United States Patent 7,365,185 (GENOMIC PLANT SEQUENCES AND USES THEREOF) - sequence listing, part 80

SEQ ID NO: 77910 - DNA, 11511 bp, Oryza sativa
aattattgtcatcacaaagcttgtttatacaagagaaacagcagcaaagcgctagtgctattactgtagcaaggaacatgttatctgtctaaaacttcgatggcagactagcatttgagaaaatcatcagggcaaccgaaaacttctattataagcacatcgttggaataggacgtcatctattaaaaaacggagggagtatgtcataaaagaaaatggaaaatagtactctctccatctcagtttaatcatctcttaagtaaaaggcataaaaaccaaagacaccaaaatattatcattcttaaagtaattctaatcggttaaggtgctccatcactttgtgacccgtagattactcgtgctttaaatattgcatgtcattgcatcaatagaaattaattttgattggttgcatgcaacacatttaatgacatccatttactctctgtacaaataaatgaaaagacacctttttttagaaaatggattaaaatccggcatctacatccacaatggatgtaacgaaaagacacttgttaattataatcattttaggaagacctaaaaaaatcttagggcacgatcaaaatgggatggatggagtagtaatcagcgaaaaaattaaagcatatgacataagagtataagaaagaagtgcaattcttaaaaaaaagaaactaaaatgaaaaacgtaaggttaaaaatattgcgtcctcctcgtgtccctaaccgtgagcttgctggtaacactttgccacaactttagcaagcaactttgatcaaccaagtctaatgtttattttattgccatatgtttgctataccatatcttttggtttcacttgccataggcatgcatttttgcctaaacttgtctaacttacagctaataaggattagccacacaaattgtgacatgccctttttgataaacttaaacaatataataagagatatatatgcatcagtgatgcggtggtgcacgacttcacccatctagagtttaaatcctggtatacataaatattacgcacattcaggtaaaacttcgatgggattttaatgagattagggatgtgccgtcgtgctgatagtttctatctctttgagtgtgtgttatggacacatttgtaagatgtgtgaatgtgatgttgtatgtatagtggtgtgtacgcgtttgttatgtcataaaaaaaagaaatatatgtgccaaagtcaaactgtcagagcgtctagcatgggtatgtcatctgggatcttaccagattttagtttgatcaatattgtgttgagccgtccgtaccagccattcacttgcatgataaagtgttgaaagagaaggatattgcacttcctaaatagtagaaattaattactcgttaggttggaatgatctttgtttcgtttaagctactgctaatgagttattaaaaagtaaaaaaaataatttcagttataatttttatatctaagtacgttattaatattttaaaagctaataccgaataacagattaagatgaattctaaaatcattttaaaatttaaattttgattacggctaataaaaacttcctctatcctatataaactcaatctggatatcagagaaagttcttttaaggagaaagaagtagactctgttttcatcaggcagctagtactgttgcgtgatgatttgagatttccaaggagaaggaacatggacggtgaccgcactctcacgtatgattggaggcttgacagcaggtataatagaaggctataagccagctataaacatattttaaacagataaaggaagagagagaatagcagcgggctatagatctgtagccagctgcagcacggacttcaagacgtgatgtgtgcatgacaggtgagaccagatattaatagtatagtaagcactatttgatgaattgactattacattggctaaaaatgatttaaaactagtattgagctgtactattaaacttgctctgaccaccattctccatctttcagacgattccccattcgttggatgtgtgactatattgtttagatggattacactcaccatcgtattgcttcgttccataccatttgctgtgctttactttcatgcccatcaagcacgtttatgtgaggcggctgacacttttgttcatggaaaggtgctttctataatatagttggttgtgttaggaagatcgttacaaaaacgctgaagaggacgataaggtatagctggcaaaacattatgtctaaaataatgaagataaatatcttaatttgggatttagccaaatttcgctttttccattctactgtctacattcactgtactatggagtatcaatgtgtcaaagcattgatgagtgaggagatgagtttccacacaattaatatgtagtactagaaaaattgtagatctttaggactgaaaatgatgttgttgcgtgatatttcctccgggttgataatacttgtcgttttggaaaagggcacggtctctaaaaaaacaactttgaccattattttctattataatatgtaaaaaagtgttaacaaatatatgattttattaaagtacttttcaagactaatctatacatatagctaccatatttgaaagacaaatgttttaaaaataattcaaattcaaagattctaaagtttgaccccacccttgtctaaaacgacaagtattaccagcccggagggagtagtgtagaaactatttatgtaacacaacagctgattgttgtcctgaaaatcattttatcaccttagtttttttttttagaaaatcatttgtcatcttcaggatgggcctatccatgtaggccagtcatttttgtgagcggaatatgttcacaccgagttcgaaattcatccctgaatcacaaaaccggatacaacacatcgctcaacttacaaaaccatgcaaacgagatcccttagcagtattatcgtcggtattggttgacgtgacgcctatgtggctcctttgactatgtcctcttcccacgtggcatttgacgtgacgcttacgttgcaatttgatctggaaaaataataaaacccctgggaccaacatgccaatttcacacacaaaataataaaaaatattggggcccatgtgacccatacatgtcatcgttactactcccctcttctctttatcctctctctcatctcttctctctatcctctctctctagtagtaagctggttcatctcatagatgctctaatggcctcacttactgagacggcagagcggggcgggcggtggctggagtggcggtagatagagcatgctggcagagcagagtgaaccatcgtcgtcaaccgctgtcgcaccagccacagctgccgcgctcgccgacaacctcaagctcctcctctggacaccttcgctattgttgccccctccgccgcccaccccgcttcgacggccagagagagagaggatagagagaataggggagagaaagaggatagagagaagagggaagcagtgaggatgacacgtggggccacatggggcccactatttttattattttgtgtgtaactgacatgtgggttccacaggtttgattatttttccaggtcgaagcgccacgtcaatgtcatgtgggacaaacacttagtcaaaggagccacgtaggcgccatgtaagccaaaaccggggacaatactagtgagggatctcgtttgcgctggttttataagttggggatgtgttatattcgattttacggttcagggatgaatttcgaacttttgtgacaaatttgaggtaactaaagtgaacttattccgttgttaaagttggatcgcaggcccgagctgcaaaggtagttgggccagtattgatgggcataaaccacggcctttctttgctcaattttgttgctcgtggtttctctcaaattgcctagattttcatgcactgttggttaatggttacccaaattgtgctttgtagcctggattttattgaatttcatcctacttcgctttgcatccccttgtcctaagaaattaatttttaagacggagggagtaggtttaaaatgtgtctcgacgtcctactcactactacaaaaatggttttttctggcggccaaaatcagtctttgctgacggttatgctagccgcctgaaagcaaaggctagagaaaataaaagttttcacaaacggaacttaaccgctagccaaaacggattttcgctggcggctctattacatgggccggcagtgaaaacggattttcgctggcagttgtcttatgcgggccgctgacaatggtccattttcgctggcaatggttctcttctctgcatccagatccatcatacgacgcttgtacagctcttggtcaacatgcggttgcaggggacgccgatccatcaccacttttgcgtaggagcggtgatctcgcttcttctcctcaaccctccaaatctccctcgcactgtccccaaatcgatgaatatctgaggaggaagcagggaaccctagctccggatcgagacccctcccttttctcacccacagccagcggcttggagacattgaggctttcgggaaaaggtcatcgatatagaaacccaaaggctgggctgagaacgcgggacggcatgggtgtagcccaaccaaagcgttgggctcccaggcagcccaggattcccctccagggtcagggggacgcgaagcaggccgcgcagatgggggtatctcaccacgctttagggaaaatttcctccaattcgagcgcttttccttaggggaaaagtgttgaacaccttgcgcgcgcgcgctccaatgtcgccacgctgtggcgccctcgtgtcgccacgacaccactctcaccgctctcgccacgacacatttttcccttcaaataagtttttaccccagaaggtcgccatggaactggaactgcctggctgcttcaggggaagaaaaatactagtactccatcaacaaaacaaaggagggaaggggaaggagcgctccatcaccagaggaaaaaacttatttatcttttttatggctaaaatataatgtattttaagataacattttacacgtatatgtaatattattggaaggatgtgactatttttttttaaaaaaaatcgcgacattcttacctgaataagagatattccatctatcaaatctattttagcagtggtatctttttttttttttgcggggttagcagtggtatctttgactaaaaccactcgtgacaatgacataataatgtcccgctccccgaccagcgtcctcaccgccgacctctgcaacggcgaggtcgcgtcgctccgtcgccgccgttcccttctgccccgccggcgccgggggtggacccggatgcattcccccaaggacatcgtcgccaagaacacgctctgacgagatcgaggtgagtgggaactgggaaggccccctcccatggtgaaccccaactccatggtgctccaggccctcgcggcggcgaatcgaggaggaggccgagaagaatgaagaggaaggcagggccgccgcggcttcaccaccaatgcttcttcttcttcttggtcgtcgtcgtcgtcgtcttgtatgtatacagatacagctatacacataattttaggatcaaaagacgtacagctatatgtatttctgggggctaatttcagtgcagagtgaattaatgcgttgttgctaattggattgctagaatatgtgtagcagagtgaaagctagtgtgaattgagaccattgaacaaatggtttagagataataacttagctgctttctttgaattgccacatgttcagttcaatcacctaattttatctgaaaagaaatgttcgatcacccttgtctggatgaatagttactcttgtctttactttctagtgatattctatattgctacgaaagcactggttgtccttcattatgtttgtaagattgaattcgataacattttttgtcgtctattgcttctttagacaaagagggtatgtatgtcagtcagtcaaacaggttttccatggttgtaaatcctctcttacaaagttatagccactaattccttcccagaaattgaaactatgatcatggcataagcagtgtagggtgatcttaacataaccagtagcatactatgcgcatcatgaatgtcagaaacaggaacataccagtaatgcgataacatgctagaggcatcatgtagaacaggaacaagaacatagcgcacacagtatagcgctaacaatgggaacaggagtagcgctaacagcagtagaaggagaagattataccccgagaatggccctccgctggatggtgaggcagaattgcctccgttgttgtagtcgttcatggcacctcctcctggcgcaccagctctggatccagctcctgtcggcggcgcagctcctgtcggcggcggcgcaccacctccgccaatagcggcggcagcaactccagacatggcgatgagcagtcgtgcaggaggcactccccaaaaacctgatcacccgcctacccgatgcagatctcaggcgaaggtgtggtttcggaggcactacttcttccaatctctcgtgcgcgcaagagatcagaagcggggaagcgagagcaactcaggcgcggagaaggagaaactaacaccgggaaagaagcgaggaactcggatcggactcgcggcctccttatctatcaggagaaagaacgtggacgcgctgttgcggagggaatcgtgggaacgtgggttagtggctgcaaaaggatagcgacgtgacgtgacgcacgcacgccggccagcctcgcccacggccacggccacggccacgcccggcccggcgcgcgcgcgcgcgcgcgtgtggcattccgacccccacctcaactggtcaacagggagcctctaataactccctatttaggttgagatatttctcgcttaaatccagaggtggtattattatcctcaacatttattatgggcctttgagatttaatattataagttgggcctagcccaattattctaacaatccccaccaaatttcaaggctcataagaaatgttctcaaggctgtgcctgtttgatataccagggttttggtggagactgttaagttaaacttccacctaggaaatgagctacatcagaccacaactgaacaatggactatgccttgaattgtcagttttgtgtgatcaggtttcactcagacccttgactggtactgggctgccgttcgcatcccctctgtttggagcatataagtcaaactccaggcctttcatgagtatctagagattgcccaaacctcatagactgtgactagcagtcgaactcatataggtgtgttccttctgagatgttctgcaggtcaacatctctgcttggaaaaaccactcggatcacattaagacataagccatcctaccatgcaggaaagaagagaagcacatcatgaaaatgagcccctttcaagggtcttttctctcagtcacacaataatttgtttcaccatccaaattcacgggatctccgatcacaatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcagcctcaactgtcgcagtatctagtgctgtaagttctgcttccattgttgacctcgttaagatggtctgcttgcaagacttccaggaaacagcgccacctccaagtgtgaacgcatatccacttgtggcttttatctcatcagcatcagatatccagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgccaggcctcgttgcgctagccaagtacatcaatgaaccaatgatttgagagtatctcagttgatcccttcctattcttcggtttttccttaatagcacgctgggatcataaggagtaggagctggcttacagtcactatatccaaagcgactcaaaaccttgtccacatagtgggattgcacaagtgtaatcccatcctcatctcctctttgtagtttgatgttaagaataacatcagcctctcccaaatccttcatttcaaaactcttggacagatagtctttgacctcctcaatcacattaaggctggtcccaaagatcagtatgtcatcgacatacaagcataagatcaccccttctcccccaccatagcgatagtatacacatttgtcagcttcgttcacaacaaagcctgcagatgtaagcgtggtgtcaaacttctcatgccattgcttaggtgcttgcttgaggccatacaaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtagtcaagcgagcaactggtgaatatgtgtcgaataaatcctcgccttccttttgggtataacccttggccacaagccttgccttatacttttcgattgtaccatcaggcctaagctttttcttgaaaacccatttgcatcctacgggcttacatccatatggacgctcaacgacttcccaagtaccattagacataatcgagtccatttcactgcgtactggtttccttccagtagtcagcgtcaggagatgaatatgcctcttctatggttcttggggtgtcatccacaaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatggggcatgacagtttctttactagaagtgttaggtgtatatttcataggaaattcattctcaaagaaagtagcatctctggactcaaaaattgtaccagcatgcatgtcgggtactccagagtttactattaagaatctataacccacactgtggatagcataaccaagaaacacacaatcaacagtttttggtccaagtttccgctttttgactataggtacatttaccttggccaaacagccccatgttcgtaggtatgagagatttaatttcttcctttcccattcctcgaatggtgttacttccttgtgcttcattggaattttattcaggacatgacacgcagtcagaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaacctttgaccaaagtgaattttggaattaaactcatgttagctaagcgcatcatacaaccgaaattcacatgacagagtcgcgaatgccacacattagactcatcattctcgctaatatggttcacagcgttatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctccgccctcgctaatgatcatgttggcagacttcctgtctttgcgctcagaacagtccttggcccaatgcccagacttgccacacacaaagcagtctccctttgcctttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgttctcaagtttcttagccagcatctgaatctcatgagcttgttctactacagaacggtcatcgaccatcttgtagtcatagaactgctccatgacatacagctcactgccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggtttacttcgtttaccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttgga

SEQ ID NO: 77911 - DNA, 2351 bp, Oryza sativa
tgcagtattcgacgtcagttcctcaaaatggtcctgttaggtgttcactaatctcagttatactgattgctggacttcaccctactgtacaactcatcaagtgacttacctgatgttcacccttagattttcatataccttactgttctttacaaaatctaattgcagtccgagtgagcaactgggcaagtactgagaaccccaagtgacatttagaagatctattcattcatatgaaatgtcactgcttagtagattcttctacaagaggcctcctgatggattactggagtttattgatagggtctatggtgagcctccaaattttgtaacacggtcacattgtccttttacgtgccatttgaactgattttgctctttgttacattgcacagtttttgattcatgcttctgcacagaagtcttgccacatggcatgtacccagtctatttgactggtattcttacagatttgcatgaagaacatagccagtcttcatttctgggtattaattttagagacggggataagagaagccaactcgctgatgtcctgcgtgaatacaatgttccagtaattgactaccctcgtcattttgaaggctgccctgtgcttcctttatctcttatccagcatttccttcgtgtctgtgaacactggttatccaccggaaataatcaaaatatcatactgctacattgtgagaggggaggctggccatcattagcatttatgttatcgtgtctccttattttcaagaaactgcagagtgcagagcataaaactctggaccttatttaccgtgaggcacctaaagggtttttgcagctcttttctgccctcaacccaatgccctctcagctcagatacctgcagtatgtagctagaagaaatatatctccagagtggcctccaatggagcgggcactctcctttgactgcctgattcttcgagccattccaagtttcgattccgataatggatgcaggccattagtccgaatatttgggcgaaatattattggcaagaacgctagtacgagcaacatgattttttcaatgcctaagaagaagactttgcgccactatcggcaggtatgtgctagagttaatttagcattgccatctacttgctttgtgtcacttttttttgcattaatctgcaaggttattatgcaggaggattgtgacgtgataaaaatagatatacaatgtccagtccaaggagatgttgttctggagtgtgtacatcttgatcttgatccagaaaaggaagttatgatgttccggataatgttcaacactgcttttattcgttcgaatgtactaatgctgaacagcgacgatatagatatagtatggggttcaaaggatcagtacccaagaaattttagagcagaggtatgagcattgcacatactctttgtaacttcaagatacaaattaataattgaacctaatttggaagtgcagatgctgttttgtgagcttgggggcatatctcctgcaagacctccaacagcaacattgaatggtgatatgaaaggaggtttaccaattgaagccttttcagctgttcaagaactcttcaatggagttgactggatggaaagcagtgacaatgctgccttttggttgctcaaggagttctcagcaaattccctccaagagaaatttcaaaagctaatactcagtgatatggaagagctttcaaagtttcaagctaaagttggtctccaaataccgctaatgtctcctctggattctgatgaagaaaagtattcagtggcttctgattcggtttcttcatctgagcatgagaaggttcagcctggtggcaactcatctgactcggagaacattaatcatgatcttaccactgaagatactgcatccatgggtatagcatttgccataagcattgtgttatgcaactttatattgctatatacctgttgctatatattccctctggaagaatatgccttgtgttgctaaacctgttgtttccatgctatcgattcccccaaaatcacttccgtttcctcccaattctgttctttttgttgctatctgtttaaattcttattcacaacccttaaaattttgcaggcaatgtcttggtgaacactccatctgtcctacctcccacgacaccacctccttgtggtagcttatctatcctttccactgatgaaaatcagctgcccccagaagtacagcatgagtcaccaagtgacaggaagctaccatctccatcaccaacagctgctgcaccggcgacggcaccaccggcaccaccgtcttcaagtggaaacaaacctgccttttcccaccaccaccaccaccg

SEQ ID NO: 77912 - DNA, 1064 bp, Oryza sativa
atcgttcatctggtatgtactactactcacacatttgtatgctaaacacttgtatcacaacctttttattcagttgttccatgatatgttggaatgttagaactcttgtttgtctaaagctttttctattagattgcacgatgcatgcacactgccttttcttccgtgaatatatatttatcctttttatgtatgtgatcagtttattgataatgagactacataagcttttgagttcaatcataaaagtgcatagtaaagcatggaattatgatttgttgcatacatggtattccctgctgcaatctttgcactcttttgagtggcatttgcttgcaacacagacttctgattttctttattgttatatttgaagacttcaacttatttgtaaatcaacaccatcctatcctgtcatggagaattctgttcctcatttcattagacaatgaattctttgtttttatttcaggttgatatgagaagagcaaacaattgcgagatcatgcttactaaaattaaaatgcctcttcctgatatgattgtaagtatctttcttgattgagccgctcccttataatagaaagagattggacatcagtttcctcatgcagaatattgataacaagttattttttgctctgttgataacctttatttatttatcttgaatacctgaagtttctgtgtttcctgggtatgtatatttctaggttttcacagttttgatttaggtatggatagggagacagagagtacatatgatgagctacagcaatggtttagagcctagcatagctaagttaagagataattgagcctgccatgatgttgttaggttgatgggtggtgagggcccatattgactatcatgagatcttttcttgttagcgatacactcatcctttcttatctctatgatctgatcgattgcataagacccgcgatagcaatagaacggggaagtatcacttggctacatccgccccttatccagctaaaggattttctaatttaatacacagttattatttttttctcaaccagacacattttcaaagatt

SEQ ID NO: 77913 - DNA, 5032 bp, Oryza sativa
gcgggggatagaggggtgggattcgaaatcgaatcccgcccatttgcggtgcgcgcgcgagcgggaaaagcgaggcgtgggcggcaacgtgggcgtggggcgtggggatgcggagtggggcgtgggagagagcgagcggcggcggttggggcggttgccgccggccgggcgcgggcagctggagcttggggacgacccaacaggtgggccccacctatcggcgtcctagaaaggagggagggggcgcgggccggcctagcaaggagggaggcgcaggaggagggttaggccgacgacccaacaaagggaaaaagaaggaaaggagaaaaaggaaaaagggaaaatgatttccagggatttatattgcggataaatgaattttaattggttaaaattattttcaaggctctgaaaattccactaaaaatttccacgacgctgattccaattattaattgcatttattaattagggaattagctctaggttaatttaaacaatttcttctggcaatttattcaacaaattttaaagcaagacgaaagggataaacttcagggcatgacacacgtgcaccataactaatagattctagttgagaagatggatttttttttctaaaaatatacgtttttttgaccgaaattgcaataatatattgagtagggaaagatttaccaaaatataccgttgccgcgctttggttaagcaagaccgtgatatcgctgaaaggattaacgaaagcgctggcgttgtcactaattgggaaagcgggagtgctaatgcatcggtatcgctcttcaaaagcgtgataccgactcggtctcgcacatgagctacgcgataccgcctgttgtctgacgtagcgcgaggaaaagcggtctcgcactttgttagtgcgagagcgcacttggtatcgcacaaccatagcgcgataccgtagcgacgtggcccaccgtgctaatcacgtgcgtgagcgcctaacggcgtgtggggacggaccggtctcgcacaatgcaagcgcgatatcgcgcgttgtggggcccgcaagagcgaccgcttcggtcttgttctttcaaatcacgagagcgcgtgcagtatcgctcaacgagagcgcgataccgatccactaattgtggttatatttcatgcgaagatggttgatatttcatgtgtgattaagccattgctatggagagtaaacgtttatttcatgatttttttagttatatgtgcaatatatatatatatatatatatatatatacatatatgtatatatatatatatatatatatatatatatatatatatatatatatatatatatatatatactacttcagacaatatacactgttcaaaaacactatttattcggctgaatactattcagtttactgtttattcggctgattactattcaaaaacactattcagtttactgtttaaattactgttcaatactgttcactttcagagatattttaactttaggatctttgcagggtggcgaatcctatttagacagcctcagaagcttgcttcagatgatgtaaagtcctactcggtactcaccgtatgcctcacctatctgtctttttagaagcaacttaaaaagatattccaagtcacacttgttctagctaagagtttatcgtctccccaggcagttccacccgaagggaacacttctctacggataccgattctccagacgcctatgcaagatgcaggctaaaaacgagaacaaaccgaagaggtttctcctatagggtccttagcataaacacttgtctagaacaaacgtgcaggaatacttaaggaaaattacttcatattaaacagataagcttacatacggttttccctttcgggaaacccgaaggtaggtacaagcaagctgttcttaccttacacagcgttataacacaactccttgcttcaatatactatgcaaggtaggctaaagtcactactactaagaacggtggaatggagggtgagagcgcgcttggaagctttgctctgaatggtgtcttcgttgttgtcttcctcagctgggcaggcccctccttttatagaggtcaggggtggcgtcgcctgtgcctcctgcttatctcttcgctactgtggattcacgagagcaggctaaagttgaggcctttcctgccgaaagttttattcttcacagggatatgtcattcaccgcaccctatattgttcctttatgcttatagggtgtccttctggattccttcttctggattccttcttgagtagtcttctgaaatcttcgtttattcttcttccacgcccaaattattgatattctattatcaatatatattgagaaacatatttagcttaaagaattctattcatctggctgcccatgaccaccaagatctatagtgtccagatcagaaaaagaaacttctaatttctcatctactgccttttttatttgttcaaatttctgatccatctcttgttttaattctttaagtatttcctcctttaattccttctttaattgtggggaggcttcttcaaatttttctattattttccaatcaatatattccccatctaatggatccactccttttgttaggcattccttgtatgtgggttttttagaatacccttcttcttttatagtcgttttaatgggtatttctggagtcttctttcctttagcttttttgcatttttgaatatattcttttgcagcaggctctagataataatttattcctagtatttttctagcctggcttaatgcttcatcaatgtctttatatttcttccaagatattcctcccattaatttagcatctatcttttgggccacaatttcttcaaaagatatatagacccctgggagctttccatcaaatacgacatatataggcttctgttggattatttcatgatcttcattagctggcattaataacccgtttattaagtgaaaatattcagagaggctattcaatattgataacatatatcctttttcttcccttttattattgtattggtaccaaaaattatccaagatgcattctttcacttcatctaagattatatggtcttttggcttaaatttatatgaatttggtgggaatattctgagcttgttgtcatctccaaatgtgaagcattcaattccgctgtaattcattgatcttttcatacctgcaattcaggtaaacgagaaagcatgtcaggcaaattattatctttccccttaatatgttcaaatataactttataaccgtttcctgttataatatcttcaaataaaacccatcttctagttgagcttttcttgctatttagctgattatagtacctacaaatggcttcacaatcggttctaaccgtgaattctttaaatcctaagtacaacctaaaggcattgattgcattgattattgccatgatctctctatctgtattattgacagtttttaatttataacttccagaagcatatctacatattttttcttctgatttagcggaaaatttagtaggtctttgctttaatatagcaccccaaccgtattgtgatgcatcagtttcaatgataaagtaactttcttctaatggtaattctagaggttttaattctttcaccttctcttttattagtcttactaatttaatgtcttcagaattaaaatatctctgactattttttcttaatttagcatataacggtcctgctaactttgctaaattattgatgtaatttctggcataatttacaagtcctaagaattgctgtaatttctttttatcattcatagcatcaggaaattgtaaaattttcttagcaatatgttcttgcaaatgaattttgccctctcctatttcatgtccaaggaagttaattttttctttgcatatttccattttctttttggataatattaacccattttgttccacctttctaaagaatatttcaagatgagcaatatgttctttgtaagtccttgagaagactaacaggtcatctatgtagactaatatgaattcttggttttcgttaaatatattctgcattttcctttggaaaattgctggtgcattttttaatcctaatggcataacaagccattcataatgtccttgaggacatgtaaatgcagtccattctatagattcttgtgccatctttacttgccagaatccagctttcaagtcaaattttgagaaatatttactaccttgtattctattaatccattcttgcttatttgcgatattataggcatcttctatagtattatcatttagtcttttataatttatgaccatcctagatttacctctaacttcttctgcatgatttcttactatgaacgctgcagacctatgtggacttctgctttctcttatggctcctagtttcaacagttcttctatatgcatcttaaattcttttatgtctttcggagttgcttctattgggctagtcttaataatatactctgggtttattatattaattttgcactcaatagcatttttttcccaatatttcataggaatttctcctataatttggatatcttctaatctttgaataattttttctatatcccttttagacttaatatccctataccaatttggtgcaaatgcttgtagtcctatgcactctatattggaatttgatatataatagttgtctatattctcactaagctcatattcattaattctttcttcagactcaagattaggtacttctaagaattaatgaatatatatatatatatgtatatatatatatatatacatacatacatacatatatatatatatatatacacatatatacatacatacatatatatatatgtatatatacatatatatacatacatatatacatatatatacatacatacatatatatatatatacatacatatatatacatacatacatatatatatatacatatatatatatatatacacatatatacatatacatatatatatacacat

SEQ ID NO: 77914 - DNA, 4771 bp, Oryza sativa
aacttgtaaatattactggatatcattgggctgttcagcgagaaaagcattctccatttgaagcttccatgatcacaaacatcatataaacaatcaaaatcttgttaaaagtttttctcctctttaattaaattgaccaagtttccaagtataaaacggtgaactacattacagaagtagacatgtgtaactaactttaaaaaaacagtgaattactcacgttatatggtcatgcacagcaacgaacatgtgcaagcattgggtccaggcatacatataagtttcacacaattacatggcacattatattaaactacatgctcccattgattttgacgagccacattatatcattgggcatccctgattgcgatctgcatcttctctgcggcgcctcagttacaacgatggcgagtacggatgacagtgtccctctaacttttaagttggaggagctccttcctggcgagtacatcgcatacacaacggtgtgagctgcaatacaacacctcgaagccatagctgggaagcaagacaagtactattcgtgtcaagtgtagccacttttgatgttctacgactacaaatggggccatgggggtcctatctggttgagcccctcccatcaattagcctcaatgcctcgtccatcagacaaggcatgcaggcagagaagctgttagctgctgctggtttagtggttttctgaaaggcaccgtgtcaaatatcatgaaatcgaccggtctgaacatatggatgatttagcccacacaacaaatcaatgcaatgtggcatttgattatttggttagtattcactattcaggtgtatgcattaagtctcatgttatatgtaggtctaatgatatccattgcttcttgataagtactgtcgtaatccaaaaatgtaagacaattggtgttaaagttagaatgttgctgcagttagatgatattgccttcaattttctgaaattactgctatccccatgaactggtttatttggcccactacacaaatcaatgctatttggttaatatttagtaaatacattaagtgtcatgttatatattggtctaatgatatccattgttttatgatattttacaggcgtactccaaaaaagtaagaacattttgtgttgaagaatgttgctgtcgttatgttgcttgggttttgtgaagttggaaaattaagctcctaaatgtttttttgtgtactattgtctttattataccgaagttataatgttcttgaatagggcatacgcagattgaggatttattttcattgagtaacaatatttttattgtacttttgtccacgcataggggagtgtggagttgctattgtgaaattattcaaatccagattagtattacataaggattttacctattcttgatatgtcatgcctaaaattgtaaggaaattgtattgaagagcttccctgtgcagagctcattggtgctggagtttgagcgatggttcttttgctctttgagatgtatgttgccttcgctgctgcaagctaatttttttcttccaaccacaatgataaagaaatagcaatttaattattatgtttttttgtcacttggttttagtgccatctatgaacatatgtctctcttcctccaactctccatggaatcaaactcctcacctgctagccacagctcaaagctggtgcattggttttctccctggtagaaaatacataattttcttattgcattttgttgtttgttgaccactgactaacatctccattgctgccgagaacaacatctaaggtttgcatgtgtactcgcaattcatccttgaaaatgtcttgatcagaagtctggtgtgcatactttcttgcggtatactgatcttaggaatttgattagagttttgatgcatgaaagtaaaagtgagatgaaggtttatgcatgaatatatttggtcatcttaatttgttttcagcattgttaatatgtatgtatgctgtcattttctcctgagaaaaactcgcatagtctcggtcgccatgtatcaagtatagatatatggtttttttttccaacagaagttttgcgtacattttgttcagtgcagttttcttatattctagctacttcttgcatgtacatcttattagcttggtttccctttagcacttgaactgtaattcagtaagaaaataatgccttgatagttattctcttttacttgcagtttcccttctagctgaaattgtgcaaagtttgatcattaattgtttgcattaaaatggtagcaatatcgcattgtataaattgtgcttgacccactaaatacgtttagctttcttggtaaggaagtagtgattcgacagagtccaaattgtcagcttagtatagtctatatgaaattgtcttagtaccataagaatttatgtggagtgcattgcatagaaatgattgcatagattcttctttgtttgctaatatatactgtcaaaacatgtcttgcatgttgtcacgtccagaaattcacgaaccggaatttctaagctgaatgtgcattaaacccctatccgggaccagccatggtacacaaacgataattgctgacacacagatccacgtcttacaaaaataggaaagattacaaatgcagcggaaaagataaaacgagctagacttaaaagcttgactcctgcagcgaggcgactctactccacaggcatccttgacggcagcgacgaaaccaacttcaacaagacaacttcaactgggaagatcttcagctctggcgtgggggaagagagagcaagactgagtactacccactgtactcagcaagtcatactggaagaggaggtatgatgcaggatataaccaaaggaggctaaaggttcatttgcgtaaagtaggcatttaaaacagtagttgaaaacagtaaaacatttgtaataaattaatcaatattaaccaatcaccgctcaacgctacaccacgttgagacaggtccaaaccaccacctgtactaaccagttccattaaactaaactaggggtgagactaatcacggtgaatatgtttgatcgcccataaccacgggcacggctattcgaatagttttactctagccagaggtgtacaactgtacccacaagacacgattccacacatgtcgccaagccccgaagtatcaccatgatactgcaaagggggaaatcgtgacaagaccattcgcataacccgcccctaaccatccacaccacgctaaggtttcacccccacctcctaccccggaggtaggcagcccccttgtgcgtcgcggtgaatccgacagctggacaaccggacaccccggccgacccaactccatcacgcctgccctcgccaccggtgcctaggaaatggtcgagctatactacaagtcaagcagttacccactcccgcttgtggtaagcatggtaagtcttccagggtttcccgtgaaccagtccttaactgccatgggtgcgaccaacaaaaccatgcacccacatcccaccatttagtgtgttttaattaactaacaccattgcagtggcaccaaaccaaagtcatactaaaagctaatgtctacgcattaatgtgattccccatttgtgtactagttgaactaagcttggctaagcatttcctaaaccaatatctagtcattttaatacccaagttatcaatggcataaggtaaacgacatatggctgagtaatatgacccatcccacgtgacattgtaaaataatgcaacatttaatagaaatgcaggacatttataaattgggtacaatatgatcaattgtaatgcatgacttaccttgctctcgcactgatgagaccacaacaacatcttcgaggaaccgcggatcaacgaaacggccgaaatctatgcgacaaacaaagcacacaagcaaaacatgctataagtctactgaaacaggaaataaaaaccattttaaatggattatttgcatttttctcgatttactgagacttgaatggacttaaacggagctcggatgaattagttatgacttttagaatattctctgtgtttttactaataaagaaaacccttatttgatttattgcacaatatatcctagggctgacgtcagcggcggggggttggggggggggggcgacggcgccgacatgcgggcccactggacagtgactcaagggagaggggagggggcgcctggcaaagcgggccccactggcagcggctcaaagggggagagaggggcgccggctggtggctcggcatggctcaagctggtcggccatggtgaggcggcggcgcacggtcggagcggcggtgcggccaaaggtggcggcgcacgtgggacggggagaaaaggagggggagggattcctcatcggcgaactcggaggccggagcggtggatgaaggcggcgatgacggcccgacgagcggaggggcggagggacggcggcgacacctagaggaggggaggagaggggttaggagcggagaggacaaccacgacggcttacatcaccggtcggagatggacaaaaatggagggctcaccggcgaggcgagggaatcggagctccgacggcgattagcgacagccgagcggtggccgaggtagctcacgcgacggcgaagctaacggcagcggttgcacagcgcagcggcgaccctagaagcggtagcgcgcggccggagagtgatggcgcggcggcggtagggggcgcagaaggaagcggcaagagcggaaa

SEQ ID NO: 77915 - DNA, 16765 bp, Oryza sativa
gtcccctgtgtcgggcgagtgacggcgctgagcctcactgaaggacaagctgtgatttagtttccgggcgaaggcgcgaaccaagttttggtcaagatagggtgggtccccatcctaaagaagagtaggtaggagtggtgcatgtggtatccccttgagatataaaaggaggaccttgcccaccgaatggggggttggttgattcgaactccggccacttggttccagagcctgaactctctctcgctctcgagctctctgtaactccttcatacacagatccaccaaaacacaggagtagggcattacgcttctcagcggcctgaacctgtctacgtcgcccgtgtcttgcgcgattcttctcgctgacatcctcagatcgacgagggcgaagaacctcacttagcgccccggtcgaaccggcaaaggggggcatgcgcggtctcccggtgaggagccccaagctccgtcatcaagcgcgccaggtagagggcgcgcgtgtcattcgaagccctcgtcctctttcgtgtgcgccaagcttctcccgctcagcccaatggccgaacgggcagtggcgcacagcctctctccgaacgctagtggtgacgacggggagcagaacccgcgccgtcgggctcgcaccccaccgtccccctctcgccgaaatcttgggcgaggggaggtgctcggagaggtcggaggatccgcgacttcgctgcccacggacgacgggggaggacggcgagacggggcgcgtcgtcgcctcgtctacggcaatggcggcacgccccagggcgcgctccaggctgcgggcgcactcctgcgtcacccgcccgtcgtccccgatccagagactccagcccgacgttggctggatgacgtggccgacttggtcatgatggcgcagcagcgcctaggtgccggcgggcggtcctccgccaccgggacctctggcgctgccgccgctggctccacgtcgtcgaggcggagggcgcggcgagcggcggccgtcgcccaccgttcgtccgccattccctcgtcaacgcctccgacccaagatgtgcgtggggggtcagatgcctggctcgatatcgagcgccggcgcgacgatcgtcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccatcaccgaaaaatacgacggaagcttcaaccccgccgagtttctccagatctacacgactgggatcgaggccgccgggggcgacgacagggtcatggcgaatttcttccccatggccctgaagggtcaggcgcggggttggctaatgaacttgccacccgcgtcggtccactcttgggaggatttgtgccagcagttcaccacgaactttcagggcacatatccgcgcccaggcgaagatgcggacttgcacgcggtacagcgaagggacgatgagtctcttcgctcgtacgttcagcggttctgtcaagtccgcaacaccataccatgcatccccgcacacgcggtgatctacgcgttcagggggggcgtgcggcacaaccgcatgctcgagaagatcgcctccaaggagccccagaccaccgcgcagctttttgagctcgcggactgtgtggctcgcaaggaggaggcctggacctggaactcctccggctctggcgtggcagctccggccgtccccgagtccgccgctcgatcagggcggcgggacaggaggaggaagaacaggtcggcctgttccgacgacgagggtcatgtcctcgccgtcgagggcgcttcgcgggccccccgaaaggggaggcctgcgagcgacaaaaagaaggaggccggcgctcccagcagggagcgcccgactggcaagtggtgcaccgtgcacaacacctccctccacgacctcgcggactgccgcgcggtcaaaagtttggccgagcggacgaggaagtgggaggaggagaagaggcaggagcgccgtgagggcaaggccccggcgactcccgccggcaatcggcgaggtgaggccaaacagaaggcccccgccgaggacatcgacgatggcgacgatgacctggggttccaggagcccgaggccaccgtcgccaccgtcgatgggggagcgtgcgctcacgcttctcgccggagcctcaaggccatgaaacgagagcttctggccgcggcccctacccatgaggcgacgcggcgggcgtggtggtcggaggttgccctcaccttcgaccagaccgaccacccgccgtgcgttgctcggggaggacagatcgcgatggtggtatcccccaccgtctgcaatgtgaagttggggcgtgtcctcgtagacgggggtgcagctctcaacattctttcccccgcagccttcgatgccatcaaggccccggggatggtgctccggccgtcccagccgatcatcggtgtgatgccggggcacacctggccgctgggtcacatcgacctcccggtcaccttcggtggtcccgccaacttccgcacggagcgggtggacttcgatgtggcggacctcagtctgccctacaacgcggttctgggaaggcccgcgttggtgaagttcatggcggcggtccactacgcctatctccagatgaagatgccgggccccggtggccccatcaccgtccatggcgacctcaaagtcacgcttgcttgtatggagcagcgcgcggaccacctcgccgcggtgtccaagcccgcgggcggcgacgagaggctcagcacctccgtcccagccgccccgaggcagcggatgatcacgtgcgacgaggtcccggtcaaggaggttgccctgggcgatggcccgtccaagaccacacgaatcggtggtcttctggatgacaaataggaagacgcgctcgtctccttcctgcgggcaaacgccgacgtcttcgcctggagaccggcggacatgcccggggtccccagggaggtgattgagcaccgtctcgccgtgcggccaggcgcaaggccggtccggcagaaagtgcggcggcaggccccggaacgtcaagccttcatccgcgaggaggtggcgtgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccatagggacttattgttatacgacaatgcctttcgggttaaagaatgcgggtcctacttttcaacgtactactcgaatttctttgggtagccagctaggacgcaatgttgaggcctatgttgatgacttggttgtaaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagagatgtgcaatgcgtcaccggctgcatggccgccctaagtcggttcatatcgaggctgggagagaaggcgctacccctatttaagctcctcaaacgttccgggccgtttacctagacggaggaggctgagcgggccctcactcagttgaaggcgtacctcagttctcccccagtcctggtcgccccggagccagatgagccgttgctactctacctagcggcaaccccgcaggtggtcagcgcggcgttggtcgtggagcgtgacgaggacaaccctcactccgcgcatccccaccctgtgtcgactcgacccgggagagagcaggaaggagaggcccctgagccgaacggcggcccgaggcccccgacggccggagctggccctccgcccgcttgtccgacggtgctaggcgccccgacctccaggatggcctcggggccactgcgggaaggccgcgcctgtcacctccgaccccgaggtcgtcggcacagaagccgagtgcgccccgcgtggcctctcggacgaggagcgccccggagatgcggcccctggcgaagaggatcggccccgccgaaaggtgcagcggcccgtctactttgttagcgaggccctccgggacgccaagacccgataccctcaggcccagaagatgctttacgctattctgatggcttcgaggaagttgcgccattatttccaggcgcatcgggtcacagtggttacgtcttaccccctcggccaaatcttgcataatcgagagggtactggacgggtggtgaaatgggcaatcgaactctctgagttcgatttgcactttgaaccacgccacgcgatcaagagccaggccctcgccgactttgtggcagagtggaccccagctcccgagcccgtctccgtccccaaggccagctcgggcccctcgtagctgcctcacaccgcctactgggtgatgcagttcgacggctcgttgtctcttcagggtgccggtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtattaggcgactcccagttggtcgttaaccaggtctccaaggagtaccagtgctctgacccgcagatggacgcttacgtgcgccaggtgcagcgtatggagcaccatttcgacgggatagagcttcggcacgtgcccagacgggataacgcggtcgccgacgaactctcaaggctcgcttcctcgcgagcccagaccccaccgggcgcctttgaagaaaggcttgcccagccgtcggtgcgacccgaccccctaggggagacggacgcgcctgaatggcccccgaggcccgtcggagtccaggcctcgggacccgaggggagcgcttccagctcccctagattgattgcttggatcactgagatccaggcatacctcgcagataagactctacccgaggaccgcgaagggagtgaacgcgtccggcgcatctccaagcgctacgtgctggtgaaggggaccctctatcggcgcacggctaacggagtcctcctgaagtgcattcctcgggaacaaggcgttgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgctagttccacgccaagcaaacccatcagccggcccaggccctgcagaccatacctctttcatggccgtttgctgtctgggggctcgatatcctgggtccattcaggcgggccccgggcgggttcgagtatctgtatgtcgctgtcgacaagttcactaagtggcccgaggcttatccggtcatcaagatcgataggcactccgcgctcaaattcatcaggggcatcactgttcggttcggggtgcctaaccgtatcattacggataacggcacccagttcactagtgagctctttggtgactactgcgaagacatgggcatcaagctctacttcgcctcccccgcccaccccagaagcaatggccaagtggagcgcgccaatgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcgaaggcggtcctcccatctgagctcaccctgaggtcccctcgggtcaccatgtattgcgaggctgatcaaggtcagcttcgccgagatgacctcgactacctggaagagcgaaggcggcgcgtggcccttcgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgagcaccttcatcgcttctacccctagtgggggtcgggtgtcatgtctcgggctcgggccaaccccgcacccccccctcgggcgtacagggctggccgggggctaccacatgcatatacttatcttttttctcttccgtatttcaataaaagcattttcgatttcctaaggactgtgtctgtgctattgtttccttttgaagaatcttggcttgaattagcacgctcgtgctcgatcctgctctcggtggcccgggccggctaaaatcgccaaaaggggcccagaaccgagccgtgccccggggcgtggtgaactccgggggggaatcggcaaaggcccacaatcgggtcatccataaccctcggtcaccacgctcccggcctggccagtctcgacacgtggatctccccaggcactagccccgacccgcgccgcttggggttgggacctgggcacgagccctcgttcaagccaagacacagaaggaccgtggcacagaccatcctcgtatcatacacacaacaaacataactaacgtagaaatttcctctttatttgattacagatttaattacagattaagtcagtctatacaagaagggggccctaaggcctcggaagaagaaggaaaagtcgttaagattcgcgggggcctgggggctcactccgacgcacccgggtcgccggcctcgtcgtcgccgtcgtccgcgccgtcatcaccgccctcctcgtcggagtcgggcgcgaacgcgagtcgaggggccgtaccctcgaagctgtggacgatgtggttggcggcgtcccggacctgcgcgcgcgcgcctcctcggttccgggagggaactcctccagcgctgcccacggagagaagtcagggtccctggcctggtagctcgccaatacgagctccaccgccccccgggcgaggtccctcgaggatgacttgatcatctcctcgagctcctcggggagccgccagaggaccccggccatctctgagaggcgctgggcgaggcccccctggttggcggcgtacttcgcgcaccgcccgccccagaggcccgcctgccgcccggcgcggtctagacgagagacggcgtcccgaagcatgccgggccctacctcgttcgccaaacggagggcctcaacctccccggtggacgagtccagtgcgccttgcagcccggcgatggtgtgttcggcggctgcgaggcgggcggctaggtcgctgtcgcccgcggcagccccgccgctgtgcgctctcgcgttcagctccttcgctcgcgcctcgagctcagcggcccgctgatccagtgcggccctctcggcgcgggcgccttccagatcgcggcgcgcctgctccacccgcgctgcctcgcggagggacaggctgtccgctagccgccgcgccgcggcctcggcctcctcgagagctcgctcccgctcggtgagcgcgtcctcgcggaagcggagtgcggactcctcttcggcgcaggcggcctcgtgcgccgccagtgttgcctcccgggtggcgacggcggcctcgcggtccgcaaggtctttctccttcgcgtccagggcgcgggcgcgctcctccagcgccgtggcgcgagcctcaagggcctcttcgcgctggcgggacgccgcctcgttctccgccgcccgccgctcccaggcagcggcggcgtcgaggactccccgggcggcgtcgcgcttcttctctagctccgccgtccggctcacgtattggaggcggaggtcgtcccgcgcctcgtcgagcacggcggcggcgatgagagcggtctcccgctcctcctccacctccctggcgatctccgccaggcccctacgacgggcctcaagctctgaggcgtgccggcggtgtgccttgcggcccgcctccaccatggcctcgaccgagcgccgcccctcctcgacgcacgcccacgccgcgtcgagctccgcccgctctgcctgcaggacctccatctgggcacttagcccgtccagcaccgtggtgttcacggcggccaaggcctgcaggaggggctccgcgctcagtggggcagcggaaggtagaggggagagccgcctcggtgtgggtgccgcgcggctcggcccgccgatcgacgtgccggactcgggggcgtcccccgaagctggctcctcccgagcatcgcccgaggggtcaggcccgagcggcgcgctcgcggcctcgtcgtgggtggcctcggaagtcgtcgtcgcctcgggcggagtcgggtcgggggtttggcaggccgcctggcgtgcgcgcgccgcctcctcctcccgggcggactccccggcccggcggagtctggcctcctcccgagcggcctccttagcctgacgaacccggacggcctcctgggctgcctcctcggcttcccggaggtggtctgcggcttctcgccggtcagcttcgcgcctccgggcctccgcggtcgccgtctcctcggcctcggaccggccggacttggaatggcgggggggggggggggcgatgggatctcgctgaggcagaagaaaaaccagaaggcaaaaagaaacgggtgagtgaaaactcgccttgggagatggaagaacgaatatggccgcgatgggcgcgggaacgaacctgcgaggaggtcagctaaacgaccaccttgggggcgagatgaggtcccccccggcatggctcggtcccccccatcttgcggagccgcttcttctttcgctccccctcgggctgcggcgacggcgcggcaccctccgggcgcctgctgctggcacgcaccgccccgccccctcggggaggagatgggggggcgtgccctccagcttcctcttcccccgggcgtcggcagggcggctgccccccgggcccccgtcgcgaggcccagaagcacgaccccttcccggggtagattgttcccccctacggctcccgcccgcgccatcgtggcctcggagggcccgctcccccgacgccccgaccgtctgcatgatggtcaggatgctggcgcgatctggatcgctgtagagggggaggataccttgggggataagggatgcctccacggagctgagattcagcacccgttggaccactatcctgaagtcctcggagtcccagtcccattggcgcccctggtgggtcctcatgatgtcctcgggcccggtgtactcccaggcgccccgggcgcgccgctggagcggcgcgatccggcgacgaaggtagtcgccgaacaccatggcccccgtgagcccctgggatcgcagacccgccaggcggtcgaaaacggcgtcgtagccgtctcccagatctaccgtcgcccgccagctggaggcctgcgccgggggctggctcggaagtcggaggcgcgcttcgtcggcgaggggggtgtagaaccaatcgcacttccagtcgtcccacttcttggggaggacgcagggaatgtagcgttgcagcacctgcccccgcggttggaagtagcagccaccgactaccgtcggcggcgacaccggctgtacggtgaagaaccaccggaacagctggagagatgggcgcaccccgatgaacatctcgcacaggtgcgcgaagatggccaacgtcattatcgcgttgggggtgaggtgcgccatctggagatcataaaactccagaacatccatgaagaaattagagaatggcgggaccagccccgccattgcgaaagagaggaagaagacggaccgccccgggtagtgtggcgccgggcgtccctcgcccagctcgaccacctcccggccggtggcagattccggcatgaattggcgcggcagcccggcctgcctctcgctcacgatgcaggaaggcggcagcacgctaccgtcaagcagtgcggagccccgtgccatgacgccggcggaggaggagcttgagagcgagtgagtgcggcaagggtagggcacaggaaacgaagagttagagctcaaatggcggaggcaaggggaagaatggcgagaggaaggaaacgaatctcttcctcggcgtctttatacccttgccaacgctattcccggctcctcgtttcccgcgcctactacctcgccccctcgtttctcgcgcccacgcctccactaacccaactcgtccgtttgcggcgcacgaggcagatgtgcggccgtagcagttgagatgggacagatcgtgcacgcattaatcgcgctcgccaaacgcgaagatcgccatcatcatgtctccaggcgaaacgaaccggctcgtcccgattcgcgcgctgctcgagtaatgtagcggtcttgaagagaccacttattattgtcgatcggttttcccttgccgatgtgcgcgatttgcgaccgctgggtttctgcccgcctgaagagaccggccccacctgtcaccagacctaaggagtggcgtcacgaccgagcgtttccctccaggggggcgatcgccctggcgtaacgccgggggctactgtcggtgacatgggaccgggggtatcatgactagaggattgggcagccgcggtcacccacgtggcccgaccccctcgggggggtcgggcccgagagtgacgtggccacccctccctctgtctccccgaggggtcgggccgctcccgtttcggccccgagggctggggcgccccgaccccctgtgggattggcaccacgtgtgtgggttaggtgagcacagcggcgctcacctaaccgcatttactgcgggttggacgagcgcgccacgccgcatttaatgcggcgcagcgcacgcttatccggtccgtgaccggtcgcagtgtgtgaccggtcacagaccggtcagatcgcgggttaggtggcaacaggcggcctgtcacacgcctcgccccgtcccgtcggaatgatgagagcctccaggcgctcgtccctagccggagccggcgtgctaacccctggagttggtatgtcagtcccggccagatacattccaggcttcatcgcaaccattgcaaggaagtcattgtatgaagaagggcagacgtgcagcatgctaaactgacgtgcggtggacaagaatgaccggtttgtgactggtctgacgccggtcacgtcattggcaggcaaccatgctcccacgttgcatctgctttcagcggagtggaggtaggtatgacccatcccatcggagggtcatccggacagcggccatcgcaaatcttcgcccattaatgaaggaatgacagggttgtcccctgtgtcgggcgagtgacggcgctgagcctcactgaaggacaagctgtgatttagtttccgggcgaaggcgcgaaccaagttttggtcaagatagggtgggtccccatcctaaagaagagtaggtaggagtggtgcatgtggtatccccttgagatataaaaggaggaccttgcccaccgaatgggggtttggttgattcgaactccggccacttggttccagagcctgaactctctctcgctctcgagctctctgtaactccttcatacacagatccaccaaaacacaggagtagggtattacgcttctcagcggcccgaacctgtctacgtcgcccgtgtcttgcgcgattcttctcgctgacatcctcagatcgacgagggcgaagaacctcacttagcgcccccggccgaaccggcaaaggggggcctgcgcggtctcccggtaaggagccccaagctccgtcaactgtagtagtcaattagacgtggttgtagctaggagggtggtagtggtggcgagatggacctggggagggcagtagtggtgacgaaccgaagtcatggaaggcggtcccccccggagcaattaggcaagcccaacgggagaggacattgacaccgtaccaaagctccgccctctcctgccactcccccatcggtctgtagtgcgaagtgcacgcgtcctcgaagccaactaaagacggtgctggtgggcaccctcacgaatcccaaccccactcttcctcaggttcgagacggaaggaagcagcacggagatggagctcctaggctcaagacgagaggacaacagtcgccgtttgttagggatgacatgcccctccccactgttcgtcttctctcacccttcctcggctccgcctcaccactatcgccacccttcccgggctccatttcttttggaaggtgatagaggaggaacatagagagagagagtggaggtgaaaaagaagatgagatgagtaggaagtcgctgacatgtgaattccacctgttgacctatcgagtcaacctaccatgtcaacagaaaaaccgtttcccgcaccaccaaggatgcgaagtagacttatttttcaccacactacaaagctgagtttgaaactgacctcaaaagtgaatgtacatgcgtgtgcggggtcgcatgttcagacagccaggcctaattcccggcccaagttccggcccatccccagttcactccgatgccagccattatggcgggatgcgtgaaataccaaaatatttttttcccatctccctcgcgagggttcaaactcctcccccaaaatccaatccccaatccgcgccgcccccattcgtctccccttcttttcaaatcccctctcctctcctctctcctcgccgccaccgcctacctacctccgccgcaggaagcttccagaaggttccgggaggccgcggcggagaggcttcaggtgagctctcccctttgccttcctctccagtctccatccggtcgagatttgacccctcgctgccgagcccaccgacgctcgccgccgtcgagatcccagctgctcgctcgcctcctgggccgcccagccgctggatcggggtctttgctgttgatttttcttttcatgccaaatgcgggggccatggttagggtctagtgcccaatggcggcgcgccgcggtttgattcgagggcactgcactgctgcgagttgcgcagctcagatccaatcctctcacttgcttgggatttttatgaactagatccatacccaacctgctagtgcaactgctagtggatagtaacaaatttgctctaacttaaacggttttttttttttggtcacatggttcttcctttaggggtacaggttgagggagaggaaggtatggtttggtgagtcacaggaagggatgcggagctagaagattggaggctacaatggctcaagccgctgttcaatcttctctgaatggtgacttgttgattgggagggccgcgggagttccgaggatgaagaggaagaccccctctgaactcagagtaatttgcctttaacctttatatgtgtcaactatgccttctttattttcaccatgatgtgatattagatgagatatttggtgaaaatgtgtgtgcggtttcaagagatttccatttgataaaaaagtattctctaatactgttctgttccagataccaagaatgcacattaactatactttgtataagcaaacctgcaatatttaaggacaattcatatccttgcaactttccatggtgcagccctgatgcaatgagcatgatatgttatgccatatgaaaagactgacgaagaccattcccaacgcatctcaaaaaattactatatcattttactgcatcaagtgatatttgttttacttagctaatgctagagaagagtaataacatagtcacttcaaactgcatttaggataacttctgttatatatgcatgtttcctttccatggctgaattgttaatgacaattagttcaatggaggccagtgtaagcacacacattacttattgctgctctcttgagtgctgctttaggcataaaacagtacagctgcttatgaatgctgaaaatgttccgataattacttattgcagggagagcaattgaagcggcgtgcttctgacaagcctgctaatgaccaatcactccattctgcggcatttgataggtagctaatctgcaatctgttttagtgatgttccactttgcttgtatgaaaaacttaataattctattatcgcggtgtagggcaagcaatgggtttcggaacccagagcaatcaaaaatatcgaaatacatcagtactcgtgttacagaggtgttcccagtaaaaaaatctagaaaccttggaaaggaaaacttcaaggtcagacattgtgacatcattcacttttatggaccttaaattgttcagtgctaaatgccacatcttgaaactaggatgctttgcagaataatgagaaggctcccaagtctgctgatgctgtgacaacttctgattttgcatcaccttcactcccatggtaattatttgactggataattttatgtacttgatgttttgcatcgtgtttatgttcttatgtggattgtttttgcgaaaattcagtggttatggtgactctgctaagttggactctgctgttccatcacatactgaggcagctaaaccaagttttaggaaagttgagaaatgcagtgaaaatgctttgcggagtgtatctgagctccatattggtgatgagcagcagtctggcactaataaatttgatatggtaaggagcaccaatctatctagatcatcttagtatatgttgtttgtgtgctaatatttctaatgctttttgataggaaaaagtactcaaaggttttggagctcgtgatgcttttgtggcctctaagctcactgacccaaacatacaagttggtgttgtaccctcgaaatctttggatttgtgcccttctgagatcgctgttccaggaaaaagagctctttggatctcaccctgaagactactttgcaatttgtttcatcatcttctgtaaagtggtgggtattttactctttcttgccctttcagcttgtcagttggatgacatatccatctcaaagtaacagttgtctgtttgcttgaattggtagcatatcttaaacctgtaactataacctccttgaaaacaggtttcattttaggtcttaaacatggcatgctaatatactcatagaacaaggaataacaacttagttttccgcgcacataaatctaacaccagtattatatttaacccaaaagaaagatgacaggcatttgcaaaattgaaattatatatatattttttaaaaagcatctggtttgaaatggcagagtatttggcaaatggttatgcaccattataatacctcaaataatattacatctatagtagtcccaatagatggcatctacgaattaggggaatggaaatcaaaacttctgcttttggagtgttatcatgaaatgtggctgttttcatttgaggttttctgcatagaagtgaaaaattctcctgtcaataactcttgtatgttacaggtgtcacaagataagtacaagttttggtaggagcagcattgtaggacccattgcccaaagttatcatcatgggtgtcaaaattcaggatgctcaaggcctgagagaaacaaggaattcttgttctcaaaggcactacaatcatgggtatatccacaatccttgttgcctgcttccatcatatctgcaatggtatcatcaactgtacgaggaggtaatatcaaaacctgaaacaatcctgtaatgttttgtggatgtaactaaaatgatatattcctctggtcatgtagaaagtgattttctcctcaaaaggcatcaggactgggaagattcatttcagaatctttactacatgctccggaagaatctgttgaatattttttatggtattttcatgctccttgaatccaactgattcatagtaagctacatagttggaaaaatgtaatattatggcatttgtttagtgtttcacatggtctgcttgcttttgtgctgttgtgcactaaaaaaattgctgctgcaaggtttttatagcaaaaagtttagttggacacgatagttatacaataagtaaaaacaccatctatctaaggaaaactatgaatttaaatttagtgccaacacatgtgccttttgctcaaggcctcatttgcagttttcaaatatgagatgttttattagactatctctgaattactcattaattacaatgaacatttgctttattgttctagtttatacgccacaatttgttgctctcttcatcggtggaaattgtttggacaagaagcagacctgtaatgcgtacctatcacaatcaacacgtgggatacgatcattgctgcgaagacatgtgagttctttctgtttctctatgcaattacaattcgcaatgcacacattctcctcttttttttttcat

SEQ ID NO: 77916 - DNA, 20637 bp, Oryza sativa
tagactttttgttccactgcttttgttgtggcgggtaaacgggcactcccgcgggaaatgggcatgggcaaccattcttacccatcatgtagtatgggtaggcactacccgtgcccgtcgcgcccgattgccatccctagcggccagtgagcttgtccacgtgaggatggtgggaggtcggcgacgaaggggcttcggttgtccgtagcaatggaggagaggagtaggaaagtgagggagccagtcgtccacagcggcgacgagaaggaatacaccttagatttgagatgggatgtaggccaatcatggaagaagctagttgcagcccccttcgaacctgctcacgcaccgtcctccgtgagactagggctcactcacacgagaagagagggtagcatgggtggactcgggaggaaaggagccccatcctgaggaggcgaagagatggagggggggggagtccagcggtggtggtggtccttccttaaattgcttcctcatcaccactccaggcgtcctgtcccgtccacgccatgcgcgcgcgcggttaacctactcatcggcaacgcgcgtacaaggaggtgaagtggaggaggggaggagtctggtgatggcggagactctcctcgccctgagtaacgagggggagagatagagaaagaaaaaggagggagagagaggagtgagagaagaggaaaggagggtgaggatgatacgtcgggcccatttttgtttttgtcatgtaaacgcctagccaacacaagtggaccaggtcaatttgccacgtccgtgaaacccaaaagacctaatttaaccatgttttgcaagttggtgtttaagatttttggtattgcagtttagggatgccaattaaatccggcgtaaagatgagggaaggtaagtggacttattcgcagataaaaaggcctactaagcccaccaaatttaatgggcagcacgtaactcgcattttatttccggggcaattgctcaaatgccactagggtttaccgtatttgtcattctgccactggtttttcatcaattggtagaatgccactggtttcacagttgggcacgccaaaatgacactctgtcgttaagacggttagtctacacgttagattggagcaattaccagtctgcccttattacggatttttgtgtttctttgccaaccgatggtagttggatataaatgacgcaagcttttgtgaagaatggtattatttcgatatttttttcctattatatttttgaggttgcaggacatttattttatttttttatatgcataattgtaccatggtccttacgttagatttattttgtattttttaacaggatgggtcattttgtttatatttaattaatgaataagatttttcaacaaatatgattctattagcactagctcaaatgtaagcgagcaatccataaacatacatgaatcaaacatcatcaacttgcacataggcacacaactggtttcatcagaacatagccaccatggttcaagtgacttagacattacataacaaaagcacatttttgttccagtacttaaagaacataccatggttcaagcgactgagacattaaataacaaaagcacattttgttccagtacttaagaacaaagggctccaagaacaaaacacagattagtttcatagactatcatagagcatcatcatctactgccacttttgagttccatcagattggaagacaacactagatggaatctggagttggtttgttccttccaacctttcttggcctgggaatgtttggagttggcatagcactgttcaaggtttgcaaacaaaagactaattagcactagagtaattagcacataagatgtagttagtatttttagtttgaataaatttaaactaacctagaagatgtagtgcaactgtcctttttagcccttcctgccttttttggtggcatttggacagtgatggaagggtcattgcttccctgccctgaatccatttcaggggttgagttgctcttagtcctgcatgtaataaatcattagactgaaatgaatacacttatgatgtacaaagaaatgaaagtggcatacattgtattccttttcttctttgttgcaacctctcctccctggcagtttttatctctatgaccaaatcctccacattctttgcatttgtgctttgtattttgtccagattcatctgaagctttgattctgtttttccttggccttccacgcttcctccttagtctaggtttttgtaacttaaagccaggatccacaaattcccattggtgtttccctattatgggcctaaacactacagagtatgctagctgcaacttctctacagagaagtacttatccacatatgtgtgcattgatgcacctctgattgaagtaatgaaagcaatagcatgtgtacaaggtttgccacacatttgccatactctgcagctacatgtttggctatctaagtctactgcataccttagttccataccttggttatcagggatagtcacttcagctgtagttagtgtgaccctactaactttatgtttctttagccctatgctctgtttattgagatctttagtcacacttggcagtatgactccttccatcttacttgcaatttctgctctatgacagaacttggacactatcttttgcctaatcttatcgatcatgtctacaatctgcacatctttcaagtcctttatccaattattgaaggattctgacaagttattgttgatatagtccaccttggacaattctgagaatttcgctctactccacaacatagggtggttgtcattgaggaattggattgcctgtggtgattgcatcttgatggcatcataatgcttgttgaatccagccattgtataactcttagcagctggctacatgttctccgcatatactgctccatggaacttctttttgaagttcttccaaaggtgcctaaaacactccctatgctcagctatggggtagacacttctcactgcattttccaagcccttgcatgcatctgagctaatgactaaacctgaaggatggccaatgtgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaaaatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattataagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagtgcaccgttcccggatcataatcacccccttataaacaaggtatggactccccagcgacccccgtgggcttatctccgccacttctcagtctggtgctccgcaatgaaccatgctatacaaaaggtaaagccgttgcccacgctggcttatggttggcacggttaatgtttcacaacagtagctcgcgaaccggtccttaattgccatgagcacgaccttcaaaaccatgtgctcacaacccaccattaatcatattttagttggcaagtaattaagtaaccaatcacgattgaccatcgtgaactatcattaagccatcattaaataatagtgagtcataagttatcccaatagtgtgctaatgtttctaagcatggctaagcaattatatctaatatctagttgaaccaatatatataaagctcaactagtccaattataatcacccaaggtatcaaggaataaagtaatcaagaacaaaagggctataacaaacaataggttatttccacccaatgacattcgaaaataaatgcaatagttgaatagaaacaatagctttaaatgggatcaacatgctcaaagggttgtttgggatctgtgtgacttgccttgctggccttggaactcttcaaattcttctcctgcgaaaacggactctccggaaacgtcggaatctaaacagaaaagagcaaaaacaccaaaacagcacataaacaagcatgaacagtacaggtggatatttttaacatgtagatctcaattttagaaaaatttagagacttgaaccaactaaatccgagctaagatgaattagttatgaattttcaaagattaaatcggattaaatcatttatttagattttaattgaattatgatgcaataatgaattatttttgaaaaggaaaagggaattattgcgtcagcggctagggtttgcggtggaccgggtgcacggcggcggttcacgggtttggacggccgagatcgatccatccaaaacggacggccgagattgatcgggtctacggcggctcacgggagacgacgacgatgacgccagcgatgacgtcaccaccggcggcggctcgggcgcgcatgctcgccggcgaacgacggcgcggcggcgcgaacggagagcacctacgggtagcggatggcacggcgaactcaccggtgaccaaagcaacggcggaagatcaacggacggcgacagcgtcgaggaagaaacggcggcgaccttcggcttgacgacgacggcgaggctccggcggtctacagcaacaatgaaggggcggacgaggacggcgacgcgacggcgaccacgacggcggccttcccgagcgacggcgacgactggagcgacggcgacgcacggctggagcggcggcgctaggctacacggagctagggctctaccggcgacgagaggcgaaggcgagggtggcggcgggtagcggcgggcttgggggtccttttataggggctaggaggcggcggcgaaggcccacggcgaccggcgacggcgaaggaaggtctagggttcggggagagagacgaatccgattcgagatcgaatccacggatttccaaacgattttagccgacgattccaaaagagaaagggtagaaggggtcccggggatcaattcccctctattgatttcaccggaaacggaaaggcgcggctgaatttggaaggagacgacgacgacgcggcgctagggttcgggtggcggccggccggaggaagacgaagactgacaggtgggccccacctgtcagcgagcgggagcgcgcgcgcgggcggcggctcggctgcgggccgactttggccagggagagagagagagagcggttttgggccgactttcggcccaaagccaaaagagaacttttaaaaccttttccaatttaaattattcatgaaatgcaattccatttattaaaaatacttccttagctcaaataaatcccagaaaaatctaggaattatagaattaagcaaagtatttaatgaaattttatctggccctattttatattgggatttattatttaaaattagatcttttcaaggcttttaaaatgaattctaataataatttattaaataatttataaatcctaaaacaaaaaaaatcaggatgtgacacaatggctgattgaaggttttgaacaaaccaagtccaactttctatggattctgtctctatgacaccgaaagcaaccgggaacatccaattatttccatcaatggctacagctgcagcaagctgacctttattttttccaactaaatgtgtactgtccatggcaatatagggcctgcagcccagtaggaacccatcaatacaaggtttgagagctataaataaccttttgaagcacatctgaccattatgctcttcgatatcaatctgaactttacttcctggcgctgacttcaatagctcttccttgaaagtaaacagcaaagcatagctatcatcccatttgccaaacaatttctctagtgccttttctttccctttaaaaaccttgtcatatccaactgtaatgtgatatttccgctctagcctttcctgcaactcctttggccccaagcttggtttctctctaagcatgtcgataactctgtcacatacccaactgcttgaagccatgtcttctcctgacctattaacagatgaacatatatgttcaattttgtttctttttatctgcaaatcaaaatggcaagattaaagatgattgaaaggttcagaacatagcaaaattagattacacaaattcaattacctggcaaatcttggtgcctctcttgcatgaagcatgaatcctccacttgcaattctcttcttttgccctcttgcaaacaagaatcaaccttgttttgtccttcttcttagtaaaaaagccataagctttcagaactgcatggtgtgtaaaagcttttttgcattgattgacaatttggaaaaatgtaccctcatcaacacatggtttgtcaatatcatgtgtgtaaactacctcatcatcagtatcagagtcaacatcatcatttacttcagagtcctcagaacaactctctggttcatattcacaatctgagtcagatgaagaagaatcatcggcacttgtgtagctactgttactatccacagctaatgaatcatcgctagaccctaaggattcagcatctaaccctgaatttttagtgcccaagtctacatcaaccaacccatctttgacattagctgcagtctttttcttgcttgcacactttggactctcaagtagtgggcacttatttagtgcacactcattttttgcacactcatttggtgtacactcctgtgttggttgggtctgctcagctagcaaaggaatgcattgaggaggagtacatggtgtccgatcttgtgatttctgattttccaatgtgttttttgaaggtgaaacagcaataggaccctctaaatcatttacttgacaatgcaatcgaagcaaattttgtggtttatgtcgtaccaacaatctccacaaatgcttatctgttcgaacctcaatgtactcctcatcattacaatctggatcaggataccaaaaagaaatcaactgcctagaaccccagtctattgactttgctaagtcagcactcaaatccattaaggaataccgatctggattaatataaattggaatttctctgcgatctatgtatctcttcggcttaccatctggcatgctaaagaaagcgcggacgctaaccaaaattttcattaaattgcccctacatagcatggaagaaaacctaatcaaccaacccactggacggaaagaaagcaaatttacaagattagtacctattcggggctacaacttcactcgtttccattctgctcgatgaattcacagctcgatgtcagccctgttcgctaagctttgccgtagcaacttgctcgtcgagacatcgctgtagccggttgggcccctcgtcctccgtcctccaggacctgccacgcttcgacttcaggacgcaaacgcagccgctccgtccgctaggacctgctcgccgagaccccgccgcagccggacgcccaccgggacgctgccgtagccgctccgcccgccaagacccgccgcgctccgctcagctagctggacccactgcgctccgccctccaggacacagctgcagctccctgctcaccggaacccgccgccgacacccatcgggatgccgccgacgcccatggagggatcgatctagggtttaccgaaatgaggggaaatttaacggtcaatagaagttttatagagcagttaacggtcattgacggaacgaaacgacagtggcatctcaaatgaatttttgttcattctagtggcattggagcaattagctccttttcagtgtcatactgccaaatagggcgcccaggagtggcaaaacagcaattgttcctttatttccggcccaattaatatgggatacaccgaggccgcaattcctttccgggccagcatacatgggccgcactgaggctgcattcccgtccaagcccacgtaaaattgctgcggtttcttcggctcgttttcctttttcgtttttgatagtttcagcaagtattcttgagatcagaagagaggcaacaatgattattatacctttggctaaaaaagtgcccgctagaaaattacacaaacagagtttaaaagctagctaaaaaccacagttcgcttcaaaaatagtttttaaggtaaaaaggtggagagactctaccttataaccattaccatattttttttgtttgacgttggttagctcaaaccaacgtcatacatttgtgtaaggaggtagtatatattaatggtgggacagttttacaaagcttcagacaaacataagaagtacagacttcaaaaacaaagtgcaaagtacagaaaggtcttagactcttagttcagctcgatcatccatcatctgatgtgagcgcggtggctgctgtgtttgatgtttgcttcaaaatagctccagaagatgatcgaaagatgaacccatgcattcttttctttttctagttgatgaaaaagcatgcagtgcacttaacaaataattgtttttttatctgacaatgaattatttagtttgtacacaaaagaatattagcaatgcaagtattcagcacactgaaaatgcagagtatatacacaatacactcggaatgcacttgaggattggtcatcccacataatcatcatgtgacaatctccgaaagaacatcaagtgaataatctatgaatgaactgacaatcaagtgataatttttgtggcgcaagataaacaagaagactaaattgttttaaactttttttatataaagtaaaaattccatggtttaaagagtcaacaagcatgaatcaaatatacaagtatgaagatatatcagatttcaactataaattgctatccacatatataacgatgcggcgatcaaaaatttcaattggcaatgatcaaacttcaataggaaccgcgatgctatgcaatcctatatcaaattgaaaccccaaacacgcagtgcaagtatgcaatctttttcttgattacaccctccggccgttcttaaaaaaaaatcaaattctgaacatgtgcttcatagctaggatttttttttcttggacgaatggagtaactatgtagaatccgaataatggtttaccatctcttaccatcgcacaaaatctaccagaatccccataaactttcacaaattaaattaactgttcttttcctttatcttaacatgaaattaactgcgtgtgaatcaacgaataatcgacataacgatgataaatgaattctttcacctgtataatcaaaaccaaaataacaaaagcacaatggaatggagatcatcggcacggcaaagaagaggacacatcaacgatcgagcaggcatcaatctgactccacaattttgttttttccctatcaatttcttttctttcctcccaatcgacaaaatttttggaaagagagaagaacacagccaattgccaaaaaaaattggtcaattgcggctaaattaatcacaagatcgagttatctgtcttctcttttcccaagaaaagggaggagaaaagccaagaaaccaacaaccgtggtgaaggagaagaagaagagggcggcggcggcggcgccgtcgccggcggcgatcacctcctgtcctctcgttgtgaggggctcctccagaagccgccgccgtagaagctcgcccacacctccttctccatgtcaacgaggtgttcggccttgggcgtggccgggaaatcggcgtccaccttcctggccttggcggccgcggcggccagcgacctcggggaggcgatgtccatggcgcccgtctccttcggcttcgtggagcggacgcggcgtcggcgcccaccgcggacggcgcggcggcagagcgcggcgggagcgcggacggccgcgaggacgacgagctcgacgacggcgaaggggaagcagcagaacaccgcggcgcactccgccgccgtcccgcccgccacctccccgcaccgcggctgctgctcccgcgcccgccgccgctcccgctcccgcctcatctccacggccggcgacctcctcaccctcctcgtcgccgacaacccgttccccgccgccgctaacgccgccggagacgccgccaacgcgcggcggtggtggtggtggtggtggtgcacccgcgcgggcatggcgatcggtgccactgcggccatggcgggcggcgggggctgggttgccgttgccctccctccctccctcctcgagattcgtgcggcggaaaaccgacggccgagataggatgcgagagagagaggtgggaaagcggttgcgcgaccgaaccccatatataccatgacgggttcgcgggcccacccggattcctcggcgaggaacacgttaaaccgctcgaccgtttaccggtttgtggggcccacgtgccagtcgcaattacccgggaagcggagggggagactgtaaattcgttaaattatttttctttttcgttttttttttttgtttttgatcggatcgccactagtgcgccacatttttgcatggggcgtttgctattttagtgcgaagaacacggcggcgacgtgcgcgagacgaagccccccgcgggtttgatttgatttgattttgattttgatttgcttcttcttgggcgtctcggaggcgtcgcatcgcgatcgatcatggaggtaaggtgacgagatgggtgttgggtgtttgcgatcgcggggttggtggtggatgcagatgaggtgttcgatgtaacgccgggtggttttgtttggtgcagcagaaggacagcggcggcggcggcggtgggttggcgcggcggttgatgctggatgcgagcgggagggagatggactcgccgcggttcagggcgatcctgcgggcgacgagcgggcggcggaagcgggcgcccgacgtgaagagcttctcgcacgagctcaacattcgcgggccgctcctccacccgctgcagcagcggaagccgcgcgggtgcgtgaacagcccggaggagttcatcggcgccatcaggacaaagttcatcaggctcaaggaggaggtcgacgccgagctcggggtgttcgccggggacctcgtcggcgcgctcgacaaggccgacggggacgaggagcgcgtcgcgctcgaggacctgctcgtcgtcgcgcagcggtgcgccgagatgagccccgaggagctctgggtcaagtgcgagtgcatcgtccagggcctcgacgaccgccgccaggagctcaccgccggcgtcctcaagcaggcgcacacccgcgtcctcttcatcctcacgcgctgcacccgcctcctccagttccgcaaggaaggcggcggatacgtcgccgccgacgacaagcagcacgtcctcagcctgcaccagctcagcgacctcggcctctaccccttcaaggtcgccggcggctccagcgagctcggccgcaagagcacctccagcttgaccgagctcaaggagaggctcatcaggcggaggatgctggagcacaagcaactcaccctcgacttctcggcgggccgtgtcatttcgtcagacaccggcggcgattccccgggcagcggcggcaagatctcatcctggaagaagcttccatcccctgccgagaagaccctgcacaaggttacggaaccgacaacggaggagaagaccacccctacaaagaagaaggccattacgaggaacaaggtcgccgtggatgagatcgtcgagaggattgacgcggctagcattcaccccgacggattgtcatatcttggggactctgctgtgaagctcgaggttccatctgggttcccagaggctcagcagatcatcgtcgacgggaagccgaggatgatatgcaggatctgtgactttgagatccccatggtatgcgcagaagggcacttcatagtgtgcacattagctgatcggtgtgattccaagggcctgaatacggaccagcggctgcagagggttgccgaggtgctcgggagggttttgggttgctttgaatcgaagagcccgcaaactgcagaatgtaatcataatgagactgcaagaggtagcacgtcgagtttaacggaatccgatggatccatggatcatgatattctgtctcatctgttgacagtgccatcgacagagttgttttcagaggtagttgcctcttcttcctcaaacaatagtatccttcgaagaaacaattataactgctctgttttgatcatatggattgtggacattttgctggtgaaattggcagggagcactcacaccagcgtcaggcagcatgccacagtcaccattgctgacaccaagaactagccacgcagagtcacagctgactaaacacaaggcattcgtggaactagagaactttcagcaggtttgtgcatatcaacttaatactgatccttgtttcattaaattctgttcttgtcagaatgttagttggaacattattcttttgaggttatgttaaattttgcttcttcagtgatctagactggtagtttaccatactggcaggttgaaagcttaatgactattgctagaggcatcgagagaataaaaaactctgagtacaactcgcttgaggacttgagctcttatctagaagatctaaatgctgtcattgacacaagaaaagtggatgcccttgttgtggagacatttggaagaaggatagctaaattactacagtaagtgcaatgccagtttaattgttttacatgtgtttgtgccccttagcatcttcagatttatttgtccttagcagcgatatacgcattgctgtttcattactcaaattacactacctgaaaatatagccctgagtgtctcgttaacattatggcttctcagggagaaatttattcaactatgcggacaaatagaggactcaaacactgattcattaggttcaatagacgaagatggtcctatggagagtagtgtaagctcgagaacaagccagatgaatggtaaattcaaagatcgtacctcaattgaggactttgaaattataaagccaatcagccgtggtgcatttgggcgtgtgtttcttgcaaagaaaagggtaacaggagacctttttgccatcaaggtaatggtcattacactgggccttcagattcttatttgtgccaatgtagtagtgtccttctggatcaagtgcaataagagtataaacttaaaaataatcaattttggctttttaattctccttctgttgagaaaaggaaagtgtttgagatccttttagtgtgaattttgaattttgatgaaactaaatggatgctttgcttcaagattattagagaactcttcaaatgaatagactaggataattcgccggcccggcgaaaaagaatagactaggataaaaaaaatatagcacttacataattgaattgctagcttcagtggtggcttttatcctgatggtttcatcttgaatccaggtgctcaaaaaggctgatatgatccgcaagaatgcagtggaaagcatcttggcagaacgtgatatcttaatatcagctcgcaacccatttgtggtaagtacttcgaatgttaagtaaaatgaaatattggatttcatttaacttcaatctgtaatggacaggttcgatttttctactccttcacatgtagggaaaacctttatcttgttatggagtacttgaatggaggagatctgtattccctcttgagaaacctaggttgtttagatgaagatatggcaaggacgtatatggctgaacttgtaagttatgagtgtcttttatttcctgaaagtattttacaaacaactaaatcagaaaggtccatccttagccattcctttattttaaaagttttaatcgtaggcatttttatttctatctgtaggttcttgctttggagtatctgcattctatgaatgtgattcatcgtgatttgaagcccgataaccttttgatctcccgtgatggccatataaaggtaatactaccttcttatttcttttctttcaatacctattacctattaggttcttatgtgtttagtgttgttatcggtgactgatgattagattgtctgaggaaaattgttgctgtactttcaagtcttataagtatttttttcatgcaatagaatgaaggcggttgtctatttccgtgcagttgactgattttgggctatcaaaagttggtcttatcaatagcaccgatgatttgtctggtccagatgtcagcaatgttcttgttggtgatcatcaacctgcagatgcagaacaacgtgcacaaaagcgagagcaaaggcaaaaacaggcagctgtgggtactccagactatttggcccctgagatactgctagggatgacccatggtctgtttgcatctttttcgtagaacttacatttactttaaaatgtttaagtcagtactttagggtgttgaatttattacatataacttatgtttaccttcatcgaaaagtgaaaatgcatcttctattaaaatatatggcactcttacatgcaggtccaactgcagattggtggtcagttggcgtcattctctttgagcttcttgtgggaattcctccattcaacgctgagcatccgcaggtagtcttctatcctctctaaggctctgttctatttcttcaattccaacttcaacttcctcgttaaatgatgtatttttgacaaaaagtttctatatagaagttgttttaaaaagcaaataaatccattttttaattttttacaataattaatacttaattaattaggtgctaatgagctttcttgttttgagtgcgccaaaaatatctctcccaagtcagggaacgaacggggcatgtttgataatatagtgacaagctggctctaactaatttgttggtactactaacatgttggttgtctgttggaaccattctaagagagagaatttatttactgaagaagacgaatattagttagagccagtttgtcatttaattactccaatgtctcgatgcttatggtctatcaaaggtcttccagcagtaacataacaatgttgtttatttacagataatatttgataatataatgaatcgggaaataccttggccacaagtaccagaggaactgagtttcgaagcatatgacttgattgacaagtaagtcagaaaattattattttggaaataattgctatcaaccgtttatttctgttcatcggtatttcttggtgaatctgtagtgttaaatgtccaacaaatctgcattctacagatgctattttaactcagttaactttcatgtcaggttgctaattgaaaaccctgtacaaagattaggagcaactggtgctggagaggtactcgttttcctttttcgtattccagttatacctcttatgtacacaccactaactgacatatgctattagagcaggtaaaggctcatcctttcttcaaagatataaattgggatatgattgccagacaacaggttagaagctaaactaatgggcagtctgaaaaacaggaacctcaaaaaactgcctccaaagaagtttctgaactggattcaatttttgtaggctgcatttattccttctacagatgatgaatatgatacaagttattttgcctgtcgtcacacatgggacgaccaagtgaatgtagcctctaacgactacgacgatagaagtgaaactagtagcatgagttgtggcagtagtccacacagttgtgattatgaggaagatgtatgctagatcaatccctctaaaatcccccttctgatttagacatccaaatcattatgtagcccacacctcatacctctaaccttttctaaaaaacattaacaggcggatgaatttggtagcatggaagaattcggagctccatcactgtcagtgaaatattctttcagcaatttctcattcaaggtaaccctcacctgaagttcccacgatatttgaatctttttctcggttagtaagttttttttttcttttcctttgtaaacagaacatttctcagttagcatccatgaactatgatctgatcacaaagcataacgaggatcccctacagtcttcaaaatcttgagagtatgcactccctcgacatggtaatgtctcattgttgaactggtgtatcgtccttgataccttgatcctgtgtacagggcctgcaaatcaagctactaaacttaccatcttgggtcttgtcaggcaggctgcaggaaggagcttcctcaacagtgaactcccacagttttgctacaatggtttggtcgatgacaaattgataataggaatttcctcggcaagactggttcaagtaattttttttctcttcagtttctctccagtgagcaaagaggtgcatttcttcatggcaaatgcaatctgtaatcattgaagaagaatggataggtagcacaggaatcataggaaagaatggcacccactgttttggcaaaataggtatacctttctcaaaacttgtgagtggtgcaagattaagttgtttggtactttggtgcagtgtttttttgcatcaatagtagaaaaaaaagtttatagcatattttaccctattgtatttattctcatatttattttattgctgttgagacccattactagctgaatgatcaatgccctggtttagtccaatatatatgccaaaaatgcttgctgtgattggcaaatggaagttgcagatcttactctcaaggatgaattcagaataggaaaatactttacagctaattaccagtctttcacctacaccatccatgatcaaccacaaaagaagagaatccaaacgagccaggaaatcaccacacaccacaagaattaatctctatacgcacatgtcgcaaataccacaagctcagacacacagagagtccccaagaatccaacctctccaggatcagagacatcgcagatcaatcgaagtaattaattaactaatgtaaactgaatcgaaacataatccttacaggtaataataaattaactaaaaccaaaaccgatcaaattcgaagctgggagttgcttattggtttattgattattatcgcagtattctaaactcttactgctagctagaacgaaagctaagatacaaacagctagtagtagtgatcacatctagctgccactgccactgcaaactctgcaagcttcgtcttcttcctgcaaatccgaggctagctagctagctgggtgtgattgcatgacgcgtcgaggcctagcgaaaggcctagccggtggtgaggaggaggaggagttgcccatcgccggtgaggggcggccggcgacgtaccggcggcggtactcgtcgccgtcagacgacggctccaccacgtcggcggcgaaccgcaccctcctcgtcctctcccgcggccgctgcggcttctcctgctcctgctgctcctgctgctgctgcgctcgcgctaagaatgaaaaagaagttgaatgctagtatcgatttcgattggtctatggtgattttggttgtagttcgatcgatcgatctcaccgatggagagcttgaggtcggcgaggaagcggcggtggagggagtaggagatgatgatgatgccggtggacgcgagagccaaggcgatgagccccatcgagccgccactgccgccgccgcggtccatgcaacgccgccctccgacgagtgtgggcgatggctgctgctgctgctgcttgagcatggccgatgggggaggaatggagatgggtataagaggaggaggcgaagaggaagaagacgaggagggaaaagccgtttttagaaggaaacacacatggggaatgcagcataaaaacattctcttttagaaaaaaagagataaaaggcatgctggcatggaacaacaatgtatcagtgggcttgattggcacaaccccagctccagctccacctggagctcaaccaaacagtttcagttctatctaaaatgggagtggacctctctcataaaatgaactatagaggtggagctggatttaggcagctccacaactccactctagatccaactcctgaagctaaatttaggagttggagctctaccaaacaagcccatcgtggccgcttagctatgccttctatggtgtcgtccaagtttttaccaatatacacacgacgagcccgggatcggacgaagcgtacgtgatggtttttcggtgtatcgcaccggctggacgacgtgtaaggagatatggtggacatggtgtgcattttgtgtcatcttggtgttattgatgccgacacgaggcagttttggtgaagcgtgaggcttactggtggtgtgtcgacgagcgcgcagaacactgggtgatgatgtgtaagggatacatatgccagctctaacttgtgccggtatctttgttttatcgatgtggatttgagacctcgtgatcttttacaacaacccttttaaagttttcttgagttaatttgcttacgaaatgtgataaccaatgggtatgtagtcatcagataagatagagatgcataattacgtaacaggcaatagtagtattgtagcaagggagaaaacttaccggttgtggtgacatactgaacccatatgctttatatgcttatccagttgtttacttgtttacccagtggaggatggcgtttatttgataggttatcttttttcttgaggcacaaattacatagtttagttcccaaatcagctcagaaaaaaaatgcacgcattaaatcaacaaaaacaaccttctcagaacaaaaatataacagatatacaggggtaacactaacggtataatacatttggaaaaatatgaacttacaagtttttttcctcgataataaacttaagctatgcatatggaatttgtcatggggaatttttaggataaattgttccagatcctctccaggaccaacaccattatcctaggcaatagattcgttaccaatcttaataaaattgagggtacgaacaaaataataaaacaataaatagtaaaggtcacctgaaaactcgataaactatgtaaaaattaagagactaagaacataaacagacaaattagcattgaaattacattaaagggctataattaatatacattgcgtgcatcacacatatgggtaaaccatgcccataggtcttgcaaaaaaggaaaggaaaatcatgtgtgagggataaggtgtaagacccaaatcgtaacttaagtaaaatggattatgcatcaaactgtggtggatgactagtttgatacctcaggatatgtaaacaaatgctttgaacacatagaatttagcaaaacttgaaggagtttgaagcaacatcgtctagaatatatcttttctgcaagaataggtaagaccaaactaaaaagtatcggagtagttttgcaaagttatttttccactgccctctcctaataatcctaacactagcaatagcaatattagatgtgtttactctatttcaatgttttatttgtgattttgtatattacacatatacttgaatagtgattcaagctatatctgagaggaaggaaagataagtatgtaatcataagggttattcgaaagagctagctactgttgtcggtgacatggaaccggggtatcatgactagcggattgggcagccgcggtcacccacgtggcccgaacccctcgggggggtcgggcccgagggtgacgtggccacccctccctctgtctccccgaggggtcgggccgctcccgtttcggccccgagggctggggcgccccgaccccctgtgggattggcaccacgtgtgtgggttaggtgagcacagcggcgctcacctaaccgcatttactgcgggttggacgagcgcgccacgccgcatttaatgcggcgcagcgcacgcttatccggtccgtgaccggtcgcagtgtgtgaccggtcacagaccggtcagatcgcgggttaggtggcaacaggcggcctgtcacacgcctcgccccgtcccgtcggaatgatgagagcctccaggcgctcgtccctagccggagccggcgtgctaacccctggagttggtatgtcagtcccggccagatacattccaggcttcatcgcaaccattgcaaggaagtcattgtatgaagaagggcagacgtgcagcatgctaaactga

SEQ ID NO: 77917 - DNA, 11000 bp, Oryza sativa
actactccgggcttaccaaatttcactgctaacagccgtgaacaaccggaatccacgatccacacgttatccttccttgccaccaaagcctacacacaagcagaagtcgaagcctcaatactggggttagatgataacaaaaatttaggaatccaatactgagatacacgaccagaagatctaataggcatatatccacgtgcaaaaacagtttgagaattttcagaaacattcctccgaggccggtctgaccgaggtacagtggccggtctgaccgggggccggtctgaccgctgctgcaccgccggtctgaccgaggcacagtagccggtctgatcggtcgccggtccgaccgcgggacccaccgtggtctgaccggtttccccgagggaaaacccgatttttgcaactttgattttgcaaaagcaatctctctcacctttttctgtttatgagctaatctgaaacaaaaaccaacaatatgtccatctttgccacaaaaagaacaagtatatttttcacgatgattagacacattggtagaattgaaagacttagcaacacaagcaacaataggaggttttgcatgcacaacattggattttgaagcagatgcattctaggtagacatgataccagcagatttaaacacagttttgttagtatcaggtttaaccaaaatctcaccacttctagcaccaacacctaacacaccaggaggatgtctagattatgagcataaggattaaaacctaaaccacgattatttgtgctaaccttagattgatctaaaatcatgttgaggttctttttaccatcagaacatcttagcaatgaatttttcaaataagaaacctctttttctaaattagcacaattttcacaatctactatgacacctttgcttttacgacatttggggcaagaaaacacttcattgtttttcacaacatcttccatgtactcaacacgacctaaagcatctttcaatttcatcttattcaaattacatgttgagcaatccaaaacatcacgaggttgttttaactttttagcagaaatcatgttaaacataaactagcatgaaaagcaatttgatatttttgcaacaactttttagttaaaaacaactcatccaaagtgcgtgtgtgcaaagcaaaagtaagagcaagagaagatttatttttcaaatcatgtgcaacattaacctctctaatttttgaaatctcattcattaaaacctcacaacttttgcaatcatcatcattaggaataagagattttaatctagcaatttcagaattaagagattcaatgataaattcctgttttctatacatcttctcacacttcttattttttgcactcaaaatattaatagcttcctcaaaagcacttacctcattgttttcacactctgaatctgattcaccacgtgccatgaagcaaacaccggagatgttctttcccttagcttcatctccactatcaccatctacgtcgcttagtggctcaaacgcgacgtagacttgatcaaaagccttcttgagattctccttgatcttccttcctttgaatgtaccctttggcttattgtcgttggtcttctcaccatctttgtcttctcttttgcctctcccaagcttaggacaatgcaaacgaagatgatcaattgaaccacattcaaagcaacggtttggaccacatcttttcctgttcctagcattattcatagctcgagcaattctgttagcaaccaaagccaaatcctcctcctcgatctgttcgagttgatcatcggatgtggcattaaaaatagctagaaaagaagactttgatgaagaagcatcaacatccaaagaagatgaagaagaaaccaaagcacttgacttagaatcaactttacgagaaagaacgttcatctcatgtgttttcaattttgtgtaaagtgaatctaaagtcaaagtagacatgttaacagactcctgaatagatgtaacttttatctcccaaatagacatgtcaagaccattcaaaaagtgatgagaaatctcagattgtggataattagcataataagaaaaatcaacagatctaagatcactcaaaattttattaaacctagaaagatagtcatccaaagcttctccaggttttatctcaaatttaatgtactcctttttgaaaatagcacgacgaagttctttaatgttatttgttccttgatgaaagttactcaaagcattccaaatctcatgagcagtttgaaaatgcgcaacacgatcataatccgaacgagaaatcccactcaaaagaatattgcgagctttgcaaatttgtcaaacttagtttttgcagcagcagtattaataacttcaggaatcacataaggatgagaaacttttctccaaatatcataatcttcagccataatataagattgcatcctactacaccaatgagaaaaatccgttccatcgaaaacatgaggcttagttgaaaacctaacaggagcagccatggcaaaaattctagatcgataaaaatccaaagaagaaaccaaggctctgataccacttgtaggatcgaatcacaataactaagccacccagagggggggggggtgaatggttggtatacccaaaaagggaaaacttttagcggaaataaaagttaccctcgaaatcgacggagttcggtctgaccgagattgatctgccggtctgaccgctcgcatgccgccggtctgaccgtcggtgagtcgtcggttagaccgccgaaacccggtgaaacacaaatcgaagaactcttaaagtggatgacgactttattgattctctctgtgtttacaaagtgcaccaacagcactccttacaaaaatttcgactaaacttgaaaccctaactcaaaactaaactcaattgctctcaaaagcgataccgggaagactcacgctctctctctatttatacccgaggtagacagcctaaagccatgaaccaaactcatactagaagtcctaaacaccttagaaaaccctctagtacaagaaacaaactttacataaccaatcataccaaatttggactccttccaaattcgattccgcatcccatacacacacaatacctccatcgtatgccgtatggaatatccatcaaccacgtacatcaactctagcctaagtatcccgcatgatctctgaccaccacggacgtcggcttatccccaagcctactcccggtccatcaccgcaaatactctcccgaggcatctagtcacctacacatgaaataaacaaagaaaccatattccgagaccaagctaactccaacttggctcattgttagtaaacaacagtattacatacgtatagtatccatctagaagccataatcatgaaataatcacggatatccaaacaaacaacccgaaaccgaaaccgacacagagtcggccggtcagaccgcgggctgcgccggtctgaccgcgcgatacacgccggtctgaccggcacacactgcccggtctgaccggtcacatgaaattaatagaacctgcgattcacctgtaaatccaatcatctcaaaaccacttcgtgaataaattccaaataacaaaaccaataaacttcgatgccaattgttcatcacagaataataatcaaaaacacctttgattttacaatctcccccttgatgaacacattggcaaatccatcaaaaatgttttggtgtttggaaaaataaaaacaaaagcggtaaaagcacacttcgtacaaacgtacacatcgtgctcgaaaattcaaaaatccaaaagaaaacttcttcccctttgtaaaagaaagaaattcccaattgaacaaaaaacatgctcttctcaaaaactcttctcttctccaaacattcaccttgcttctcccaaaaagtcaaaaagttacctttgcttctcccccttttgacaatgatttcatcaagcataggaattatgttcattaatgttcaagagcttagcatacatatagcatatcatgtcatgtgttgcaataaaaagaagataaactcatctataatataacaagcatgcattaaagtataaccatgaaccaaagactttacaattaagcttgaatcaacaatcaaaattcatgatttcatacgatttataatgcaacatcttaacaagcagataggttgaagaataaacactaaacacatatacctattgcatttatcactctttctcaaataacctttagcacaaaataaccaagagaatttttaacttttttattttcttgagcctttttgctcatatttttctcttttattctgggtacgtccctgtcgtcaagactgtttccaaagattcggcacccattattttgctcacatcgaatacgtccttgtcgtcaagactgtttccaaggattcggtattcatttttttcatatttttattctatttttcacaatgagcaattaaagctatttgaggaataacaattcaataaagcatagacataaagcatttagaaatcaaaccatatgctagcatcaacattgcatatttgcttaattcaagtagaatttaagtgtcatgcatcatctccttaaaagcaaaatctaaatcttatgaaaaagactagaatacatacaagctatgctagagacaaataaaccttcaaagtattgctagcatgcacaagaaaatactatatgtataaacaaagctctctttttctcaattttcctcattgttatattattgcttgataaaaccatgaggtacaaactccccctcaaaacatgccaaaaggatgaattatgcccaattcaccacgaagaaaagcaaagcgattagaatccaaaggtttagtgaaaatatcagcaagttgcaactttgtgtccaaaaactgcaattcaacatctcccttctcaacatgatccctcaaaaagtgaaagcgaatatcaatgtgctttgtgtgtgagtgttgaacaggattcttagcaatgttaatagcactagtattatcacaaaagagaggtactttctcaaaagtaagaccataatctttcaaagtagataaaagccaaagaatctgtgaacaacaactagcagcagcaacatattcagattcagcagttgattgagcaacactagattgtttcctagaagaccatgcaatcaatgatgtaccaagaaaatgacatgttccactagtacttttcctatcaattctacaaccaccaaaatcagcatcggaatatccacttaagcatatagaagatgaagtagaataccaaattccaaactcaagtgtatgattcaaatacctcattattcgcttgaccgcttgacgatgtgaagcacgaggagaagcttgaaagcgtgcacacaaacacacaacaaattgtatgtctggcctataagcagttagatacaacaaagatccaatcatacttctatactccttttgattaacagcttcaccatcttcatcaggatccaatacggctatagaaccaattggtgttgaaattggcttgcaattctccatcttgaaccatctcaaaagatcctttgtatacttcgtttgatgcacaaaagtaccttgaggtgtttgcttaatttgcaatcccaaaaagtacgataactcacccatcatgctcatctcaaattccctacgcatagtctcagcaaactccacaaccaaagcgtgagatgaacaatcaaagatgatatcatccacataaatttgaacaaaaagttgattatcaccatgcttaagaacaaaaagcattttgtcaacctttcccattgtaaaacctttcgcaagcaaaaagttcttaaatctatcgtaccatgctctaggtgcttgtttcaagccatacaaagctttagacaattcaaaaacatggttgggaaaatcaggattttcaaaacctggtggttgtttgacataaacttcctcctgtataaaaccatttagaaaagcacttttcacatccatttgaaacaatttaaaaccttttgaagcagcaaaagccaacaaaagtctaattgcctcaattctagcaacaggagcaaaagtttcattaaaatccaaaccctccacctgggtaaaaccttgagcaacaagtctagctttatttctcacaatcaaaccatcctcattttgtttatttttgaaaacccacttggttccaataatattatgtccagaaggtggttcaactaaagtccaaactttgtttctctcaaaattttcaagttcttcatgcatggcgttaatccacgattcatcagttaatacatgtgacacatctttaggttcaaaagaagcaacaaatgcagaatttgcacaaacatcatgagtcgttaccttagaccttgtagtccgctcacctatattaccaatgatttgttccggcggatgtcgtcgttgaatgtgtaaaggagcagcgacttctaaagttgatccacattctgtatctgtcacatcctgattttcgtttcaggatttataaattatttaataaattaataatagaatttatattaaatgttttttaatttacaagtgaagttaaatgtgggaaataaaatttcttaaatctaaagcatggatggatttaatttttattaaattttccatgattaagtcaactctctgaaattttctcggatttttcagagctcaattcttaaataatacaaagaacagttcagtaattatttgatcattaatgatctaattataattgttaagagcttttcttgtttaaaaatccttaaattataaattgttgtttaaaaggaattattagaaatgattttaaaagcctagaagagaagatctaattttaatttgttaaatctcaatataaaattgggccagataaaatttcattaaatactttgcttaattctataattcctagatttttctgggatttatttgagctaaggaagtatttttaataaatggaattgcatttaaggaataatttaaattgaaaaaggttttaaaagtcttcttttggctttgggccgaaagccggcccaaaacccttctctttctctttccctcagcccagtccggcccagtccgccgagccgccgctctcctctctctctcagccgctgacaggtgggccccgtctgtcggagtcgtcttcctcgcgccgccgccgccgcccgaaaccctagccgagccgcgccgccgccgctttccaattccgtcgctcttttccatctccggccgaattgtttgagggcaaatgatccttgagatctcctcttccttttctcttttggaaacatcggctaattttctttggaaaccggtggattcgagtttgaatcggattcctctttctctctcccgaacccgatctttccttctcggcgccggtcgccgtgggcctccgtcgccgctcgctagcccctttataaggacccccgagctctcctctacccgtcgccaccctcgccttcgtctctcgtcgcccgtagcgctctagcgccgtgtgccctagcgccgccgtcgccgccgtcgctccagccgtgcgccgctgccgtttcagctgtcgccgtcgctcgggaaggtcgccatcgtggtcgccaagtcgccgctgtcctcgtccgccccttcgccaccgccgaagaccgccggagcaccaccgtcaccgtcgacccgaagaccgccgccgcttttcctcgtcgccggcgctgtccgttgttccttcgccgcttctttggtcaccggtgagttcgtcgcgtcgccctctacccgttggtgccctccgttcgtgccgaagcgccgccgttcgccggcgagcgtgcgcgtccgagccgccgagccgccgccgccggtggtgacgtcatcgctgacgtcatcgtccccgtctcccgtgagccggtcgtggaccgttcgatctcggccgtccgttttggatggatcgatctcggccgtccgttcccgtgaaccgccgccgtgcgcccggtccaccgaaaccctagcccgctgacgcaataatccttcttttccttttcaaaaataattcattattgcgtcataattcaattaaaatcaatttaaaggttttaatccgatttaatccttaaaaattcataactaattcatttgaactcagtttaatgtggttcaagttgcaaaagttgtgtaaaataaagatctacatattaaaattgtccataaattgaattaaatttatttaattctttttaaatgggctttaaatagatttaatcttgtaaaattcataataaattcatttgaagtcagaatgaggccgttcaagtctcataattcatccaaaaatatgatctacatgtttgtttactttttatgtattgtttatttggtttttattagtcttttccttgttttgcgtgttagcttgtcgtttccgtcgttgcgaaggttcgcgagtgcgtcggaagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcttttgttatggcctgtttgcattgattactttaatccttgataccttgggttattataatttgactagttgagctttatatattggttcagctagatattagatgtgattgcttagccatgcttagaaacattagcacactattgggataacttatgattcattattatttaatgatggtttaatggtagctcacgatggtcaatcgtgattggttaataaattacttgccaactaaaacttgataatggtgggttgtgagcacatggttttgagagtcgtgctcatgacaattaaggaccggttcgcgagctactgttgtgaaacattaaccgtgacaaccacaagccagcgtgggcaacggctttacctttttgtatagcatgattcattgcggagcaccagactgagaagtggcggagataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcatgattagtcccacacctcccacaataattatggatgttatacctggtaataatttgcttagctcctggtttggagattagttctgtacagccgggtatggttgttcaggatggttgggcctgtgcagcatgggtgtgctgttcagtgttgattaaaatttctgattaattactccactgttttacttctcttaaatgttttgctaaatgctgcttttgcaagtgagcctatattatgccatcctttggtatccttgtgcacttgcatatttgctgtgtggcttgctgagtatgtcatatgctcaccttgcaataatcaatcaacctcagttgaagacaagttgcgaaggagaagacgtttggcttataccccagttgagctgcctgtgggagtggagccggagcttcgctagattttattttccgctgcagttttcttcatgttgaggactaagtgcctcttaagtaagtatttattcgctttagttattgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaattttcctttcttccttctctagaattctctataaatcattttatcatcctcttccctcctgctttcaacttgagtagttctgaaactagttgttgaaactagaagatgttgatgtggtcaacttatggaggccagtcaagtggatcgaggaaggaccgaagtgccaagtgtcaagaaggaatgaagtttgcatcctaccttagaaccctatgccgccaaagtgtctttgaagaatagttagtaggatagaacgtttgttgcttgcttgtgtgtaggtatggttgcattcccatcattggagtagttcagtgatgagcatgtaattatactaggttgcttgcttaatcaacttgaacaatataatggtctacacacaccagatcagtgataacctagttaaggtcttgtctttagtgtaacccctctccttctatcttctctaatttgcaatagatggtgaacactcgcgccagtggaagtggaaacaataacaatgaagggaacccaactcttgctcaagttctggctcaacagactcagttaatgaacatgatgatacagcagatgcagaatcagctcaaccaagggaacaacaatgctccaccgccgcagaacaagttagctgattttcttcgtgtgaggccacctaccttttctagcactaccaacccagtggaagcaggtgattggctacacgctgttgagaagaagttggaactgctccagtgtacggatcaggagaaagttgttttcgcttcacatcagttgcaaggacctgcatcagaatggtgggatcatttccggatgaacagagcagaaggacaaccaatcacttgggcggacttcacggaagcattcgagaagacacacatacctacaggagttgtttctttgaagaagcgtgagttcagggcattgaagcaaagggatcataccgtggcagagtatcttcatgagttcaatcgtctggcacgttatgctccagaagatgtgcgtactgacgaggaa

SEQ ID NO: 77918 - DNA, 1573 bp, Oryza sativa
acaagaattaggatggactatatataaatagttcttttgaaattatgaataaacatattttatccacataactaaacaaaagaaatatttaacatgtagtagatgctatcaatattaatatcccgtgcagcgcacgggtcgacggctagtatataagaatcagtcatacatcaatccatctttatcactgtcgtttttttccagaacgtaaagacgatgaaaagtggcactggggcagtgatcaatagttacaccggataagtatcacgctgtccaaaatgacattgtgttcttactatgaatattcatattctctatgtgtttaaattcatgacactgttaactttattaattaagtgaaacttcaaaacttttaccatcaataactcttaaaataactttattccttccaatcccataggatacaatgaactaattactatacttgagatatacctattttttatataatttagtaacatttcctaataccacatatactaaagacatcaaattttataatagaaattttctatgcacccaggtacctctcaaagacagcaagatcatcctgactaaaaacagtagaaaagtatacatgaatcaatctgtatcactgtcaacttttctataacctaaagaaaaggaaaagtgacaatgatcaatggttacaccggataagaccaagttgcatgcgaatttttatcattattaattaatcacatattcacccatggaaacatttaagtcgaaactatatgacactattatgtattatcctactaatcatacgttgagagtatttttcatatttataaaaatgaaaaatatatatttcaaaataattatttgtaatattttttctactgtccaaatgcgtgagaaatcacatttgggaacataaccttttatatgaaaatattgggaactacactagacctcctttttaaaaaagcagccttttatgtaaacttattgtttgaacatctacttcccatgaaagaatttatgtgtttttttatactttttctttagttggattggcagcccaaccgtcgggttaagtggaccacagggggataatcgattatccgtaagatcaaataataccaatcacacggaaacaaaaaaaaagaacaaaaaaatcgaaaaaataaaaaaaaccacgccggcgtcgctcgtcgtcgcggccgccgtcgccttcccaggctcaccgctcctggatccggggcggcaccgcctcgtcgtcgtcgtcgttgtgccccccgccgcgagaaccacgctgccaccgcccgagctcgccgctccagcaggatccgcgcctgcaccgcccggtcgtcgtcgcgcccgccgcggccccgccgagctcaccgctcctggatccagggcgacgccgcctcgtcgtcgtcgtcgtcgcgccccgcacagcgtctactagtcggcgtcgggcctcgtcgtcctcgttcgctcgcggagccgccgccgtgcctccgccaacagccgtcgcgccgcctcccgcgccgtcggcggcgggggcagcggcgctcaatcggtggggaggggaggagaggaa

SEQ ID NO: 77919 - DNA, 2093 bp, Oryza sativa
acactctgcacaagtaatcacaaaccgagaaccgagcgttgctcggttgggtagcttcgctggtgagcgagcagcccgcgcggcttcgatccctgggatcgtcacaaaagtagagtgacgtcctcgtcacgcacaaggtccttaagtggctttgtgtatctcattagcacgtgtgtgtagttgatatcgtcacgcacaaggtccttaggtggctttgtgtatctcattagcacgtgtgtgtatagttgataggtctagcatgcgtgtaggggtgtgtgtgtgcgtggtggaatgcgtttgcacgtatgttcagatactatagcttgtactcaaagtggagagctctcaaaaaaaaaagtgacgtcctcgtcacgcacaaggtccttaggtggctttgtgtatctcattagcacgtgtgtgtatagttgataggtctagcatgcgtgtaggggtgtgtgtgcgtggtaaagtgcgtttgcacgtatgttcagatactacagcttgtactcaaagtggagagctctcaaaaaaaaaaaagtaatcacaaaccaatagcttcagtcatcttctttgaatccaaatgccaacactcctactgcgcttgctcgtgtcatgccttctttgcctgcaaacatatgtaggtgcaaaacggcatgaaagcatgatctcactcaattcacaataaatggcacttcttcgctggaagtccactctcaggatctcatcagtgcatatgagctcctggaagaacaccacaagcctctgcaactggacagggatcatgtgtagtcgtagtgtcatccgccatggacgacgacaccgtctgccatggccagtggtgaccaacatctcccttccagcttctggcatccatggccagcttcgtgagcttgacttctcatctctaccatatctcacatatattgatctcagcaaaaacagtctctctggtccaataccctcaaatatcaactctctgtcagctcttgtgcaccttgaacttcaattgaacctgctcacaggaagaataccagatgagattggtgaactacgaagtctcaccacactatccctttcctttaacaacctcaccggacacatccctgcttccttggggaatctaacgatggtaaccacatttttcgtacaccaaaatatgatctccagtttcatcccaaaggaaataggactgctagctaacctgcagagtttaagtctaagcaacaacacattgaccggagagatacccagaactctagcaaatctaaccaacctagctactttgcaactatatggtaatgaactgtcagggcctataccccaaaaactttgcatgctcacgaagatccaatatcttgaacttagcggtaataaacttactggtgaacttccttcatgtttatccaatctaacaaagatgaaagaactttacctacaccaaaaccaaatcacgggttccatcccaaaagagataggaatgcttgctaacctgcaacttttaagtttaggcaataatacctttagcggcgagatacccacaactctagcaaatctgaccaacctagctactttgtacctatggggtaatgaactttcggggcctataccccaaaaactctgcatgctcaccaagatgcaataccttggtcttaacagtaacaaacttactagcgaaatccctgcatgtttatccgatctaacgaaaatggaaaaactttacctataccaaaaccaaatcacaggttccatcccaaaagagataggaatgcttgctaacctgcatcttttaaatgtaggcaacaatgcctttagcggcgagatacccataactctatcaaatctgaccaacctagctactttgtacctatgaggtaatgaaatttcggggcctataccccaaaaactctgtatgctcaccaagatgcaataccttggtcttaacattaacaaacttactggcgaaatccctgcatgtttatccaatctaacgaaaatggaagaactttacctataccaaaaccaaatcacaggttccatcccaaaagagataggaatgcttgccaacctgcagcttttaagtttaggcaacaata

SEQ ID NO: 77920 - DNA, 659 bp, Oryza sativa
ttggttaccatgtctccggtgatatccttcggtgtgagctcttgtgtcactatggcactctgcacaaggaatttgtccttgcattgcatgtccggtggcgcctcccgctgagcttgcattgttactagatttgataatcaattgataactaaattcttagcataaaaggcagtcattcagaataagataatactgacgcaattcatcaaattaccaagaacattggatgtggactggggagccacaatgccgttatttggacggacgcagtacttctttggactagttgtcttaacctggagaaacgatgttgaattaatttagttacttattactgcaatgcatatttcctcggaattagaggccaaaaagattttattaataccttaaacgtgacatattcatctgtcttgtttgttaggtgcagagaacacgagatttgcttctttaattcgactgcatgattaaaaaaaggatgcgaaaggatgaatattctgaacaagacaatattatcatcacatattaaagaattaccaaaatttgcacaaaagaatatgcttaaaacaaaggcaaatcggactatcggtgaagtgaacaatcaatattagctcaaaaaagaaggaaaaattccccctgagaacaaccctgaaatttcttca

SEQ ID NO: 77921 - DNA, 11515 bp, Oryza sativa
aatttttccgttaggggccagggccgggggagaattttcacctgcggatgagcgagggtggggatcggaattaacccacgggtaacccgaaggggcatcggatgtgagttacttcctccgtttcataatgaaagtcattctagtatttttcacatttatattgatgttaatgaatttatatatatatatgtgtgtgtgtgtatgtatgtatgcatgtctgtctgtctgtttagatttattaacatcaatatgaatgtgagaaatgctaaaatgacttacattgtgaaacggaaggagtacctctctgaaagtagcccattgcaataatataggcccattaaactcattccaaattgacatataaaagctcaagacgctagtttccctcgacccttatctctttccttacttcaaccaacccccttcttaccgtctactatttcgttgcatcaattcatctccacatcgcctcgtcgtcgattcatctccacatcgactcgtcgtcgccgagtcaccaagcagccagccgctgtccaatttgcctcgtgctaatcattgtctattatgcatcatttcaattagaagatagaccatatgatgtatcaagtatgtatatgtgcttgatcatttcaattagaagatagaccatattatgcatcatttcaattagaagatagaccatatgatgtatgcatatgaccttgatcatgtgctttatgtatttgtgtactgaccgatgagtatacattgctattgaaattttgaaattttatcatattattattaggtgcattgtcctatttttatggagtattatctttatccgggtgatgcggggcccaagtcacccatgcgggtcacctacggggacgggtgatgttttccacctgattgccttcgcgtgaccggggctgaggatacctacaggaggatgggggcgggggcattccagcccaacccgaccctgccccgccctgttgccacccctaagtgtaatgcagcggcaagtagcacaactaaacaaccccatattctcaagccaaactaataatggattaaaaatgaccaaaagaaaaaggaatagtgaagattctttattgctggaatgtaaaaagtatagcaaaattcatgtcaaattttcttacattacatcaatacgtagttctatatgttcgaaatgcctccaacatactccctcaattccaaattgatctacatattttataggtacaccaagaccaagaaaagctaataactctctcatattatatttactctagcaacaaactcaatgcatgcaccatccctactattttctagccaatagcaaatcaagatattgcatgtgggttataaatgcttgtgtgcatggatgcatgcatcaatgtccatttactccaatgcacaaataacaaatagacctaatgaatgaacacaaatatgtatatcatttagaaataacctaaaaaaactatatgtagatcaatttgaaatggagggagtattcttgtagttatcctaaatttcctcttgattttctactgcgttttcccttttttttccccttccaaacagttcacaataaccgcagcttaccatgtggttaccgtctgaaatcgcgagtaactatctcaaaactatggaaccactgtcagatcaaaataatttgtttaaaattttgacgaattttatacggtttttcacagctaccgagcaacacccataatatcgtgaaggtcgataacccccgctgaaatagtatggaaaaacgatggattagacatccggctgaggtactattgcctcaaaacctcaaaatgtggatgccgtaaagattaattctccgggtttcataattcttgatattttgaacaatgaaacggcctttaaaacatatttttaactatatttttctatttataatatatacaataaataaacatttttttatttttattatagtactttgtgaaataaatctatatatgttattctagtgattataaacaaaataaattttaaagccattgatagttataaaagtttgttctcatgttcatcaagaattatcaaaccaaagagagtaaaacctactccagcttgtaaaaatacactccagtcacatgcggcattctcttcggcatttctagtaagcacagttatatcaagcggatctacaagcaaaatacgagaaactagcacacgttatacaacacaacaccgattggctctgcggcgatataatgtcagcagcaatcaaagaccggcggcggctgggcagaaacatgcacgaggccggcaacacaaagggcgcaaacggacgccaccatcaattttgtgcttcctaaaatcctatggacaatcagaacatgcagatacaccaagatcgaaaaggggaaaaaataaaaggagaaaaaacaaaagatcctttggtcagtcgcatcgtcgtgtcagccttgtttcgtgtgtggtcgatccaaatcaggcgaacgaagggatcccgtatctccagccgttggaggatcgccgccgggtcggctgctgctgcggcgcgaagctgagcccgaacatctccttgagaacttggcctggctcctggagcccgatcagcttggcgaccagggacgcgctctccctgacatgctccaggtctttcgtctcggtccagaggcggcgagcgacctgcagtttcctcctcttggagtccagcgagacaccccattttgtgtacgtgtgctccctctcctccgtggacagccgcttctgcatctgcctggcaagcatctccctctcccgctgcagcttctttgcgctgcattacagcagagcacggggcttatgagttgctcgtgatggtttggcgctaattttaaggttatggcacaaaagaagtgaatgaatggaaacgagtaatttacgcacctcgcaacaggggaagtactcaggctgcctactatcgcattgctaggggtgctcccccttgagtatgtatctctcaggaatgatagccttcgaagctccacttccatgtagatcgagtcagctgcttctcccttgaatagcaagaaaaagtaagtcctgtggaccaaggaaatgctgcaagcttgccaaagctcgatgatctcttgctgcttcttctcgaattccaaaggccatcgagaaggtgactgagaaacaccctcgatcgggtccaatccgatgctctttccatttgcattctaaaacatggatgaaatgccaataatttaattacttgctgaagcatagaaaaagaagtattcagcagaaaacactatttattttagattattagttggaatgctaatggtatgtggcttttgaggggtgggagaaattgttgaaattctatgatagagtcccaagagccaggatgttaaaccgaagcaatactatatataagcatgtattttccaaaccagcatcacataatcacatttttcttgaataaaacaataattaaatgaactgcagagctaagtgccctcaaagctaattagataatttcatacctggtcacctaactgcttctgataatgaacctgggccatctctttgagttcagcaacaaattcaccaataccagtgaattctgtatcgcatgcaacagacccatttgtctttgcatccttaaaagtgctgatctcagaactcatggatcctgcccttgaaagtgtgtcggtctctgcatcatagtgcagtgcagatcctcttctatgagattccacaggtcttcctgggaactccaccaaacttctatttagtggagtgcaatcatccatctccatatcgtcaaacatagtagaacctgtcagtgatctacagctcctgcttctaccaattactcttaagtttgatgagttacgtgttgaagatcctagatctttggctagactgacaaaaggccttctaatattctccaagtgttcctccaaagtaataggagcttcgccagagggccttgaatgcctagaattcactgatgcatttgaatcatttccatgcaaaccagaattcatatttgaatcttgtgggctactactttcaccagctgataagtccaactggtcatttcctcctgtccgattgctttcaatacatcgcacttccttgtaaagatctgaatcatcatgagagacctgagaactatcatctctgctgacgcttgggggcattccaacagatggagggcttctgactgaatgctttccttgaacctaaaatataaacaaaacaaacatgaccctgccggaacaacgagatgaaacaaaactaaatttcagaagtcatggcagagaatatacttgacggttcaggtcatgatcaccgacagattgcagcaaatcctgcaacctggattgagccaaatcacgttgtgacttcagttcttttatttctttctccatctgcaatggacatgacatgaaattttatggatgtgtgcaacagaaacaacaaactttttttgtcaagtagaatagtgtggaaatactcgtaatggacaaggcaaaagtggcagcaagtaagatagaccagatgcacacaaaaacaatagttttctgcaaattccagtatgagccgtggaggagaaaacagggaggtaagaaaagtgacaagtaactttacctttctgatttggttgtccttttccttcaataatgtttcgagactggaactctgaactggatgccgcaactcgctctccaatctagcaagttccttttgcaagtgcttaaccagtgctttatcagacatgaccacattaacctgagcatttgtaactacttcctttgcacaactcccaaatagcagagtatttcttgattgctcaatgtggctagtggcagggctcagtgtacaaataattgcagttcttgcattacctcccaaagatggctgtagtatgcgtgtaagctttgaatctctatacggtatgtgtgcattacttcccatgctgcattaatgaaaagatataactgatatcacttgggcgaaattccaagcaaacattactgtaaacatcccactttattgtacactatataaaatcccaaaagaaaatacatatgcataaagcatgcttaaatatgtcagcacacaaaaaattgtgcaaaacatgacatgtactacacaaaataaaatgatatatattatctgttatcaaacaaatgcaaccctattgcctttttatgttttacatatctaacaatatttttgcacaaattctgtgcacataatacatgctccaaatatatatctttcctagaattctctaaagcgacaagtgtgaaatcaaaacatatatggagctacatgactacagccatccttaaaaaatcatactctgtcaagcaacaaactattctctaaataagacaaccaaattttcctataatgtggattgaactaaataaaattgcacagtttcaagttgagattcggacctcagttttctaatgacagtgccaagggcaagcaaactcctattaatgtgacaaccttctttcagtcttgtgccagctgacaatgcctgagatgcacgctcacttccagccagatcaacaaagttctgcatggggagaaatggagaatgaataatgcatgcacctaatttttccaataaaaagaactccatgatagacttgtaagatgttattcttactgcactagccacaagtgtagttgacttgtcctttcctaagaactcgcgagcagagctttcaactgtctgaattgcttgacaaatacatcagccaaaatgaagcatagactcaaagataacaatttataccaaagtactacctccgtcccaaaataagcgcagccatgagtttctgcgcccaattttgatcgtccgtcttatttgaaatttttttataattagcatttttattgttatgagatgataaaacataaatagtactttactcgtgacttctgtttttaattttttttaaaaaagttttcaaataagaggcacagaaaaccatggctgcacttattttgggacggagggagtaattcatagatttgagtaaagaacaaaccaatcgaagtatctgatgggatctagaacttttttcgtttaagaaggtctccccaaaatttgcttgaggaggtatagaatattctcgtctgcgccagcagcttataatcgaagtatgacacaaactttttttttgtattgctctcatgtaattcaggatttttgatcacttgatatatatatatctaaatttattcccctgttaccaatttttctctccatggcaacgagatctgattggaataattcaatttttcttcacgaggtcttttacctttgcactgtttactagcctgccagaccactcctgtttggtttggtggtgaagtggtgaacaccttttctcaaaaagccaaaaaagttcttttaagcttgacactttattagttgctgaactaggtaggttgttactgtactgtagtagccattattttttcctgttcatatgctaacattttgttgatgttagtatttctgatggaaactggcatttgtgttataacaggagctgggagtactgcagttctcgtcttatactaggctactagcactcctctgatctgatggccaacattaacatggcagatactgctccttcctgtgatacttacctgttgaattattgttaatatcttggtaatcctcttagagacttagaccagaggagaaaagaggaatctggaggtcaccgccaggaaaacgctacggacaacatgggcggcagatggggtgggagctacccagatctgcgccgacggtggcggccgaagaagaagaggagaagacgacggttggggagagagccatcctccattcgcgcgatggcggtggccaggtaggatcatggattcagatttttatgccatcgatttcctggtttgctcttcgtttactaatcatatgaattaatatgcatgtaaaatgactctgcctgctccaccatgattatgatgaataagagcaataccggcttcggccaataggagttttctctacatcagtccctaggaagatgcgattgtaggcgtttagttctcggtagccacaatactagacaggacacgctgatatgaatcatatctgaaagatctcaaaaataaaggatcctttgaggacgcgtcccggaggctccgggtgctccacaccgtggagaccgccggggtgttcgacatggtggcgcggtggcgcctcttctcatgcaggccgatgcccacggccgcctcgtgctctggtgcctggagcaggaggacgggtcggacaaaggtgttgtttttcttcttgcatttgccttagcgtaggaacaaaaaggttgtttattgtgccaaaatcgaatcactacctacttgctaagcttccatgaaatacgcagcaatgttcataaatttttgactgaacgtagtgatgtagaaggcaaatgttaagttcttatgcttctgaaagtgttctatcatccatgtgaatgttgcacgatatggtaccgtctcaatcctttttcgagtagtacactgctatgtacttgccgtaaaaattatttccataatctcttatcgattttcttatcgtatatggagctttattgtacatatgaaggtatagcgtattcgtatattccatgactcgtacaccaccttacaatggaagctattgtaaagtggttttagaaacgataatactaatttctcaggcgtggagaccgctggagtgtttattttttcaaaataactttttttagataataatcacacaaaataactaaatgtatttaacttatttcctgtaagtactggtaattttgccacctactgtgcttaaaccaagcctggatacacctttttttttttttgctttggatacacttaaatgacgttcaccaaagatcgtcaccacctgcggacgggatctagacatgagaagttccggctatagctctatgttaaggattgtgggaaggagctttttactctaaaagttctgcttcaatcttttgctcaaggtactagattaaaggctaactatcaaaaatcatgtttaatccctaaaaacttgagtgatggaaaagatgagatgcttgctagggtttttgtctcggaaagaaacctagagggaaccacttaaccgatggaacactgatgctaatttcccgacatttttcaaattaaggagtatagtttttcaaatctgggcataattcacgatatgctgatgtattgtgaatcaggcgagtatagtttttcaaatcttaaacgccgtggtctcttgggaattagacagtctccatatcagaaaccaagcagagttctcaatctattcaggtcctatcaaagctatattaaacgaagatcaatttttataggactagagaaatttgctatgcaaatgccggtcactggccttatccatactaagtgctctagtaactaataactatggcgtggtgtctaggttagagattatctttgtttgttgtgtatcccacggatttgtcagaggtaggcggcaggtggtgaaacttgagaatatgttgggaggagtaaaacgtacgtacatactatatacgcacgtacggctggaggggtgggaggatagttgatttcttttgatagatttaattagttttgtgttatctataacagatctaatggcataaataatgggcccactgatttaagtgaaaatcaatggtgggttatttttagaaatttttaatattttttaatttactaaaataccacatgccacatggcggcttgagagcgtttataggatgtctatgtggtggcttgagagtgtttgtaagaagtttcacggacttgatgctgcaaccttcaatatacctttctagattttaatataatactagtccatctcttaacactagtccacactattaatattatttaaacttttaaatatttttataaattataatatatttcatataaaataaactaattatatatgatgttatttgtataccttctgatatgattcatatcagcagggagattgctctaaaatattctagcataattctcaagccatatcatagtcgagtggagctaagataacaagatagggaatactagacaccgtggagaccgccggggtaaactagacttcttaaacgaaaagggacatgaactagcgcgcgagaagagcaatacaggacatagtcgagtggcttataatgaagttaacggtcaactgacagtggactgatggcaatggcataaaagggaggagaaacttgaaccggtggcataaaaaggagaagccaatttgaagtggtatataagggagccgattaatttagagtggcatataagggattctctcttaatccaagcccttcatttattttccaatcccaatctcaaccctcatttctcattatccaaacacaccctaattgtgtcgtcatatttctagttagtactagatttcagtcagatttttgtgcattggatttgtgttaagacccgtgcttgaggttgaaaggccgttggatctgtgttgatgtaggccggtcggggctgatgttacgggacattatgaagttcaattggcaaaatttactacatgacactcaaaaaaacgtgtaattggctgtgagacaccgcaaaaaacgtgacacagctgatggacactagaaaaaatatgtatgagctataggaaactttcgtggtgctgagctgcatcctctgtccgggagaagctcgctgctgatttcaaccacatcctccaaaacttcgcctcagcaaacttcgtcgtgggaggaaattcaccaggtgacacctccagccagatttggcatgaccttggcagcatcaaccacctctgttgggataggagacggtgacgactgctaggaggatgtggggtggggggtgggaagcatggtgaaggcagaggtggtgcagcgggagaggatcttctgatgtcactgttcaccgtgcctgacatgtggacccaagacagccaccaaattagtggaagttacttatattgggattagcttttgattttaccctggttttcctatatatatgagttatattttggtatagtatagtatagtaagtatgattgtatgaaatggtttaatttcaggatagagaaggcttaagtttggagtttttttgagcgtgtgaaatgtgctttggtaaaggtagagtgctcatatgtcctttttgtcctctattcaatttttttttgtattttctttctctctgtatttaatttttgtggttaccattatatgtactagtatattagcctttttgctgctactctaataatttggtgatgagaaaatatgtggccaccaaattagtggaagttacgctaaaggagcttaatccggtgcagtagcggcgactggcatgcggtggtaaaagtggccacacgggcacatgggggcgtgctgatgcatgagctgctaatgttggaggctaggattaggatggaatagggtggggagtatatagctgatgggcttagttctgtttcctggacctgtgataggttactgggtcaaattttccaaactcagtgttcggtcagatcggataccgacaaagaagaccgaagcaccggaaaaagaagagggaatagaaaaggaaggagaagggttaatgcaaaatataagtacattgtgactatgtgatagataattatttatgtggatggatgagtagtcttgatggttccctagtttcttggtcctccagtacttttaccttctcattttaatttattactgcacaaaacatatcttcttcaattcgtcctcttaatccaaattggttgcgcatctctctcacacacacacacaatcggggtacatatacattgcttttttcttggatggaggagggccatctgttagatggatctccctccccttgagcccaacggctcaagggggccttgacccgcgccctgatcgggggcgcccagcccaatggctggtgggcccccgtcacactgtgccatataaagaggggtggaggacgggacggaaagaaggacacaaggaacgaggttcgtcgccgccgccgccactccaccccataaaccctaaccgatcgagggggcgcagccagtgacgggaagtccaccgccgcgccacgcctcgtcgttgacaccgtcgctgctgcaaccgcatcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctatttttgttcaatcatccatcgcaaatagaaccacccgactagatctaaacctaggtgatccaatagacaacctaacaatggtatcagagccaccctagagtttagattggttggggaaagaaatgcaaaagaaaggcaaagaaaagcaa

SEQ ID NO: 77922 - DNA, 1309 bp, Oryza sativa
aacgagaaccaggaaagccgcacaaggatcgacaacaacatcaaaccatggaagctcatgcgtgctaaaaaccatggtagactatcctgtcctccaaaaaataaagcctgaaaagacaaatatatactgttaggtgggacgcaaatattcaaccattaatcaacatgctgcaggaacaagagtggtacaagggaaatcctacttaccagattgggagaaatgccacgggcaacagctgatccgccgatggtgtattccagtatcaatgcccaaccaatcagccatgcaactctaaaaaaaatataacattggacaatgttaagaacgcccaatcaatggagcaagagagggctattcatgaacaatgtttactctattgtgtaggtaaattacccttcgccaacgcagatgtacgaataatggtaggcacttcctgcagaagggcagcgactagcaagctctgcataacagaaagctgagagtgcagctgccactccagctatcagaaatgaaagtgtcaatgccggcccagcatgctcccgagcaactgttcccacaagaacatatactccagctccaattgttgaaccaacacctgatagatcatgaaaggtttcatgaacaataaattcatagaagctgtataaaatgtggaaagacataattagacttgtggtaattcgttttcaactactttacttcaaatttagcagacatcaagcatgttatttgcttcaataaggtagtaaagtaatatttaggcatctacccacggcccacctacccagcacttacccaacaagattaaggtagaagcaaagcaataattctccaaaacattgcaagaatccatatcgagataaaaccatcattcccataattaaggagatttaccaagtactacctctgtcccaaaatggaagctatttctagctatgaacctggacaggtacattttcggatcgtaacagatcatgccgggcatctgaattccgtgtttgaatcaaaactgtctgtctgaaacgcagactaccagaaaactctatctaaaaagttcataatccacaagttgagccgtttaataaggactaatatatgtgacacccggccaatcaaagactcacaaactttacaaaccaaatcaaaacaatacaactttatataacttgtaatactcagcaaacatgacaaccaattaacgaaaatccaaacagactctaccgagaatcctgcaccaaaaaaaacaaaaaacaaacgccacaataattcatgcatagagatcacacctttcccaagcaataatccctca

SEQ ID NO: 77923 - DNA, 759 bp, Oryza sativa
gaaccccagagtccgcacatcctcaaatacaaagcacgttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccaccatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaa

SEQ ID NO: 77924 - DNA, 8015 bp, Oryza sativa
acttgtcaaaaaaaagttgccaacacattgctcgtttgaccccttccacatacaaaccgaagatatgatcgatctgactattttgttaaagccatataacggtgttaactgaatcccaaaataccacttttgtccatatttcttcaaagcttttagactttgttcgtttccccaggttcccaactccgcctctcgtttttcacacgcacgctgtttaaactgctaaaaggagcgttttttatttcagaaaacctacaccacggcatcccgtggagatgggatcccctcctcctacctcactcctctccccaaaatcatccgaatcctctcctcctacctcactcctctcccaaatcacacggcactgcagccctccccgtcgcctcctcttacctcactctcctcccccaaattagacggcgctgcagccctccctgttgtcgtcgcccactgctcaccggagccggcggccgccgccgcgagggaggccgctacggtgaggagctcggcggcgagcgtggtgagcgagagggagagcgggagcagggtgcggttgcggcgacatcctccatggccggcagcaagcagatctgctacagcgtcggtgatgaagacctccatggccggcggcaggggtgcgctgagcacgtcgtcgtccacagccggctgaggaggctggggaggcatggtacaaggtaggcaccatatctgtcgcctcctcttcctccgccgccgcgccgccccgctgctcgacctccttgaccccgcgactcctcctcctctctcttagggtatcacgctgatacccaggtaccaaggtctgatacccaggtaccagctcgatacccagggtaccaggtatcagtcgataccaaggtaccaggacctcccaaccccgcgactcctcctcctcctcctcctctctcttggggtatcacgctgatacctaggtaccaaggtctgatacctaggtaccagctcgatacccagggtaccaggtaccagccgataccaaggtaccagccgataccagtgtaccaggtacctcctcagtaccttacccaaggtaccaggaggatttggcggtgaggtagctgctactctgggtgctcaggggtgacgacgccggcgaggtatcacacgtgaggtagctgctactctgggtgctcaggggcgacgatgccggcgaggtatcacccgagcacgtgataccgaggagaatttttggcggtgaggtagctgctacttcggcgatgacgccagcgaggtaaggtagacactgctccggcgacgaaaccaagcaggtagtggctaggtattgagacaaatcacgtgttttgtggggtgctcctttatgctgtcgttgcttttttagttatcccgtgagtgcactatttccacggtatcccgtggggtagcagccctctttttattttgcaaaaaaaaaagtttctatacaagagttcttaaagaatcatattaatccatttttgaaaaaaaagctaatagttaattaattacgcactaatggatcgctctatttttcgtgcgcgggacatgggttcccaacccaggctaccgaacacagccttagttagtttggcctaattattgaatggtggaaatactaggaacgatttttcacaaatcatgcactgagtgtagattttatagatttgtcacaaatttgatttagatttgttatattcttcattggagttatcgtcgtcaatccgtgccaagcaacagctaaaaagaaatccacgtataaactcatacgtatggatgaacagtagggcttaaatataaggaagttatttttttaataatagatctaatttaatggtgtaaaataatgggaccaccaatgtaagtaaaaatcaacattgagattagaagtgacacgtgaagaacgtttgtgcgtgtatagaaagtttaatggacttttaaaatataactagaaaggtagcctgcacattcacgcgggcatatattgtacgcaggattaaactttccgatttagccgatttgatcaggcatcactaaaatttccaaaattttggtctgaaattttgaacaaaatttagttgaatttgaacaaatattaccaaaattcatgaaaaaataaaaaaattttggccaaaataatatcgtatcggtggggtctaaaatgagcgaaatttccaacctgattgtacattgcgtttgaaatatagaatatcaatcggctgacatctcccatgtttaaaagtactttttttatttgaataaaacccatcaggtgaagcctccactgttcttcggcattttgctttgataatttttccaagatatttgttaggtttaaaatatatcatattttatacatctgtataaataattatctatgatctctttattatatgaaaggaagtttgatttagtttgtttggaaaacatgtctaacaaatcaagtgtaaattagtagtaaggcgtttagacctttttttaatagaatgtttacttgcttttttttttacaaattctaaagaactatattgttaataaatatgttttatttgtaccatcaagtagttctccttctggtaggtttaagttgatgcaagttgttacatacctacataagggtatttatatatacaccaatttaaataaaaatcaactacagatatagatctaatctaatagtctaaaataacgggtccactaattaaataaaaatagacggtgaaatcgtttataggaagtttaatgaatgatatttacgtaaatttatagaatagtatgttttatctttaaatagaattaaagatcattaattttttttcaatgcgtaggtttactttttttttcttcagataaacagctggtacgtctgtacttcattgttttttttagtcgtatgtagtatggagtacttgcagttatagttctcccgtatacatataaagattaaggaataagtttcttaaaataaaatatatctaatctaatggtttaaaatattgggtccattgatttaagtgaaaatcaacggtcgggtttgacagtcccacgtggcggcttagaagcgtttgtagaagtgccacgtggcagtttgagagtgtttataggaagtttaatggacagacagatagataaatagatagattgatgtggacattactagaaaattttacattatgaaacagaggacgtataaaacagcgggaatattaaataacacgtgacaaattaatatctaaaactctagttctcgaaggcccattcgttctccttgcggatctcctcctcctcctctggtgtgaagtcgttgacgatcccgaacatgtccctgatctcctgtaccgtcttgcccttgatcaagtcagccgtgtgttggcacgcaagatcaagtagagacggcacgttcaagtagttggcggccaagatcaagttgaacagcatcgtgttgtcgacatcgatgaagctggcatcgaagctcttcagctcctgatccttcacggcgacgtcctcggcagcggcggcggcggcgtgtttcttgcagtactcgagcaccttggcgaggacgttggaggcgacgttggggagagggacgccgttctccgtgcagccgtcctcgatcatgttgctcactagcttcgacatgctcgcctccgcctccgtcacctggaagtgctgcccgtccgagctgatcagaaggatcttgctgtcgccggcgtcggctccctcctttactgccgccattgatcgatgtcggttagtttctcgtcgaacacgcttgaggttgaacacggacggacgggacgaactcgctagctgatcgattggttgcgcgcggtgagctgaacggttgaaacaacgttaatcggtgcttggcgatcgagctgtttggtgctttgtgtatttattgcgagaaccaggccgagcaactccgattcgtactccaaatccaatctgattctaattagtttttgattgtttatttctgcgttactttgcaataacgccaacacagcttaattagctacttctactcagtttaatcggactccgcttcaaaaccgaagtaccccttgtaggtgttatttctggagagattaaaattagtttgttttctttcggtatattacactacatgcatgcatatacctaatatgagaattaataaagactccgagtaggtgcgtgtgtctcctgctagatcacgagagctactacaagattaattagagatcaccaagaatttctaagacctcatcaaccaaaacagatgggagtaactaaaaagttgttacaaattctttgaggtaaaaaacatttatctattatctactaatagtccattaaacttttcacaaacgctctcaagccgtcacgtggcgctcctacaaatgctctcagtcgccacatggcactatctgatctcacagtttatttttatttagattggtggacccgctattttacaccattagattagatctattattaaaaaagtaaaatgcaccaacgacccttaaacttgtcaggaggtttcacttagatccacgaacttacagagcgcacatcgagttccctaaacatgttttattgtatcatcccggtccaaagccgcgtttgaccgtggtcttgcctacgtggcacgccatgtggacgatgacatggaattttttatatttttttctcccttcttccttcttttttcttcggtggtgagaggcggcacgaggggaggggctgtcgcagtggtgcttggcgaggtgccggctgaccggcgcggcggagggagggcggcagaggcggggaagcctgcgtgaggaggctgtagccaaggtcggaggcgagcacgcggcggcggcgagcacctgggggcggcgtttatggggggaggacagcggcggcgatgccgaaccaccgcacggcatgggcgctgccactgctgcagtttcgctgagccgccgtgctggaggcgagcgagcgacgggagggaggacagcaatgctaacaggagggaggggacgggggcgactctgggaggaggacggcggcgctgacgggagggagggagaccgcggcgactgggggaggaggacggccgcgccgacacaccgtctcgcctcggccgcatcgtcgcgtgcctacgccgccgccgccgctgccgcactgagctcccccgtgccggcctctcccttccattgccgccacctgtgtccgcccgagccgagacgacgccacggccgatctttcttctcctctccacaaccgccatctcctctctcaccgccgccccgagctccctcgtgccggcttctcccttccatcagcgctgcccgtttccgcccacgccgagacgacgccaacagctcctctctcaccgccacctctcttaaaaaagtatatttcctcatgtttataacatacaagcgctacaatcgttgtgccgtaattacgagttgataagatacaaactctaatattgttcttccgtatatacatgattgtaaacaaaacaacaaatatttactaatgttcgtcggaagaaaaaaaaacatacgcatgtacataataaaagaccaaaaaataacacacatctataaaaatcgatggtctttaaaatacgattttctacgatatgaagtcaaaatatattacttcacaaatataaatatataaatataattaaattaagatccgtaataaatgtccgaccaatgttgcttaaacaatcttctatatctatctattgtaaactccataagtatattaaactttctgcaagcactcttacgctgctatgtggctctcagagagaaaccctagaaatctattatacagtaaaagtctgttaaagttcctacaaaccctcttacgctgtcacgtggcgctctaataaattatataaatcctagaaattcaaaggaaaaaaagaaaagcatcggaccgtcaaatttcacttaaattggttgacctaccccgttattttaaaccttggattagatctattaaaaatctcatgctgctaatctctatcccggaaaaaacataacgtgcgtatatgatcgaaaatatataaagcaaaaaataaaagaaatatgcacagtacatagtagaattggaaaaatcattagcgccgacactgatgtgtcggcactaatgattaaactatgattttaataaaaataatattacacaaatatacacagctaaacttaatctctgatagataaaatatcaaagcttcattaacttaaatatgccattgatgacttatgatggttatattgtagtgctaaataaatcatgacaaatgacgcaaacatgtaatagttaatgtgataataatgtttcaaataatttcatatcatattttatggtttcaaatatcacttgacaaatgtacaatgttaatttgaatcacatagtaaaaattaaaataacaaaacatagcattgttttttaagtacatctatttaggtttatttaattttgggagagattgagattctcaaagtatttggaatttttcaaaactttttgttcttatttgaggagtgagaagaacaaataatagatagatgagaaaaaataaattaaattatagcaagtggttttgctatgataaaacaacagaatttagctttggtttttatgtgaatctttgtagatttattttgggtgagattgggattctaaaagtatctgaaaattttcaaaacttttttattgctatttgaggagttagaggcatacatgattcatgatgtaaaaaaatatatataaataagactttaaatagatttttttgctacgatacaaccccttagttcatcacgagaattatgtattttctttgccaagtattattggcaaaacatgaacaatccagtaaaatacgaataaaattacttatattatattttttatagttgatagaaaatcaaatggagtgggtataattgatggacgaatgttatacaccactgaacccaactgtaaatgcactctagcgaattagttagtgtaaataagtttgtgaaaataagtacattcttagaattagtaaatgtgtctccattagctataaacaacatatggtggaaacaaatctggcgctaaagtataaatctttatcaaaatataaataatgatatggtcttttgcattttttttaaaagtagtgtcgaatgattaaccccactcatttgaaaaacataatactgtatatactccattaatatttgagaagtacttattactaacttcatatacaaatattgtctattctctaccacaaatcgaccaggacaaagggatttttcgggacattcctatcacattagtaatatattaaaacatactgtctatattacagaaaatatatttatttttttattattgtagataatttacattcctttaccgtgtatatagtgatgtatgatttcttttagcatttcgtttacttaataaaacataagatgctgtgtatctgtgcgggcttcctttccgatttatattccggaaatgttctcctatttatattttatcattataacgtttcaaacacagcctatcatacatgcccatgcgaatgcgcgggctaccttcttttttgaaatgtaaatatatcatacgtaaactgcaactagataattacaaacttacgatgtaactttacatatatgtacaaatagtgtatgtttcaaaacttataatctgaaatgttagcctaaacacgcatgatcatctaattttgtgaagccaatagccctgtagtagatgaatcctccccgtagggtagagttgtcggtgtagttgtggactggccgtcactaggtttgatgtctaaagcgtcgccggtgatcgatccataggttgatgtagcggtaacataccaccttgtgaaatcacctggttaatcatgaatgggtcccaatgataaacatggaacatggcttaccgtgcgacagagctcgtcattctcgcatggtgccccttcccttcttatatat

SEQ ID NO: 77925 - DNA, 532 bp, Oryza sativa
ttcctttgtcttgtgcctttgggccttgtcttgataggattagggtcggtaacaagagggagcagttgattacaagccctgatggcagattggcagaggagccttttttttttctgtcaatggaagattacaaagcaggatcaccaaattaatgggagtaaagaaatgttctgatcagatcgtggttgacgtcatgcgttgtttgttttgtttgtccgtagcttgttcaaagattcctcggatcatgcgatcgccaagagtaaatttagtactgctactctccaagttggtgtgctgaaagtttcagaaaatattttcaggaatcagcgaactgcctcttgatgatgcccaagagataggcatggcatctctggatggttcagtatactagttcattttggtgtgataattgttttctaaattcggcaaatcaatgatggtttaggaaacacgttagccaaatgctccgaactaaacttctgtctactgattgagctcgtcagatcagcagacaatacacagttggtgtatt

SEQ ID NO: 77926 - DNA, 9458 bp, Oryza sativa
cactccccgggacgcaaaacgaagcagcgtttagcaagtgattaattaagttttagttatttttttaaaaaatggattaatattatttttttaagcaacttttgtatagaaactttttgtaaaaaaacgcaccgtttagcagtttgaaaagcgtgcgcgcggaaaacgaagagggggttgggaacaactgggaacgaacacagccttagtatatcatttagatgtgtaattatccattggacttatacgttgagttgagagacttatatcctctgggttggtcctgtacctccaattaaccatggggaattcgcatgtttaatatcattctaggttgcttgtgacagttcatgatatagacacagaaggaatttcttaaaaattgcaagtaaaagaatttaaatacattaagtgcgtggagtatttctggctagtatgtatgcactggcagtttctcctacggtcttactagcattcacttttgtactaaacatgtatctattaataatatatccatgccaagaattgactatacttgatggacgacatgacaaccgcttcagttatttcatcggtggtatcgcaaccaatctataaagagacgcttgtattcttttatgatccaggcgtctcttattgttaactcttagtacttttaagtgttggtcgatgcaaagctcaacaagctaatgaataaactaatgtaaatccaccaagtataaattatgattagtagtaactaatcatagagttaaaatgacccttagccgacaactaattaatgaataaactaatgtaaatccacttgtactctcagccaaaaatttttttatcatagatatcaagaaaataaaggggctacgcttttgaagttccatttttagagtcacaactagtttcattgaacaaaatatagatacagttgcatccaacaagcataggatccaatcgttaagaaaagatgaaaaatcacatttaggaaatactatcatctagacaaagcgacacgagcgtgtggccaaaatataatattaagctaattagtcatctaattagcttttgtaaggcctaactgaattagaggtccagaccacaacccataatttttcgatcgatgaagatgtcatagatgatgagcgtcgtagttatataagggtcggacattttagttgtgtgtatagcattttccataaattaattgccaagttgtactcggcggcaacggcagcagcgccggccatagctcgcggggtgttgcaatcgctgctaaccaagcggtgtggaaggaggggatagagaaaagagatacgagagagctgacatatgggtttagggatatttctattatttcacatgatttctcttttcttttcaaccgaaaattattatttgaataggtgtaatgtccactatttataaatagtgttttataactaaaaccataaaatcacagtagataatattaagtggttccaagtgaaaaactcagctaaaacttagcccaaaagctacagcaagggtaaaaatacattgcccaaaataagatttactcgaagtattgcttttattagggtctaacttgaaaggaaattccccaaatttcgtcgtactcctctgacgactccgatgagccgccaccgctcgccgtcccggtccccgctggacgacgacgacctcctcggcgagatccttctccgcctcccgcccattccctcctcgctggcccgcgctgcctgcgtctgcagccgttggcgccgcctcgtctccgaccccgccctccgccgccgcctgcgcgcccaccaccgcgaccaccttcccctccacggcttcttctaccacagcgaccacagcgcccgcctctggcccatcctggagcggccggatcgcatcccggcgtggcgcgtcgcccccacggagaagctgctccctggatggcaagtcctcagctgctcccacggtctcgtcctccacaaggatcgcgagaagttcatggtgcttgaccccgtcgccggcgagcagcacgccgtgcccttcccctcctcggtggaggacacatccgggttcgtcttggggatggtggttccttcacgccgttcttcttcttaccgcgtggtggcgctcttcgccggtagatctaccagcacaagagtagccgcctatgtctactcttcagagtctgggagttggggtgattcggattcccccatcgcgacattggttctaccatcaaaggccaaacatcgagccaggcatggcaccattgtgggcagtgtgattcactggtttcttgatggacacaaggtccttacgtttgatttggagaggcagattctagccatcatcgagctgccgccggaggtggtgaaggatacggattcattctatgaatttcggtgtcagatcataccagcactagatgatggtgttggtgaggttcgtcttgccgttctagctgatcctaacatgcaattctgggagaggaagaagacagggggagatgggagtggtgccgcatacacatgggtgctgagttcaactgttcggctgaacttcccttccattgaatcaatcaggagtgatctgaaatatcaggtcctggggtttgatgatgaaagtaatgcgatctttatatgggtgcagaatgttcttttcatggtctacctcaggtcgatgcagagcagaaaggtgttggatcattggccccctgctgacatcttcccttactcaagcttataaattgcaaggtgtcatatcctctttagactgaccaaattatttttgtaataagttgtcagattattttatctttttacacatgattcaattttgaagtggtatgtggtcaatttgcaaagtatcttcttctatgccaaatagacctatgaaatgcccacttaatgatcatctctgtttctccataaataactaaatgatttagttcatccattctatgcgtgcaaatagatatagtaagtaacagaatgaaaggctggcatgttctgttctagaaaacatgattatgtgtcttggagtcctattagaaataatgaacctaaataacgaacaaagcagtgtctcctatgctggaaattttattcatgcaggatgctgccattttttatatagaccatcaccctctcttgttatgtggtgtttttattttaatataattaactgcattttcctttttacaaacaaaatcaataactagtgcatttgtaaccttattattgtaatatcattgattagcaccaatactctgctttttttccaagaaaaattgttacaactttgtgaattatgaggtatattttggagatgattttgaaaagaagacattgctactcctaagttttgttatcttccagataattattatgaccatgcgtactggttatattaatgataaagtgacaatgaagcaatgccatgtagttctctatcatttttgtgtagactattactaaattgcaatctatagtaaaggaacagaaattcatacttatcaaatatgaacttgacatgcccagcttctctatactgtgggacagcttattttctagtcaatgagttttgtgtatgcattcactcaattattttgtcctggagtagaatgagaactgtatatgccaacattgttttggttgctaagggtctctacatatttaatcagttgtgcaactttgcttatttaagtgacaagtcttagcctgcatagccttcattataagcttaattgtagtattattggacctaactgtacaatgtgactgatcaatttatgacaataaagggcatcgtttgttctagttttggacctttggcatattttattgagttgttttttccttgcttctagatggcagctcgttggtgtataacaagatgattgcacctatggtagaagattatattcgaccatgtagtctgtcagaatggtaatctagatggctgctatgcatttggtattagttgtaggagatagtgtatgccattcaatgagctaaattggaagcatgcagataccatgggaaaataaactgtcatattttgtgttggctgcttattgacaatatgatatgtagtgcacttttaatccccttgtgtttgggtgccgactatcaatttggtaaccatgtgaacctgtgacttgatgcttcaattcgttgtgtaaaactgaatagccaggtctgctgtcgcacttgatgaagcttgcatggcaatatgctgtccatgagtacaatggtttatatgactactgttccctaagaaatgttaatggagtgatgcaggtcttattgctgatatgctgatcatttaaagggcactgcatgtatgaactgtgaagtagttgtgtaactggttgattgcagatatgtgatgccacttgtcttctaccgacgtctaatgtgcccttgatgcttagattgactgcgtgtacggcactatgtgatgaagcctgcgtgctgatctactatgctgtccatgcctagctatatgagtatagctgttcataaaagtacatgttcatgtagatcttttccatatgtgaagtacagctcactggttgcatctctgtgaagcaacttgagattttctgttagtgtgcaaatgtcccgtacgtgatctcatcgttttgtgccattccaaatttgttggtggttcaagatatgcgattgcagagtgctcaataaaattagctccggtgcaaaggatcattcttttgtgatacagccacgtcagggggacaaagacaacatctagctaactggaagagcaagtttagaattgagcatctgcattgcagcactactggtctactgcacgcactttacgaaagcacctggggcatttcattatcctctagctcaaaagtcacgtctaatgccacgtgagacagcgactaggttaaaaccaccacgtaggcacaacaacagtgagcccgccctccaaaactgccaagggagcaaaattacaccggtttaatagttagggggtcagagataccgggtattgtgatacagggatacaaattaaattcgggaaaaagtacacctaaggtcccccaacttgtcatcgagttataaaatcgtcctcaaaccacaaaaccggctacaacgtatcgtccaacttacaaaactagtacaaaactagtccctcggcggttttgaccccggtattgtttcacgtggcggctgagtcagcgtggaacccacgtgggcaccacatggcagggtgtccccgtcagctcctgcgtctctttcctctcttttctttctttgtttttctcctcctttcctccctctcgctctctgctcgtgcataggcggcggcgcgcgcggccgacgacggcggctcccgggtggcggcgcgtgggctcagggcggcgcgagctcgccggcctccccgtccccctgtgtggttggcgatggcggcgcgcggctgcggccatcatcaccgagatcgattcgacgccgccgccatcagtcgctgccgtcggcgcgctgcagtgggccgtccgcaacttcatccgcgccggcgactgcatcacgctgctgcacgtctgcccgtcggcgaggtcgcggcggaggcggcgcagcctacgcctcggcggcttccagctcgccctcgccttcagggagctatgcaacggcatcgcggaggtaaaccaattaatcaatggtggtagttggctcaactcaaaacaaagaaagaagcaatcatcttgttaattgtgaaatggtatgcaggcgaaggtggagatagtggttaggaagggggaggtcggggagacggtgttggcgacggtgaaccagctcaccgccaccacgctcgtcatcggtctccacgacaagagcatgtggcgtgtcggaattttatttgccgtggccgcagcggcgggctgtatcgcggggtggtcggcgcttgagctgctggagcatggcgacgacgactggattccgaccttccccagctcaaggctcagcctcgtggtcgccatctccgccttgtcctcctgctcgccctcgccgccgcctcctgccgacatagcacaaacgaaaatcaagcccaaggcgttcgatgtgcatgtgatagacggcggtaggcaaggtcgtcgcgcggatttactactactcacctgcgtagcatgcggaggcggcgaggcctcgtgttgtccggttgtggcgccggccatgtccgcgagagccatggcggcgtcgagctgagcggattgaacgccatggcagcgtcgagtcttggagcatcctgggcgcggtgagtggattgagggtgatggtggcggcgtattggggaggcacatcggagcggggaagggatgacccagtcgcggggggagaggagcggggaatcgacggcggcgtcgagggcgtggacctggccgaccccctcgtagcctgcaacgacggcggggaggggagggcgaacggggtagacgccctcgacgcggttgaggtcggaggggttgatgggggcggccagcatccgcacgcacacatcgcggttgccgatctccgccggcggcagctcagccaccctgaggactttgtcgggcgggccgtggtggtcgtagaggacggctatggcgggcggggacatcgaggcgcctcgcccttgccgtcgtcgttagtcgcttcgtcgttgacgccacggcggtggcattgcctctgcccgtcccggcgcaggtggaggcgacttccgaccgacacttccgaccgcctacgccgctccccatcgccgttcccacgcgcaagagatgagggagagagagaaaggccgggtagagagataagggggagagagagctacacactgacatgtgggtccctccatgctgagtcagcttgtcaatcgggtcaacacgccacgtcggatgaaatcgtcagcaaaactaccgagggaggtgatttgctctggttttcagagaaggaggaggcattatacccggttttccggttgagggcacacaaacgcaagagatgagggaggcaaaatggacttattccttcacaccaccgtacttggtgtaaggctgggccttaattgggttgagatgggctggccacacgctccccttgtgaactccgccgatatccggtcgatccccttccacggaataggacggtggtcgcaaggttcgatcaagcttcctcctctttgcactttgcttgctggttttgatttttggattccttccgtttgcgtctggattcattgatggcggcggcgacggggtacggtgacgccccgaccgccgacgatctggccgcgtacgaccaactgctcggcctccgccacactcgccacatggcggaggtcttcgccgtgcgcctgccgcacgccgccggactccgcaggccgccgccctgcggcaccatcagcttctgcggcggcaaccactgcaacgacgtcatctacagccgcagccgtacggacgactccacctacccaccgccctgcgacacccatgtaaaacttccaccttgtaggcagctaggtaatctcattcagaaaccggctttcatgcataaaccatcacacttaatttgtttcttgctttcaaattctgaaatataatatatctataatagtcaaaactgtaaaacagagtctaatcctgcataatgtgtaacatgacccaaggaaatgaatccacaagactaatattccgatcgaatgaccagtgattccgaatgagcaattcaggatttgtgtagctcctcaatatgttccggacctgtaattgttggtgctgcatattttcttatttagtgcaaatgaaaacctcaaaatttatgaaatcgtatttacaactagcattcatattaatcaagaaagaaatagagattaattttagtttttaaccaaagtttcgttttggtttagcatattttcactctggacacccttttcaaacatattcactttagtcccattttcctgaataccctttcgctttgggtatataaaggacaccaatgcaacggcattatcgagatgagcatgaccaaggtgcagtttgtaggatcaaatcacaataactaagccaaccagagaggggtgaatggttggtatacccaaaaaccgaaaacttttagcggaaataaaagttaccctcgaaattgacggaagtcggtctgaccgagattgatctgtcggtctgaccgagtggtgccgtcggtctgaccgagattagatctctagtctgaccaccgagatcagctaccgctcgctgtcgccgccgccggtctgaccgcctcgccaccgccggtctgaccgccgcttgccgctggtctgactgccggtatatcgccggttagaccgccgaaacccggtaaaacacaaatcgaagaactcttaaagtagatgacgactttattgattctctctgtgtttacaaagtgcaccaacagcactccctacaaaaatttcgactaaactcgaaaccctaactcaaaactcaactcaattgctctcaaaagcgatatcgggaagcatcacgctccccctctatttatacccgaggtaggcagcctaaagccatgaaccaaacttatactaggagtgctaaacaccttaggaaactctctagtataagaaacaaactttacataaccactcataccaaatttggactccttccgaattcgactccgcatcccatatgcacacaataactccatcgtatgccatatggaatctccatcaaccatgtgcatcaactctagcctaagtatcccgcatgatctctgaccaccaggacgtcgtcttatccccaagctgactcccggtccatcaccgcaaatactctcccgaggcatcgagtcacctacacatgaaataaacaaagaaaccatattccgagaccaagctatcacaacttgagtcattagcagcaaacaatcgtatagtatccatctagaagccataatcatgaaataatcacggatatccaaacaagcaacccaaatccgaaaccgacacagcgtcggccggtcagaccgcgggctaggccggtctgaccgcgcgatacacgccggtctgaccggctactagagcccggtctgaccagtcacatgaaataacagaacctgcgattcacctataaatccaatcatctccaaaaccacttcgtgaataaattctaaatatcaaaaccaataatctccgatgccaattgttcatcacagaataataatcaaaaacacctttgattttacaatctcccccttgatgaacacattggcaaacccatcaaaaatgttttggtgtttggaaaaaaaaataaaaataaaagtggtaaaaagcacacttcgtacaaacgtacatatcgtgctcaaaaattcaaaaatccaaaagaaaacttcttcccctttctaaaagaaagaaattcccaattgaaccaaaaacatgctcttcttaaaaaaaaactcttcgct

SEQ ID NO: 77927 - DNA, 15085 bp, Oryza sativa
  unsure (1)..(15085): unsure at all n locations
acttccgcttcgaagggttcaatccttaccaatgaccctaagcgaaagacaagcttagggggagacatctctccccccactaaggtaacttgtgtcattgcatatttttctttccaaatgcatgtttatttttcattgcatcttataaactaaaaaacaacataaaaatttacaaaatagaaaggggcatttgcaaatttgccatcggttttttcaattttgcaaggatgccactcgaatgacagttatagtggtatttttgcaattatctagtgacagttttgcaataacgattcaaagcagtggtaaatttgcaattgccccaaatagaaaataccaaaaatataggttagattttattatgctaggtaagacaacttagttctcttcgttgaaatgatgaatagttgctctgttttatatctctcatatatgggttcatggttaagtactatctcaaaaattgaataagagtagccaacaattatccggggacctgagggaagtgagctgtactttgctaatctgagtctaagttattgcaagatataagatagtaaataagagttgctatgatcctattctaaatatgacctgaattccggatgttttattttcccaaaatgataaactcatgaagttcctcatttgataaaaattcctaccagagccaaaaatatccatcttgattaaaccatatatatttttcggttgcttgtaattccattgaactttgtcaaatctttgtgacttgggtagatacttttcatgctctatgatcaagatcatacacccatatgcacatgctaaacatctacattggaagccagcatccatccattccatctttatatccaccatattattatcaaaataaattctccatgcttttatgtgctttcttctcctagaaaagaaaattctttctaaaaaaagaggtaggagggaaaggtatggttacgaaaaaataataataataaatttatgctctctcaactattgagcatgatgaaaaggaaaaaaaaatgtgtgtagccatgccctctccatatttatgaaagaaggattttggagaagagagtaagcataaaggagaagcattttctttattttccacattccattcccattataccacacacactttgcacgatcttgatcttgagtatgtctagtcatctattttagtccaagtttttgatttagtaataaatgtgaatacaagtattccatgtttgatccctaccaagctccacatatcaaccttagaataggaataaaaaaggcaaatttggtgaggaattcatattcatacactttgagagatcaagtgaatcatttgaggaacttggatttcttttgcaaaattcatttgaaaaccttccgggataaaagttgaataaagattgggtgactagtactctgatgattgttctatctttcaaccgcttaagacaaggaaatgcagtgtctcgtgggaattaggtgtaagggtaagccaccgtgccaaacttatttaatttgagagagagtagatatacattgcacctgtacatttgagatatacaacatagtagcaactcctgatcaacaactaagtttagatttttgtgaagttcttcactcggggcgagcaaaggttcaagcttgggggttttaattgatggtcgttatcgatcagttgcgtccgtcaatattcccaaaataaaggagaactagttatgcttgcaatgcaaatttatgttagaataagttctattccactagcactagaattctaacctcttgcagagaataaatataaaatggaggagaatcggtagcaaaacagacaatcaaataatcggacgctatcaagaatcagacttgcggacaagtgggctgagaacatcaaattgacacaaccaaaacagtccaaaattcacaagtctttggaaaggagcaaaagaggaggccacctgccgaaattgggctaggtcggcccagcacatgttttggctgaacccgtcgtggctccattggatgcagggttttgatggacggctgagattggctccctatgacggttggagggtattaccgacctttccaaccatcggaaccggcatactcaagctataaaaggccctcactccctccatttcaacacacacctcaagcaagaagaatcaagctctctctcaagtttagtagtgttctagagctagtggggtaggaatagaataggagtcttagtctgagaagtcttcggaaggattcgggtatggctctagtagctcttctctcttttgtaggacttgtacttttattagaatattcttctttatactactctggtattctatcacttcccgagtatatgaataccaactttattatatatccaaattatattgattatgatgctaacttatgtgggagatgcaatggggtgggcataatgatcttgtatacgattgctctatgtcatgacgatgatattagagtagtatttggtaatttaagcgtgttgtttagattactagatatcgttatttggggttatatgctgcgggtatgtcgaggtggggcgctgatggtgacagctcagtacaggtattcctctccgtgcgtgtatataatcctaagtgactttcctgaggagggtactcatccgtatttagccccggttggatggtcatgatgggttgtcgtaaggaactcggcaatcaggggtggcttatcaaagcaccaggagggcattggaaatgtggtattgactaaataatcatataactaggatatatatataatgtgtatgtatattacaagggtaggaatagattctttttactttctttccacttagcttagatgatttattatgagagtatataattctcgtgctgtatgtcactctaccctattcattatcttaacccctgcttagactttgattattacaagtaatatataagttattagtatagttttctctattataatctttccacagtattaaataaatacgatacccttagaatactctcgggtgaaatgctaaaatggtatatccgtgcgcttgcggatgaaatgtgtaaccataatatagcacaagtgtttctgggtcattgttgggaattatatttctagtaatgtcatgaagaaataccaacactagcttaattaccctcaacgcacatgtcccttctaataaaatttccagctttactcgatctgaaccgtgcatcatgtcacaaataattgatatttgttgaagattaatttgcaaaatttgtgaattaagcaagattttttttttcaaatcttgcacctcatcgctgctagttctcaagcaggcatcgccgattactgttgctcaacaccttgcaggagcagctcgccaacagtgagtgctacggtccggtggcgagtgctagggtaaaacatggcggacatcctcaccggggagcccactattcgatgacttgtcagaggaggtgatgctcaaggagatggccaacatgcgcgagaccggttcgagtccacgaggacaaagctattagaccttagacgagctgccggagctgtcggcggacaggctgggacccgcttgaaagtcgatcgatgtggccgggtccagctcagatgatgacatggaatacgtggggcacactaggaaaaaaaaccaaatatgtcacacaagtcatcaactgttcgagtaggaagttaggaacaggactaccctgttacccttgacttgcttataccaaccgggcctcaccgtcttgccgtcgtgctcaccccgcaacctctctgtcagccgtcaccaccatccctagcgactgatggaagcttagggatggtaatttccccgttgggggcagggacccgcccctttggggacggggacggggctgcttttcgacccgtgggttgggcggggacggggccccacatatatgcggggccggggccgggtgaagggttccacccacgggtccccatggagccccggaattaagaaagatagaaatataatagagggccattaccttaaatcccagcaaaagaatggatatagatgatcatttgacaaaggcccaacataaaagcccatcaagtccacataggggatgatataaaagcaaaaaaaaccctagctttcccgatcctactgagccgccagtccgccacccacacatgactgagtcgcggtgcatccccaaccatgtcgtcaacggcttaacgtgcggaggttacttctcgcgactgcggcgccggatgccttctcctcctcacgccgtcggcttcctgctcctcctcgcgccggtggccacctgctcctcctcacgctgccggcctatccctcctactcctcacgccactggccgcttgctcctcctcgtgccgccagccactcattcctcttcgtgccgccggccacctcgctcctcctgttcctctcccacctgcgtcttcttcacttgcaatggcagagtgacctcctgcggagccccggccgggttccggggacctagagggtgcggggacgggtagcattttgtacccgacttcctcttcggggccggggccgggggatggaatcggcattgggggtgggggcgttcttgcccgacccggccccaacccaccccgttgccatccctactcaagctacatgccaccgtcacctcattggactgccgtggctcagacccctcgttgccaactggatctggcttctctgcctttaatgagctttgtgctacagtggaaaactgtcacgcccagaaattcacaagtaatttccgaactaatttgtgcattaaatcctcgtccaggaatcagccgaggtacacaaactgacaatttaatatacagattcatcaaaataactaaaacgataaatacttacataagagacacttagtcctcaccacgaagaaaactgcagcggaaaacaaaatctagcgaaacttcagctccactcccacgggcagctcaactgggatctaagccaaaggtcttcttcttatggatcctttttcttcaactgaggtttgatgattattgcaaggtgagcatatgacatactccgcaagccacacaacaattatgcaaatgcacaaggataccaaaggatggcataatatagggttcatttgcgaaagcagcatttagcaaagatttaagagtagtaaaacagtagagtaattaatcatcaatattaatcaacactgaacagcacacccatgctgcacaggcccaaccaaacctgaacaaccaaccccggtcgtacagaacaaacctccaaaccaggaattatccattccaaaccaggagtcaaattaattatcacattattatcattaacgagtagtatgggactaatcacgaaaaacattgttagacccgcccataaccgcgggcacggctattcgaatagttttactctggccagagatgtaccactatacccacaagacacagcctcaacatcatgtccaccatgcgtcgcgatactggaaagtacccgaatagaggatgtgacaataccccctgcacaacacaacccaccacagtgaaccgttcctggatcataatcaccccctcaataaccagaggcatggactccccagcgacccccacggacttctcgccgattctcagtctggcaccccgtaatgaaccatgctatacaaaaggtaaagccgttgcccacgctggcttgtggttggcacggttaatgtttcacaacagtagctcgcgaaccggtccttaattgtcatgagcacgaccatcaaaaccatgtgctcacaacccaccattaatcaagttttaattatcaattatcataacacgattgaccatcgtgagctaccattaaatataaccataattggtagtgtagtatgaatcaccccattaatgagctaatatttctaagcatgactaagcatctataataatcatatagctgaaccaaaccaatatataaggttctagctaatcaaattataacccataggaaaataaagttatcttcggccataattaaatgggaaaggctcaccacccggtgacattcgaaaataatgtataagttcaaataaaacattagctttaaacgggttcaacatgctcaaagggttgtttgggatctgtgtgacttgccttgcaaacaagcgtcttcaattcatctttaggaactcctccaacgatcaaacgctccttcgaaacgaccaaaaactaaacctagaacgcaaaacgagaaaatacactaaaaaaaccaaataaacagtacaattaaagttcataaatgggtaaagcttgaatttatatgaattatgaggcttgaacgacctcattccgagttcttatgaattagttatgaattaatgaagttttaatcaattaaaacctataaaagaaaacaacctaaataatttatggcatcatatttaattattgttgcactgaaaagggtagaagatgacatcagccctaggattagagaaaaagagctggtgatactgataaacggaacccacctgtcatagagacaggaggtagctcgatccaccatagactcagttcacagagaggtccataagatggatgactaggattagattgactagagttgaccatgatcagagatcaaatccgatctagggtttaggatagtggccacatgacaacacgtggcgctgacgtggacgccacaaggacagccacgtcgacacggtgccggcgagcactggatggttacgacgatggcaaacggcggcacgacggcggacactgaggacaccaacgcgaagagaagatcagcacggtccttaccggcacttacatggcgacgggcgatgaaaacagcggccggtgatgagcttcgaagggcgacgagatcgggatgacggtggcggcaactttacggcgaataccggcggagaaagggtggacggccttccgcttggcgctgcaatgcccacggaggaaacttcgaggttcggcgaccatgggggaagcggcaaagcttcgccggagatcaaaacatggcgatggttcggccttcacggtgatggcgaattccggcagggtttggcgcaatggagcgggtggccggggtagctctcacccttgcgaagccgagggaggtgacggggctgaccggcgacggccgaggcgacggcgcacggcggctggagaggcgaccggaggtggaaagagagggagctcgcggggaggcggctagggttagggaaaaattcgggaaaaaaaagggaaacggaagaggagacctggggcatgctatttatagccaaaggaggaggagatcgactcagttacgggaggaatcggcgacggattagttagggttcaccggaaaaacggagctcgaaaccacgtcgaattcacgcgatatacaacgggattcaaaggggtttcttagggataaggtagaggagttcgaggggaatccgtttttacaaccaattttggaaggggagcaacggagtggccgaatttggtggggaggcggcgctgtacacgggcacggcagggaggagatcaaccggctggaggttaggggcgacactgtagcatagggaggcaaaacagacttcttttcgggcttccttttctttactaggcctaattgcaagaaggaccaaaactggacttcagctaagagaaagaggaagagtgggctgctgcaggctaaggaagagagagaagaggagtgggctgagttcggcccgggcaaagaagaggaattaaattactttttaatttaaataaatactgaaatgatatctcatttattaaaaatacttccagtgctcaaataaatccaagaaaaatcctgaaaatacttgggcagaccaagtatttaatgaaattttatctagctcaagttaatgttcaaatttttcatagattttattcacacacttactttaatcatcaaataaattttaaaaatttctttctcacaacaatttataatttagcgattttcagggtgtgacaaaaacaatgattctaagtgtatttctgtagtaacggtgcaagacagtgaacatacatactgtacatagttagggtagcgatcgatttcattcgtccgctgtgaatcggacggctaaaaatactcccaaaatcacatcactgtagctctctaacttcacacatgtaaagtcagatgatccaaatccttgccaacctcaaggcaaggcaccagcattgctcctcgctgtctgttcccaggcacccatcgtctttgcttcccgccattgttctacatactaagcatcgttaaaaactgatattatgtggtgaagtgagcttaactcaactggttaggttccttgtggtggaatctgtctaccgggttcaaatcaaaaactagacacgggtactcgtatttatagctaattattgttttattggtagatgacaggtgacgtaccctacgatagtgagacgtctcacattatgtgactgcatactctttgtacaagctactgcacgaattcttcgaccttaccttccatgggccaaccccacctccctcacccttcctaagacccaaaacccacctcccacctcggttaaagggcggttaaagcgtcctcccgatggtccgaccccggtctaacccgcctactcactttcccccctcatccacctctttgttgtttttgtctagcaggggtctagcaggaattgcgcagtaacaaaacgatcatcgtgtagtaacaggataattgtctcgcaataaaactcaaaatttggatggaggggcagcaacagaaggctaaaagctggggaaaaaaacatcaagatgtctagagctcatgttttctgttctagttattgtaacacctgttctgaaatgttatgttgtctcttctttctttgtagcttaggtgtcaaattggtattgtttattttgaggatgctaataggacttaagttagatggtcttcctgtaggcttagatggtgggatggtgctattggtagcctcacagatatatatctggatgcataaaactctattttgtactcctaagtacattgctgttaatggatatgggaggaagtctgcctctcttttatcaaaactggctcaatcagtgacataacgacatgcctgtacatatatacttatactgatttcagcagtttcacaactcaactaaaccgtgaccttgaactgtaacctgcagaggactgatcattgtactaatatctatttcaagtagctaataatgtggtactccttccgtctcaaaatataagaacctatgaccggataggatgttttctaatactacgaatctggacaaatagaaaatattcaatccggtcttaggctcttatattttggaacggagacagagagagtagtttatttgtacagtaaattcgtttgtccaacagtgcttctgcccaagctgattgttggttgccagaactattaactattggttgataggaatatacggagctaggcagcttgcttggggctcaatgggacggaagcccatgttgctgcacatacctgtgctttatctcctttaaatgctgtaactcaatttcatgttccattttcaagtaaagtgccaaataaagtgcagtgaattggtaatttaaatcatgtgtgcccctaatgtcaataattcatatgtgctctgtgactacataaatttatcaataagttctgacatgtttggcaaggcatggttttcctgtttgaaccgaggcataattcatcaacagttgcaaccatctagtaataatctgttttgagtttgctactgtacttatagcactagatacataataaaaaagtgaaaattgaccagaagaccaaaaagtaaagcaatgcttgtttcttcaaatgcaaaatctacttcgagaggcctctcgatttagcattaacgagcgaagccagctatacgtgagagtgagagaaatagtactattagtactacacatctacaaacatgcatatctttttttctattcttatataattttctcttaaattacttatccgatctataatccgattgcaccatttgttcgttgtaattaaatctttataccaagattttatattattatattataataaaaatattcattttttaaattacttttatctctctctctctctcacacacagatatatatatatatatatatatatatatatatatatatatatatatatatatatatatagcttttagatttgattaaattacttcttatacattcataatgctctgagtttattacttttattatttctagttaattccataatttattctgattaaatttaatttctagatagactcatatgttaatccctacacggattacttctaatgtcataacaatttacttctattttgtgttaagttacttttatggtttatgtaaaaattactttcaggctttattgaatttacattcataaatgtatttacttgaaaatcttctctacactttgcttgtgaatttactccagataatttcttatttcaactcagtcataatgtaattacttctaatgttatagagagttacttctattgcattgctaagttacttctacaattaaaataaattatttttaaattaataaaaatgtttgaatatatttaacatggatcttgttttgtcacatattttgagtggcaaacaaatattaaaataatatgtgatttaaaagatataagttattaaagaggttacaaaagacatgcctcattgtatattattttagttaaatagggagtcatacctgggatgaaccagcgaccagtcgctttgtagtcgtgtccttcttaaaaaccagtcacaactcataaagagcagtaataaggcaatgtttagttcccacgcaaaaactttttaccctgttatatcgaatgtttggacacatgcatagagtattaaatatagataaaaaaactaattacacagattgtgtgttttaagcctaattgcttcatgatttgataatatggtgctacagtaaatatttgctaacgacggattaattaggcttaataaattcgtctcgcagtttacatgcagaatctgtaatttgttttattattaatctacgtttaatatatcagtatatccgatatgatacgccaaacttttcacccctgaaaataaacatggcctaagtaaagatgacatgcaataaatcctctggaatctttctgttgacggcagtttttcctcccccctcctgctggtcctgggttgtactaatataatattacttactcctctcctgcaatgactacatttttggatgttgtgtcctatgtttaaccatccatcttatttgaaaaatttataattttttttcaaaaaatttagtcacacataaagtattattcatgttctatcatctaataattagaaaaatattaatcataaaaatttttaataagaggaagagtcaaacgttgtattaaatattaaaaaatgaagcctttgtgggacggagagagtaatcatcaataaagtcctgttttccttttaaaaaaatcatagaacatcctccctccatccctacgtatgtgggatgtaccctggggaaaaatatttacaaatacacttttttttaataatttacgtttatatacatcaataacaaagttttgtaaaaatatacccattctgtggatccaaaatacggaaccgacacggtcccgcagcccgaaaatgcaggacctgaacagtcccgcggtcccaaaanntgcaatcggggtaccattgatttttcacactgcaaaacactgttccgatactgtgcacaattgttccaacactgtgttgcactattcacacagcgtgcccgcgcctccattgtgcggaaccgacgctgtaacagtgtcgaacaaccccgggaacagtactgcacagtcagaacagtgcggaacaatgtcgaaatagctgggcaacgcggttgcgcgttttgggaccgcggactggctcggtcccacgactgcaccatgggaccgtttgaatttgtggtaccgtcgtaggacgggtatatttttataaaactttttcatagatgaatataaacgtaaattattgaaaaaataaatatatttgtaatttttttttcgtacctatgtctctctttgcactcacaagtcacgacagtttcaagtaaattacctacaatacattcccaacaaactcattttccacagtttgggtactagatacttaataaaataacagaagtccttttctatatcaaacatattccacagtaaaatgcatgtagtattcattttgcagtttactagcccacaaaaaggcttattgaaataacaaaaaataaaaattattgaggagactgggctgtaagtcacacggtgggtcaagtcgtgtcgtgccgtattgtctaagccacaaccgcaaacactgtaaagcatccggagactggggtgcgtcaacaaagtcgttcaagattctttacagacaaaattaaaggcgtttgatgtgaagagcttgggctgagtttagttccaaactttttctttaaactttcaactttttcatcacatcaaaatttttttatacactcaaacattcaatttttccatcacatcatttcaatttcaaccaaacttttaattttggcgtgaactaaacacacccttggttgattcgttactccgttgagcaaactgttaatgaaacagaaagcagaacaaggcatccaaactaaggccattcacattgcaaatccctcttttgtgtcgacttaaggtgagagagtgtaccacattggatggagttcctataaagcaactcgtttcacaatgcatgctattttaatgggtcccacgagcttttcacctcccctctctctcctctcttcctttccccatcgcggaggaagcctcgtcgccgtcagccaagtccacgtcggcttcgctctccctgccctctacaccggtgccgctctgctcccttccaccgccggcgtccttctccctgccctctgcatggacgacagcgccatcgaactcactaggtccggcctagggctcacctgatctggtctcggcagcagtagcagcacggcggcggcggcatcggtagcttgatggataggatggcgtgtggatggcgcacccgctccactttgtcctctcgtttccctcctcaccacagcggtggtgcaaattgaggctacaccccaaatcccctgcctcactcccacaccagcgacaagctccaccgacgtctctcccctctcccctctcatgtggcaacgagcttggcgccaccttgatgcagacgggggccttgattgtcggatctggtcaggcaaatcggcgagtcgatgagctcctcagcagtggggcgaagagaagggttgctaccgccatcgagcacctctacgctggtccatggcaggagctcctctctctctctcctttttttacgcttcctctcttttgttttctgtcacctataacaacgccacccgttctctccgagggagcgaggagcatgctgttgagctgtgatccaaattcatttgcacttaataaaatacagcttctgccttagcgaagcggaggcccgtcgccggaggcttgggccggagcccccacggtacggatcgtcattccttttaggtttccaccatatatatacctcttgtaagccgccgtgtggcgttgtatcctcacccccgatatagtgaagatattttgctggttgacgctcgtggtttttctctcctactttgggagggtttttcacgttaaatctcgtgtcttctgtaattgatctgttgttttttatcgtaggaacttgacatgtaggtggtaggctggggctgaatatcacctaagacatgtttggttgtagttgtagattttagaaaataaactagaagccagaagatgaaaaatccagtttctctatatttttagaagctggctaccatccagctacttctcataatcttaaacttcgtaaactgggattttcagaagcactgtgaatagcctaaaaagtcgccacgatttggatgggacgtccaggcatccggaagcatggcgtacaagatggggtacctttaaatcggagactgactgagtgaaggttggttggttcacacttcacacacatctttttcgaccaactgaagtactactagttaataatctgcctttttaagggagaccggcacgcaggcccggcaatacctacgtactgccatggatggcacatctgccaaggttgtgctcttcatcggcgccagctttagcttcttcctcatcacgcatgctcagcaacaagctactcgttgcagaccacaagagagagacgccctcctgtccttcaagcaaggcatcaccaacgacagtgtgggcctcctctcctcatggcggagaggccatggcgattgctgctcatgggcaggcatcacctgtagcagcaagactggccatgtcgtcaagctcgatgtcaacagcttccttactgatgattcacctatggttggccagataagtccatctttgctgtctctcaactacttgcagtacctcgacctcagctcaaacttgctggcagggcctaacggcagtgtcccagagttcctaggttcaatgaacagcttgatacatcttgacctctcctacatccccttctccggtacactgccacccctgcttagcaaccttaccaacttggaatatctcgacctctccttcacatcattttctggtacacttcctcctcagctgggcaacctttcaaatttacggtatcttgatgttagtgagatgcagaatgtagtgtattcgactgacctctcatggttaagtcgtctgcatttgttagagtatattgacatgagcaatactattctcagcaaaataacgaatttgcctgccgtgctcaacaagatcccaactctaaagcatgtcctccttttgaattgttcaattccaagtgcaaaccaatccatcacacacctaaaccttacccagcttgaggagcttgatctctctctcaactac

SEQ ID NO: 77928 - DNA, 17452 bp, Oryza sativa
  unsure (1)..(17452): unsure at all n locations
aatcttgaaaacctaattatatcctccaattacataactggccaagttcctggatctatttgtgagtcagaaaacatgaaacacttggatttgtcaaacaatttatttaagggagaagtacctcactgtcgtcgtatgcgaaacttacgtttcctgctcttaagtaacaacagcttctctggaaagtttccccaatggatccaaagcttctcttcactggttttcctagatctttcatggaacatgttctatggttcgttaccaaggtggattggagacttggtgaccttgcgtattctgcacctgggtcataacatgttcaatggagatattccagtcaacatcacacatcttacacaacttcaatacctgaatttagcagacaataatatatcaggtttaattcctctatctttgtcacattttaatgaaatgactctaaaagctgtgggtgattcaatctcgaccctggcatttgatgagtcatttgatacattttccctcggaatgaagcatcaaatactcaagtatggatcacatggggtcgttgatatggttggaatcgacttatcgctcaatcgcataaccggtggaattccagaggaaataacatctctcgatagattgtctaatttaaatttatcatggaatcgcttgagtgggaaaattccggagaacattgggtctatgaaatcaatagaatcactcgacctctcaaggaactacctttgtggtgaagtcccatcaagcttgacagatcttacatatttaagctacctggacctatcgtacaacaatcttactggaaaagttccatccggacgccaacttgacaccttgtacttagagaatccatccatgtacaatggaaacattggtctttgtggccctcctcttcaaaggaattgttcaagcaatggttatgcacaagggcatggtgatcacaaaggacaagagaaggattccaattcaatgttcttttactatggtcttgcatcaggttttgttgttggttattgggttgtgttttgtgctctgctattccacaagtcatggagagtcacttatttctgccttgtggacaaggtatatgacaagttatatgtgtatgtggtcattacttggaccagatggatgaacactacaaattaattaagcacagtaaggaaatgtgttactagcattaagcaggttctacttccgtttatagtcattttctgtttttggtggctttgtaataatggatgaatttacacttgtgggacattttgaatcccatacgtgattcaatttccattagattttttttagttgtgactagaatttctatgtgttataatgatcctgctaacagtggattcgcaataaggccttgtcatttgtttagatcaagcattttgtcctcctccctccaaaaattattatatatatttttgactaataaaaggaggctccacattcgctcttaatgcgtagaaattctcactttcctcaaattaacttgaatgaccgatcaaggtgactagatttagggtgaataggcgcctcgacaattttcttacgaaattgatgaccatttcctgtttttcatccgacgcacctctcttctgacacaccatgatcacgtagtcactgaggacctactagtgatcataggagtatgtcggaaaaacccagaaaaatgtggaagccaaaacaaggaaaaagaaatcggagcagaaacggtgatggcgccatggattaacttcaacgttctccccctaattcttgtcgccatcgcccttgagctcaacgatgccgatcccattgcataactcctggaatggaacacggccgagcggcttcatcagtacggccgccagctgctcctctatacgaatgtagttgatgacgatcttcccgttctccacgcactcccggatgaaatggtatctcgtgtcgatatgcttgctccggtcatggaaaacgggattcttggtgattgctatggcagacttattgtccaccatgatctccggtgctccaggctccgagtcaagcaggtcgctcaggagccgagctaactagatggcttggcaggcagcagctgtcgcagcgatgtactccgcttcgcacgatgatagtgtgaccaccttctgtttcgctgattgccaagagacaggactggagtcgtggaaggagaacgccgctcgtgctccggcgcgtgtccagatcgccggccatgtcgctgtcgctgaagccatgcagctccagccatcctcctttccccctggcgtaatgaacaccatggtgtcgcgttctgccgatgtacctcagcacatgcttcaccgccgcttgatgatcctcatgtggttcctccatgaaccgactcaggtagccgacggcgtgagcaatgtcggggcgcgtgttcaccagataacgcagcccaccgatgatgctgcgatagcttgtcgcgctcaccggtggacttgagcttgccttactcagcttcaggtgtatctccatcggcgtggcgcatgagttgcagtctcccatgccactcttgtagagcagcttgtcggcatacgccgactgatagagcgagatccccgtctacccctgcttcacctcgagcccaagatagtaggacaagagcctgaggtcactcatcttgaagatgttgcacatctccttcttgaattcaccgatgtttgcttgattcgcgccggtgatgatcaagtcatccacatagacgccgacgatcagcttcgcatcgccctggctgtgtgtgtacatggcgtgctaggtggcgctcttccagaaaccaagcgacagtaggctgtcgtcgagcttggcattccaggccatgggtgcttgccggagtccgtacaaggccttgtgaagccggtaaaccttgtgctcttgtccctcaacggaaaaacccggtggctgttgcacgtacacctcctcggcaagctctccgtttaggaaagcacttttgacgtccatgtgatggacgccccagccggcgtgcgccgcgacggcgagcaggagccgcacggactccatgcgtgccaccggcgcaaacacctcttcgaagtcaatgccggcttgctggatgtagcccttagcgatgaggcgcgccttgtacttgacgatgacaccgcgctcgtcctgcttgactttgtacacccacttcagtctgatcgggcggtgcgacggcggcgggtcgacgagaacccatgttttgttgtgggtgatggactccatttcctccatcatcgcgtgccgccagctcttgtgttgctcggcctccttgaatgaggccgtctcctctgccgtcacgaagaacagttcaccggcagcagctcgcggtgtgagaggcccggcacaactgtatcttcgagaatgttggcaatggtgcggtaccaaagtgggatgttgtcgtcgtgattggcgtccagggcatcagtgagattgctcggtggcgacacgaactcgggtgacgtcccacccgtttcgtccaccggcgttgccggcgatggtggcatgggcacgtcccctgaggccaccgacggtgcccctgagctcggagtcgacccgccggcttgttcctgttccgggcgttgatatctatcggcgccacagtgtattcaatggtgatgtcggtgacaccgcccttgtcgtcgccgccgccgtgagcagcccagtcccagctggctgcctcgtcgaacacggcatcacgcgtgacatgcacacagttagatcacgggttgaacacccggtatgccttggacccagcctcatagcacaggaaaatcatcagcgagctttggtcgtcgaatttcttcagattgggctttgtgttcttcacttgcgccacacagccgaatgtgcgcaggaagtggacggccggcttgatgccatgccaagcctcatatggcgtcttgccggacaaagttcgcatgggagcatggttgaggaggaacaacgccgtcgaaaccgcctccccctagaagcgagcagggagcccctttgctttcatcatggagcacgccatggcgaccacggtttgattccgccgctcgactacttcgttctgttgtggggagtagggcggggtgagttgtcgctggatgctgcggtctgcgcagtaggcaccgaactcgatggaggtgaactcaccaccacgatcagtcctgagcaccttgagcttgcacccggactccagctcggccgccgcttggaagcgcttgatcgccgccggtgcttgatccttgcttgctagcagagtaagccatatgtagcggctcacatcatcgactagtagcaagaagtagtggttcccacccagcatcgccggcaagatcggcccacagaggtagccgtgcacgaggtcgagcaggtgttcagcgaaatgcttcgcatgtgccgggaacggagcacaacgttgtttcccggccaggtagctatcgcacacttggtcgacgtggtcgattagcggcagacctcgcaccatgtcaccctgcaccatttcctcagcgattgaaagctaaggtgaccgtacctcgcgtgccaccgccatgactcgtcggagctgcgggtggtgaggcagaccgggcacgccgcgttgatccggatggagtaaagccggttcctcgatcgcggaaccctcgccaggaaccgccgatcttgccgttgcgcaccagggactcgcagccattctcgtcgagctgcccgaggcttatgaggttgacggtgaggcggggaatgtagtagacgccggtcagcccgcggtgctcgccattcttgcaggcgaagaggatcgtgccgtagccctcgatcgtgacgacggatccagtcaccgccgtgttgagctcggagaagacggagcgggcaccggtcatgtggttcgtcacgccggtgtcgaggtaccacaaatccgcgggatcggggtcgccatcaagatgcgcgagcacctttttacctccaggaacacgggcgcggacaccggcgtgatcttcgacgtgggttcggctggcgggcatcgccgctggaccaagcacgcacgcgccatcagcagcgtgggctcgtcgtcgtccttcgtggcgatgtgagcctcggccttcttggccttggagcggcagtccttggcccagtggcccatcttgctgcagttatggcacttgtcgccagggtgctcctggccacgcccacgtctgcgccgattcccgcgtttcttgccgctgttgttcgcggccgcgccgggcgtggtgccactgctctcaccgccctgctcgcggttcttgagccgtgccagccactgctcctcagtgagcatgagacggccgccactgtcaacgacctccttcggcttggccttgcatttctcgacggagcggagccggacggtgacctccttaattgacaggtcgcggatgtcgaggagcgtttcgatcgagattgctatctgcgagagatgctcagggacaacgttagcagcttgttgacaacatctatctcggggagatcgcctccaagagtgcgaatgctgtttgcgatgccgaagatgcgcatggagaagtcgtcgatgttctcgccatccttgaaccgcgcatcggcaaactcccggcgaagtagctgctcattcgcctctcgcacgcgccgagtgccgacgcatacggtcttgatcgcttcccatgcggatttcaccgtgcgcttggtggagagggagcgaagcatctccggtggcaccacacgcaagatcgcggccagcaccagccgatcgtcgcggtactcgatctcctcgtcttcatacggctccacggcgtgccaaagtccctgtgcttgctggttgacggtcatgaagagcgcacattcctcgtagttggtcctcgttaggaccgggtagtggacggcggcgctcgactccctgacgacgcgtggctgggcagcgaagggctgtcgctcgccacgcccgcgcccacggcacggcggggactcagcaggattgtggcatggcggtgtttgtgacgggcgaacgaggggagagcgtgagcgcggcggtgttggcggcggcgagcaggatggccgcggtggggtatgctccgacatggcaccagcgagccaacgaggctctgatagcaactgttggcgaaccccgaaggtgttcgaccaaattcacgatcaagaacagagtatgcaaaagagaaatttttgtgctgctgaaaacttggcagcgttttttaatgcattaggaactttaaataggcaaaatacatgtctacgacctatcggatcgtgccaacccatgaccgtgattttcgccatacctcctcctacaactccggcacttcgccatgtctcctgagcttgaccgcgccatcccacgatcgaagaacagacgaagcgcacacactccctaacaaccaaagcgaaaaactagctcccacatgaacgtgcatgcatcagagctgatacatgcgccatgatctccacaaaacagagtcacgtgcttggagtagaaataggagcagaaatggtgatggcgccatggattaacttcaacattgctcctccattacaggcatattattcatcctcatgttctgacactcaaggtgctggttgttccttttcagcaagtgttgtagactcacattggatattagactcaagagcttcttttcatatgagacatgatgtttcacagcttcagccatgctctgcttctagtaaagcctcaagtgtccagacggctaatggtactgatttactctgtttgtggcactcttcggacagagatcgcaaaaactaatcggcgaggcctcttgatattgtcttatcgcgcgatggatcggagcggtggagaagcttactacacatccatgccttttttttgctgttagacatgcatgtctttttccccttcttataaagttttctgtcaaattacttatccaatctactattcgattacatcattgtattcgttgcaattaaatcttcagaaaagatcttacatgattatattacgatgaaaaatatttatatttgtaaattgcttttattatatacgtaagttacttttatcatatatataaaaattacttttagatttgactaagttacttcttatacattcataatgctctaagttgttatttttattattgtttttagtcaattctataatttatggactttaaatttaatttttaggcagaccatatttttctccttacaacgaatttacttctaatgttgtaacaacttacttccattttgtgctaagttacttttatgattgatataaattacttgtatacttttgtcgacaggtgatacccgtagaccggataaatagggtattggggtacgttggtatgaggatctgcacaatacgacatcaagcaaacacagagatagggattatactggtttaggccccttagaaggtaatagccctacgtccagtttatatgatattgatatagaaaatcacagattacaaagagaacaactgaactcggcaataccggtgagatcgtagtcgatagtttcgactagatgacctggcgagatgacttcgcatgcttcggcttcgtaggctatggtggatttgctggtagaaagattcgatgcccgtaacccctcaggaggttctccttttataccacagatcaccttgacctncaagtaagactcgaagatgttggaccccgtacagtatagagaacaggaacctctncgagtaggactctgttgtctcccaactgatcaagataattttcataatagccgtaatcttccttaccgcatactgaaatattccatatacatgaaggtataccatacttgcatattgtgtagatcgtaggataggccttatccgtaaccctgatagtagcccccgacttcaaattaaatgagctttgttgtttacttccaacttcacttgtcgtccgcgactacccagatgcgacgttatcgtactcacttgatcgttctcagtgcaaactgaggagacatggagttttcgacaacgccacatgaagttcaacggtccacaagtgaatttaactagaagtctaaacagctgccagcaacggtccttagaaatttccggcggcaatctctctcctttcattcaaatacgaaccgcctgttagtgggcttatataaagagattttgggatttatttggagtctgcacgcctagaaactttccagcttccagcgcattctctctctcggttcatccgcctcccaaaaaccctagctttcttcctccttctccggcgaacttccggtgaccatggatcttggcaagacaatcaccgacaccgccgcaatgaaggagctgcaggtggagggattacttctcggccgtgaagttctggagcgagatgaaggaagtactgaacctaatcctccccttggtcgcatggtcatagtagaggacttcgttcgttgcggatttctaccaccgctctccaaatttctgttgttggttctgaatttttacggtctttctcttcttcacctcaatcccaactccatcacttttctgagcatcttttctcatctctgtgaggcctacattggggtagtgcctttccttgatcttttccggtatttctatgaactccggtggatggaataggggaggatatccggttgttgcggattctgcctccgcgatcatatgcgggcaagatacatccctttccaatgtcatttatcccggagcaaatggagacagaggtggttctttctcgaaatcaagaaccccaatcccgttcttgttgtgcctgaagaccaaccagaacggtcttcggattggacctccaaaccgccattgaccctttcccttgagacatttgtcgggatcagcgatgatctgcgagaacggggactaactgggtatgacgtcgctcaagacttcgtaagtcgtcgcatccagccgctccaagcccgtgcacatccggcgttcgactacacgggggcgaaagatgtgacacggatctcattgcggggtactcgttctcgcgtcgtcgtagtccttctcgtcgtcaccctgtccttttgagcttaacttgaatcgctttcctcttacaggtctgaacaacaacatggtggctcatcaagtaggccaagtactggtgagctcgccatctacagctgccgagatccccatcctagtctgcaacctcgaggacgcagacaaagccgtcgctatcaatgtgagtatccttggtgtattttattcccttgtcaaaaaacgaagtaactttaacacttgtaggccttgcccctgacggacgccattggtccactcgtcgatcaccaggcctcagcctcgttgaagtccaatgtctccgaggagaccactgccgccatcgccctcgccgagaacagcggcaccgcaaagaagaggaaatgggccgtcacttcttgcggaggcaagactcgtcgtcaggcgagcggctccgacgtaagtgtatctccatcagtcctccacatttttattataagaaagtcctgatctttatcttacgcagggtggaagcgatctcccaccaactccaaagaagcggctgctgaagggaggtgtttcccggtaaggaaaaaacttgaactcgtagattattcgatctcgttatctctgtactctgttctcatccactgtgagtacgcttgttaccagcaaggcttctccaccgtcctcggcgcaaagcggggaccaggtggccaccagcgacgtgccaacagtggtcgcgactcggacctcttcagccgccgcagtttccccgaggatcggcaccatcgctccaccgctgcctccgtcgacccccgcggccccatcatcctggtctgaggtactggccgaagaccggcgccttatcgaaccaggggaacaaatggtggccggcgtggtcgggcgtgctaacgctcgtgcgactgaggcggagaaatgagcagcgggcctcgagcaggagaacaaagaactacgcgaggatttgaaaaagatgagggaactcgttgctgggaacgagaggcaattccgaggcctgcggcagaagtcgtctgagctggaggaccacctgacgacaatcagggaatcccttcgcaaggacttcacccgattacaccaggttgctggtgaactcggaatctactcctcgattccgcagcaccccgacgaaacctccttgacgttcggtctacaagacctcgtcaaggcgatggaggcagcgcctgcaaaacacgccgcgaaggtcgctgaggagacttgtaccagagttcgcacgggcgcctgccatgtcctcgcctgcgtgaagatcgctcatcctgaggtcgacctggagcaggccatggcgaagggaggagctgatgacacacgcgaggacgtgatgtcggaggtggcggatttaggggagttaatcctctctttttacgaagagtaaaaacccgcgtcttctatgttttgaactctttttgttttgtaaacacttgtcgggcttgcattgtctttaaacaattatcccttccggctttagtaatttgtagtatttgttatgacttgtagatgtcttgatgttgaggacgtccagcagagtggacgtcctgattcacccgagttcgctccggttgcatctccgcaagcatccagtccggatgtaaacgagaacgccatgatagctgtgaacgcagctgaagtcgtcacttcgcctggcccaagtccgaccacgcttcttcgggagaacttaggttagatattcttggatcactttgtctgcaattcttgcgaagatggatcccttagaattttttcctttttgcagccctcgaagaaacgcttgctgaatgagaacgcctaatccaagtctggaagacgaaatttgaagtggcggagctcgaacgcaggattgagattacccggaaaacttaggatgtcgagactctttgaggacgtgaggtttggttgaactcgtatctcaagagctgctgcgacgtcttggcaagggtttgcgaggacttgcgagttgagcgcccagcgcctaaggaatcgacggcaggatatgtgccttggataaagggagtgtgtccccaactagatggcatcggtgcccgtagcgacaacgcctaaaagaggagtgtcgtcgagcaagtcgctatgccgggggtcactttctcacatgtatccgagatcaccgtccacatatgaacctggggttccttgaggcgggctttaggaactcgcggttgtagaccgagcagatcaatcaacttgcacaatcatttgctcctctagcggaacgggtctttttatccatggactggcgatggccgtcgtggtagatgtaatatctgcaaaaaacatctcaaacaagtttgtaatataacaatgtctggttcaacttttgtaatagaattgaaatctatctcctaagtacaacttaaataggatgtgtaagagtgcttctcttttgtaaactgctgttagtttattttgagttgtgagctctccctagcccccagccttgttctcggagaactgttctcggaggagaaggcttaaaaacccataactcgcctagttgaaactgcggtttacctagcccccagccgtgaagttggaaaaatcaatttccgattacatggcttggttaatacgcatccagtgagctctctgacatgaccaattctgacatggtcgttcagctctgattaatctgacaaggccttattaactctgggcgtcccgaggcgagatccccttaggtttcttggaggctttgtcaaaacagcgtaaagggacgataggttcgatttcaacttaaggtgttatcgtggtaagggatctctgggttaaacactacagataactgaaaagagttcgtatacctctgaaataagctttattttactgttctgtaaggaggaaacttacagacttggatacattgaatctatacatagaatttacgtaattggtcaatgttccaggagtttgataattcgcggccttcgccatctgcaatcttgaatgcgcctggtcgtaaaacttgtaccaccgtgtacggtccatcccacttaggtgagagcttgttgtgccctccttggttttgtactcggcggaggacgtaatcgccgacggcaagtgtgcgagctcgaacgcatttctcatggtatcggtgtagggcctgctggtatgcggctgctagaacggcaactcgttcgcgatgttcctcaagtaggtttacatcatcacttcgtctttcctcctggtcctcgtcagagtattgtttaactcgtgtactctgatgccgcaactctgaaggtagcatggcttcagatccgtaaacgaggaagaaggtgtctccttattggacgaagtcggcgtagttcgcacggcccacagaacgaatgggagctcttcaacccagtgtttgttgtaggccatgagcctatcgtacacacaagttttgatcccttggagcacgatgccattagcccgttcgacttgtccgttactctggggatgagaaactgatgcgaagcaaattttgactccaagttcaatgcagtaatcttgaaaatcaccgcttgtgaattgggagccattgtctatgaggatgcgatgaggctatccgtatctgcagaacacccctttcatgaacttgatggcgttgtcggctttaatttctcgtgtgggctctgcttcaatccacttcgtgaatttgttgtttgccacgaacaagaatttgtagccgcccagtcctcgtgggaacggtccgagtatgtcgagcccccagcatgacaatggccaagtgagagggatggtctggagtgcttgggttggcaacttcgtgtgtttgctgaagaactgacaggcttcatatcgttgcaccatgtcgcaagcatctttgagggcggtcggccagaaaaacacttgtcgaaaagcttttccaaccatagtacgcccgctggcgtgtgacccgcatataccttcatggatgtcgaggagcagtgctttgccgtcgtcggacgaaacgtatttgaggatctcgttcgggcccattttatatagatctttgtcgatcaaacaatagattctggcctggcgggatatcttttctgcctcaacgtcgtcctcgggtagctcatcggtgctcaaaaatttgataagcttgattcgccagtcgtcttttgtctcgatgtccgccatgacgttgttgacctctctagcccttaagttgatatcggaatcggctgtggtattttcgtcgtgtgactctttcacagatggttttgtcaggatatccagaaaagttcctagctcaagaggttctcttctagaagcacaccgtgctagggcatcgggttcgacgctgtcttttcgatagacatgtcgtacctcaaggccgtcaaatttccgctctagtttcctgacttcggcgaggtacttggttaacttggggttggagcacttgtagtctttgtgcacttggttcgtgactaattctgagtcccttttcacaattaatcgcttgacacccagtgcaatagctgctcttagtcccacgaggagtccttcgtactcagctgtgttattggttgcccggaagtcgaggtggattgcgtgtttgaactggtctccagtcggagctgtcaaaatgaaccctgcacctgctccttggctgttgaatgcgccatcaaatgccatagtccatgtctctttatccatttgactgtctggtctattctctggaatagtccagtcagctacgaagtcagcgagaacttgggatttgatggctattctcggcacgaagtgaacatcaaattgactaagctcgactacccatttcgcaatgcggccgacaacgtccttgtttctgacaacttctcccaagggaaaagaggaaacaactgtaaccttgtaggcttgaaagtagtggcgtagttttcttgatgtcatgatcaccacgtagagtagcttttggatctgtggatatctggcttttgcgtcatggagggcctcgctgacgtagtacacagggcgttgtactttttccctcttgacgacgataaccgtactcatagaataagacatggcagcaatgtataagaaaagctcttcattgtattgtggtggattgtggtgcaacgagtacagtgggatttgacaagtagtgtttgagcgctatgagtaaagcaaagaagggttgtcctcgttctcccatcctagcgacgaagcggctcagtgctgcatgcatccggttagtttttggacttccttgagtcttgttggcgacttcatgttctcgattgccttgattgtctcatggttagcttagatgcctcatccggaaactaagaaaccgagtagcttttctgatggtactccgaacgtgcacttctccggatttagtttcagccgatgtcgtcggaggttgtcgaacgtttcccttaggtcatcgatcaatgtgtcgcttgtcttcgttttgatgaccacgttggcgacgtaagcttcgacatttggccgatttgatcgccaagagctccttggatcttgcgttggtatgtgttccctgcgcttatcaatccaaatggcatcttggtatagcagaatacaccgaagggcgtgatgaatgccgttttctcctcgtcctcttttgccatactgatttgataatagccggagtaagcgtcaaggaaacttaacagctcacagccggcggttgagtctagcagttggtctatttgagatagagggaaatgatccttggggcacgccttgttgagatcagtgaagtctatgcacattctccatttcccgttggccttgcgaaccatgactggattggcgagccactctgggtggagaacttctctgataaaaccagctttgagaagtttgccgagctcttctcgtatggcttgttttcgatcgggtgcgaatctccgcagtttttgcttaactggtttggcattggctcacaccataagtttgtgctcaatcacctccctgggactcccggcatgtcggacggttgccaagcgaacacgtctacattgtcgcggaggaaggtgacaagctcgagttcctatttgctggtcagcgtcgccccgatcttgacggtcttgtcagggttggtgctgatcagcgggacgatttggattgcgccgtcgggtcttggcgtcttgttgggcttgctcactttcgtaggtggctcaactgcggcgggtgggttgggagtttgctcgaccatgtcaaggctccgcttgttgcattgtaccgccagcttcgcgtttccttgaacagtgattgtcccttttggtcctggcatcttgagcaattgatacgcgtagtgggacgctgccataaacttcgcgagtgcggtccttcctaagatgggtttgtatgccgtatcaaattcagcgacatcaaaggtgacctgctctgttcggaagttatcggcctgtccaaacgtgacgggtagcgtgatcttgcccaatggcttgaagggttgatctgatggggtcaactcgcttcgtgggattcccatcgcgtccaatgtgccagcgaagagaagattgatggagctgtcgccgtcgatgagaacccgtgcgactttgatgttccgtatggtgggctcgaccacgatcggatatctgccgggtagggttgtagtttttgggtggtctgcctccgagaactctatcttgtgctgagaccaattcatcctggcagcaactccttgagatgtagagtgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaaccaaaaataaacagcagcggactagcgggcctacggctccatcttcacaggcgctcaactggggtataagccaggactccacctaagacatcttctccaaagcttctcttactgaagggggaagaaagatagagcaagaatgagtacaaccacagtactcagcaagtcacaccggagatgcatgattaatgcaagggggtacaaggggataataatatcggggttaagttttgcagtaaacagcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccatttcacattttagttgttaagcaggttttaagaattaaaacactaacttgggtacattgcttggcttgcccataaccgagggcgcggctattcgaatagattatactctgatcagaggtgtacatctttacccacaagacacatcttcctcacgtgcaaccacgtgccacataacaccacggtatacagacggaagacgtgacatagtttccaacccatcctagccatagacaagagtaccgacccaatcccgcctacggccggaacctccgggacaggcaggcaggactgagcccctagcagcagggcaccaaccctgtgctatgacatctcgactaccgggccgcagctcctgtagccttcatttgccctggagaatgtccatcgacccccgacttcatccatctccaatccgtgtacttttgtttataaccagactgagccacaaactaagccttacccactagacatgtggaagtacggtagtgcttagcaacagaggctcgaagaccggtccttatatggccgaggtgctactatcaaaaccatgcaccccgagcccagcctaaaaccattttggggattttgaatagagggggcggtgtgaatccaattccacaataatccaacaattccgaagtgtccaggtgatgagattatcccaaagtctagagttgtaaaaccacctaatgttacctaattaaacagcgaagcatctacctaaaatcatgctagtggtaccatgagtagagtgtccactagttggggttttgtttaatctagggtgaacaaggtaataataacaataacaataataataaggtcataacaaaggtaaataggcatggctaaataaaacagtgataacgcgggaatttaaataaagcgacaatgcaataatttaaatcaaaataattttataaactgggattcaatatgttcaaggatgatgtgacttgccttgctcgctttcccaaacgccggcttcaacttccacgaagagcggatcttccgaagctgcagcgtctacacgaccaacggaaaagaaaaggcttttactctaataaactccaaataacaagcagaaacaaagcacaaaaatgggtt

SEQ ID NO: 77929 - DNA, 790 bp, Oryza sativa
caagaagggaaggggggggggaaaaagactttttagggtttttctttttataaaatcattttaactttgtttatttcttaataattatatttgtgctctgaaaattccactaaaatttgagggctccttttagaccaagaggaatttaacaaaaattctccgggccacatttgaatttttcttgtacgtattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtctgacttcttccgctccgtcttctataacaaacttgcctaacaaaacttctccactctggactgcttggctcgatctcctgttgcaggtggaatcttctcttcacccgacttgtccctggttgaacctttagctgacttcgactgggttgcggcacttgaagatggggcttcagttccagaacttctcataattcatatctttggagtcaacctcattgaagttaccaacttcatgtcatgcgtcgacaccagcttgtcattactaggataccatgcttgtcatcatgagattaccatgcttgtcatttacttttaacttgccaccaactgcctcatattagctttcctgctctccgggtgctaactacttctgctattcgatgcaagggtcgataactttgcctttgaattatgtttc

SEQ ID NO: 77930 - DNA, 8787 bp, Oryza sativa
ctttaaattattcgtaaaaaatacatcgtttaataatttataaaatcattaaatcattaatcatctctgtatataatatacggcccaaattccacaaatacatcgtttaataatttataaaatcatcaaatgattaatcatcctagtatataatataccgcctaaagtccacagccgtgcctaacccgtttaacctcaagctaagaaattaagttaaaaactaccatgtataagacaaacggcaaggagaggagaggtccaacagaggtagtaaacaggtatgtgtgcgtacgtacggtactatgaatgggagaagattttgttttttaatatatctatttggtccaccaatttaagttatctataattattagttgatctaatgtactcaaataatgaatcacgaagcatttatagaatatccatgtgtcagattaagaatgtgtttataagatgtttaattaacttaatatataatagaaataaaaggacggagggagagctggccagacctagtagatcaaagtctatttgtgagttttttccataaaaagggttccaatttttgttatttggggataaaaaaagcaagcgaaaaggagtacagaaaacgtacgttgtatgtcgtacgtgcatattccacacagagacagagacagggatggagggatgctttttttaacggagatctaaccatctaaaataataggtccaccgatttaaataaaaatttatggtcagatttttctattttattacgatgccacatggtggtatgagagcgtttatagggtgctacgtgacgatacgggagtgtttataggaaataaacttttataatataagagaagatagatagatagatagatagatttatgagtgcaactgttgttaaaattctacacatataagaatagtacatgatatatatgccaaattcccaatatatgatctgcatatgcactgagtatgtggctaacacatattatagaatctatcttataattgtggtaaactcttgtttaacggagacttgactggatttgcgcaccttgggagttatctattgacttgatctaaatcgtgctggcccggtacctactgtatacctcacatgccgagccgttgacattgacatgatactctacagctgaagcttttttgagttatgttgggaagaatcactaacaaaaacaacttaatttttgtgatataaggtgaaatcctgaaatatatgttccacaagaactgtgcgactgattaagaaactttcgtatacattgatggccaaattataaaaaggaaattatatattgaagagattaatggcctcaaagattggaagtgttcactgcatgcatggaataattaatgatttttacccacaaatgatgaagggtggttgcctacttgcgaagtggacatgcaagttgattaactaggactgatattaacaaattagaccttgtctcatgtgttgctagttagtcaatataaataaaatggcctttccttggctgtcctttgccagttaatttgatagttgccccttaacaactaaatagcgaacctctgagcagatggccttaatatctatctactgaagcttggcttcgacgaccttatcatcgaattagcgtggcagtttagctcggaagacaggcagagcaagaggtagcacatcctctccgaagggaagatatgagcgaccagagctcgtaccctaaccctgctcaaggtattagatctgtctgctcatcccttgattatattctaattattagtacatcagttcaattgcttttgaatacacaagaacttttttcgattcatataaggagtgaaacgtttcctgtgcaattaacagggtttaaaatttcagatcaatcggattcatccgatgcgtaattatattgatccagtttgttgtgcattcggaaaattttgttcaaaacttcagttatggcggatcgaaattaccgaaattttggtagaaatagccaaaacaaaattttgaacccgagaaaataatactgcaaaattactctgttttaagagacctttttgtatgtctgttcggaaagaaaggaagacgacgcaattttggagtaaattagtgttgccatgattacgcagggtactaccagggtcccccagcctcggcggcggccggccaagataacacggcggccggcggtggcaagtccaacgcagccaagaaagaccaaccgagcttcatggataacctgtccgtaatccgtctctgctctactaattaatctctctcgctttctgtatatttgtaacgccatttatgtactaattgcttcttaatccattttgcagccttgcttgcctcccctgtgcccgcccagccgaagccaagaacgacgcgagctaactaaccttgctccatcaggcagcctagcacgggaaggaaggctgcaaagctactgcatgattatgcccagtgtttgtttgattattcagcatctaagtaagcacgtcgttaattagttcaatccggattgctcatttgcgttttgtgtactagtgaacgatttatgtatttgtcgggggcgcatgtaatttaatttattcccctttggattcattattcagtttatcttgtcatgattttgtgaggaaagaatctgttttacgcatggttaaattgtactactactacttcacacaattctttaaaaaattctcgaggttaaaagttaacttttcaaaaagtaatttttttgttctttggggaagtcaagaaagaagaggataaatatcttttgtcactactacttcaaaacctataacatgtggcattctcacgggggccccaaatttggccgacttcccaagtcccgtgcacgctgcgcccctctacgctaattacgtgtaatcgcaattagcataaataatatttttttctaatagattagtaaatttgcccatgcgttgctaccggaaaaggtaaaattacgattagaaattatggtttattttttgtgatctgattcccttaaaaattactacaattgattatgattgacttataatcatttagttgatggatctatcataagtatgaatcatgtgtagcttccagactgtttcctctcaaaatgaaaagaaaaggatgaaattaagaaccgagcaccaataaccaaaagcgatgtgccaaacaatcagtaaaaaaaaaaaaagaaaaggcaaacaatcagcccaaagaacttgaatcgactactagttaataactagaaacgttattttctgcccccaggacgtaatgtgactgtgagaccttaatcttttccacacccaggacgtaatgtgactgtgagacctgaatcttttgtacatccaagttgtagggatcagatgtttacagggctttagtcagagacgggatgcctaaccatctgccaaaaaaaatgtgtttgaccatcggaaaaatgatttttatagcagtgacgcagccatacaggacgcacaggagacagacagatgattcgtccgttagagcactacttccatgactcctaggctcctagccaagcacacggcgggtgatgggtgataataagctatctatttatttcagcttactactaataatttaaattataataattctaaggtcttatttgattcagcttagagttattaggagtaaattgaaacaaatagatatcttattatgatatattattacaatgtataaacacatagcttatttaatcaactgtaaatgtgctttttagattaattggttggctaaacaactaataatccagagaaacaaacaactaacaacttatattctatatcggcttattataatctagcttatagtaatctgacttaataatttagattataataatcttaacctgcaacaaatgtcacgaccgcgagggcctgtgccatgtcgcggagaagctggcgggccggaggaaggaggccaggtgcgttccgccgcctatcccagactgcaggtggatatctcctattcgagcgtatcaagggccattgcacctcgatcgtccttgttccactatgttggcaccgtcccgaagccttgcactcatgctctggccccagcaccgtagtgtgcggtgtgccctccatgtccgtggccatagttcatcttcctcttcatctcatcatctgccggatttatccttgttagacggttgtggaaaatgacagagtgcactgtcaggacagggacgactctgcgtgtagatcgaggaggacggagaagatcagaagaggaacaaggacgccaaggaaggaatcggccgaggccgggagcaaaccattgtggcctttctgttgttgcgcgtgggcttgcatgtggtgattagtcgctaaatcgctgggctcgttgttggggccttggggatgggcaatgtggagtcaagggagatatatctgactcacccagtttttagcttggtgccagcgctgtagatggccatagagtcagaggcccgatggcctggtgatttggtccggcctaggcacggcctggcccgacagccgtgccgtgcctggctgctacctcggtacgctgggtcagcacaaagttcagggatgcgaaacaaagaatagagaggaaaaataaacgtattatatggcacaacccaaagaataggaacgtaaaatagacttatttcaaaaaaggcacgatgggccgcccgtgccttcgggccggcacggcacggcccgactgctagtgggctgtgccttgacccgaggtgcagcccgtggacaggtatggcacgaagcgccgaccgtgttgtgctcgggcgggccttatggccatatatagcggcagccacttcttccgcttccctggcagcagccatctcttccgctccatggccaccagatccggctggcgggagctcagccatgaggcgaccggcgccctagtgttagagttgtctgttggatcacttaggtttagatctagtcgggtggttctatttgcgatcgatgattgaacaacaatagaaattaagggaaagggtttagtgatgtgaccggttgacgcgttggatgaggaggaagtcccggccatcgtcgttgatgtcgctttgcttatcgaggacggcagcgacgatgtgcttgacggcgctggtggtcgtagcagtgggagtcgtggtcgacgatgaggcgtggcgcggcggtggcacgttcccgtcactggctgcgccccctcgatcggttagggtttgtggggtggagtggcggcagcgatgaacctcgtgtcttgtgccgtcccgtcctccacccctctttatatggcacagtgtgacgggggcccaccagccattgggctgggcacccccgatcagggcgcaggtcaaggccctcttgagccattgggctcaagggaagggagatctatctaacgttctcccccttgatctcactatttcttttaactttttctattccatcacagatttacatatcgagcatgtttcatcgtcacggttaattaccgatggattcgatagccactatacacatctctattcagaaaaagatactttaacttttgggtcctatagtccaggattcataaggcttcccttaaacccatgcatgctacatgttccttgaacatgttgggaggtaggcctttcatgagcggatccgcgagcattctttctgttctaatgtgctcgagactgattgtttgatcccggactttgtctttcataacatagtactttatgtcaatgtgtttggcagcaccacttgactgattgttgtgagagtacattactgcaggttcgctatcacagtataactttagtggtttctcaatattgtcaaccacctttaaaaccgggtatgaacttctttagccagttcacctgccccgttgcctcatagcctgctataaactcggcatacatagtagaccctgcagtgatgatctgttttgagcttttccatgaaatagctcctactgctagggtgaacacgtatcccgatgttgactttgtattatcttttgcaatgtcagaatcagaataccccactatctggagcgattctgattttctgtaagacagcatgaggccttttgttccttgcaaataacgcaagactttctttactaattccagtgctctagacctggattactttgaaatctgccaagtaacccggtaacaaatgccaaatcaggtcgtgtgcacacttgcgcgtactgtaggcttcctacagctgacgcatatggctttgttttcatttcattgagctcatactgatttctaggatattgagatgcccgatacttttcgcctttgactataggagcaggtgtagcactacatctgtgcatattaaatttcttcaacaccttttctatatatgccttttgagaaagtcccaatgcatactttattctatctcggtgaaactctatgcccaaaacatatgaagcctcactgaggtctttcatgtcaaagtttgaggacaagaatttctttgtttcctgcagtagactaacatcactactagccagtagtatgtcatctacatacagaattaggaaaatgaatctcccattcttaactttgaatcaatacagttgtcctcgatattctcttgaaaacctaaatttctttattgttccatcaaacttcaagtagcactgtctcaaagctttgctttaatccataaatggatctctttatacgacatcccatattttcgtttcctttcatgacgaaacctttcggttgtgccacgtatacttttttcttcaaatcaccatttagaaattccgtttttacatccatctgatgtaattccaaatcataatgtgccactagtgccattataatcatgaaggaatctttacaagagactggagaaaatgtctcattgtaatcccttctctttgcgtgaagccttttgccacaagtcgtgctttaaacttttctatattccctctagagtcataatggttttgtagacccatttatagcctattgttttggctcctttaggaatttcttctaaatcccagacatcatttaatttcattgatttcatttcatctttcatggcatccaaccattcagatgagcgagcgcttctcgtggcgtcttcatatgaggtgggatcaacctccatatgcaactcttctatattataaacttcatagtcatcacggatagccgatcttctgactctttcagaccttctaggggcctcctcatttggcacattatctgtttgaggctgttgcagctcctcctctggtgtggaaataatttatgttgaatcctgtaaaacaggttcttcactttcattcattgttgccacaggagagataacaacaggtgttggtaccgcaacgtcatgcattgctggcacaacatcagcaggtagagagaagaaatgttcctgagtagacggagcaggtacagacacccgcctctcctcaagatcaatttctcgaactaccgagctccccctaatcatttcgttttccaagaagacggcgtgtctcgtttctacaaactttgtttaactgtttggacagtagaaacgataaccctttgatcttttagaatagccaatacaatggcagcttactgttttgggatccaatttcccaagatttgggttaaatactttagcctttgcaagactcgcccacacacggaggatccatagctcatacggtgttttgggcaccgatgcattctatgcattgtatgcattgttctaaaactgagaactccaatggaggaataattacattcttagccagcctctcaattctccccctcgaaatatggccaaaacgacagtgccataatttcgatgagacatcaggagttcactttcttttcttttgtcaacgaggacacaacattcacattctcagaaagagataacaaataaagctgattttgcaacagagcaagaccaacacatgcattattataccatagttcacatttgccatttccaaaatggcaatcatatctatcaaaatccaatttggatacacttatttcttttctttgcaaagaagggacataaaaacatctggaagtaaaagtgtgaagccattcgcgagctccaacagcttcaacttttgcttcaactccattggcaactctaatgggtcttttacttctttgcgtagtcctcattgaacggaatccctttaaacaattacacatatgaatagttgctctagaataaatccaccatgtggatctagaataaccaatcataatgagattcatttacaaatgtaataatgttctcacctttctttgccatgatcactgtcaggaagtcaggacgatctttcttggaatgtcttgtcttcttgcagtggagacactgatcctgtctcaactgtgaactgttattgctgaggcagatgctgaggctgtttagcttttgaggaggatgacctctagctcttttccttgttatctttaacaaggttaatggagccaccattggtctctttgagtctttcctcctcttgcacacaattagagatgagctcttcaagattccatttttctggacttattttgtagttgacaacaaagttgtcaaagctctttggcaatgaggacaaaaccagatggaccagaaagtcatccgagatgcccaaatctttttgcttcaacttggaagccatgttgctcatcctaagaatgtggtcttttacaccacctccatggtacctctctattacaagctgctttatcagctgtgtcgcat

SEQ ID NO: 77931 - DNA, 8776 bp, Oryza sativa
cttgcagaaagagtatgaaaaatccagtaaaccaaaaagtaatatctaatttataaactaagtattatttaaaggctgcaccggaaaaatgattctccatatatatgtattatattttaattaggtattcatgattaaaactggtccatatcactattcctgcaattagtcttacatgaattatctgtatgaggaaccattggctacattatatcgcttcattcaacagttctagaaagatgaataaatgataattttgaaataacttgtatatcattgtaagaagccaaaattggtcattttttttaaaaaaaattaggaagttccttagtaccttcaactatgtccagtctagtaataagaaatcatgacctccgaatgataaaagaaataaattatgtccattttcactagaaagtctccagctaaatgtgatgttttgacttttcaatcagcccaattagtaaacaacaactgtagtcatttttttagcaataataacatgagtttaccactatctttccacgttaccctttttcaagaatatttaattatgacgctccaaacatgtattgctggtagacaactagctatccactgcttcttttttgttcctgtgtgattcagtcctcagacgcagcaatccaaagtactgacgactaaatctgactaaatggtctgtctagtgccagcaatactaacattggcaccaactaacacaagcctactagtagattgtaggctacgccattctattttattattccaaaatgttaccagttgaacattatgataaaagcaaattagcaggtaccttgatatcccttctgacgtattttccgctgccagcttctccaacagttccctcgatgtggtgacatactgcgattgaaggttgcacatgctaagaggaaaacggaattgaactttataatctaaaacgtgaaatgcagttgtcccacagagagcaccaaatcatgtctcgaatgttacacatgaactaaataggatccaacaaaagctggcagatcaccgattcaattagcaaatggtaaaacagcaaaagattagtttatattctttttcctctaaaactggttgcacgttattcagaatacaccattctcatcaaactgaaatctgagtgcagaccaaaattagggggcgaaatccactaggacaataaaactgctaggattccgagatacagctatacttacatgaatgagtttagcctggttctgctgccgcggagccgagtcaagcaaccgcagcagattcacttcagtcttactgatgcccattgtgggatatctgatcaaacacggtaccaacaatagaagcataaccacaattgcattaacttcatttccagaaatatgaacgcgaaatcgcaattcatgaatctcctgattccagataaacagaagaaactatgaacggcctttctccgaatggagagggggaaaattgtactacaaactaccttagcgcacgcgtccaatccgatggacaattcgtatgaaaatgaaacaagatccaatcgacgggtcgagatacaagaatccgaggcggggacaattgaacggagaatcgtattgcaaggggaaaagaaaaagattgcaagattcaagtggtagaaaggttcaaggggacacctcctccgcttgttggcgtcgggcacggactaccaaaggaagcggttctggccggtcgcggatgtcgctcacgggtggccgttgccggctggccgaccggacggacggacggacggcggcggcggcggcggcggcggagaagacgcgtacgcctcgtcggcgtcgccgccacgaagggagcacagcggtttgggtgctgggcctgatgggccgagaaggcaactaagaaccgtccgatgagattggacggtggatagggcagaaactgtagaaattgccatgtagggactattcgtgtgattgttagccaaagtatgtgagaaaaattcacatatatataattattgaaaaatgtgaatcatagcttctctaaagaaaaccatagcaaatagtccattcaactccaattcatgatgtgcgactataaattacaaaacattgtctaaataagagttacttttttataatggaattgattctggcctttactaaactacaaccaattattacagaattgctggatgaataagtaaaaaaaatacaaaattataacttggttagaaacaataaaaccgctaagaaaaccacccttaaaaatatagatctccatgcatggttggctagagtgtgtataaccgagctggttcttgtcttcctcaaagcagaaaagcataatcttttaaatgaatagtcgatacttgtattataattaaattttgtacctatcaccattatcatatggcgtcaaaccaaagcggaagaaataatggagattagctgaactgtatatcagtcattagtccagattttaccaccaccaaacgaatccgatccgatgaagacaccacaaggatatcacaataatagggaacctccaatacaacgccttcaagaaggctgcgacatcttgaatatcactatctctaggttttcaatgagagagtccatcctatggcacggatgcaaaggatattgtgacatcacctccaggaagatgtctgttgtccacagaagtaactgatatctatcttcggaggcaaccgacaacagactcggtgggtagcgacaacagatgccggaggctgagcaaggggacatgcccgaggaagctgcggccaaggacggatccggcaacctacatcgccaaccgtgatgctaaggcaccacctcccgtcaccgtgcagccaaccattgacgagggagcctgcaccagtgatcgtcacatgtcgcgccttgttagatccatgttggctccttaccttgcctcgttgccacgctttcctggctttcgcttgctcacggggcaacgtcctcaccagatccacgccacctccgccttcctccatgctacagcctctctgttgcaccattgagagaggagccgcatcgccttgccaacctgccttgtcattgctgaccaagaattgtcacgacgccccaattttatttctggattaaaaaccattaaataatgcagtctagaatttatattaaaagtcaaagtactttagggtcgggaatatcagtgtaattgtaatagtacaaagttcttttaatcaattaagtaaatgaaaaaaccaattaaaatcatccccttctccttgggccatttcgggcccaagtctgctcttcgttcctcgatcttcgcgggtccagcgagcttctcctcttcatggatcagctctccttcctctccttggtctgcccatctactctctgctgaggcctattcgcctcctctctctcgcgaagtccacttcacctcccttctcccttcagccgccaataggtagggcccacctatcagggtcatcccctgcctcaggccagtcagctgcaaccgcttccaccccacatcgccgcctctactgtgtgcctcccagatcccgcatgtgtgtggacctgagtccctacacgctcccgcgcccacaccccctctcttcccatgaaatccggtgggatcaaaccctacttctccccaccttgtcgacccactccttcaccaccagttctcgcctcgtcccggctcccattcaccctctcgaggctataaagctcattccttgagcttcctctcccattttccctagtatcccgagcccaccatgccccgaaaccaccgcctcactgcaccaccctagcgccatcgctcgccgccgtgctctgacctagcgttgccacggctagtgccgtcgccgcaccatgccaccattgccataagcttcgctgctttgcgtagcgcctcggccactgctcctcttccactgctatacttgggtgataatttgactagattgtgtatattcttagccatgcttaattaccactagttcatctaatgggataatcacactacttacatttagtatcttgacgagctgcaagctcgagacatctagccatgctttattggtcataactatccacctaaaatatatggtttaatgttgggttgggtgcatgattttgtttgtcacgaacacacgcgcccatggcaataaaggacgttcacgtgaaaccctataagacttaccatgcttaccacaagaaagcatgggcaattgctgaacttctagtatagcttttccctttccgatgtacccaagtaagggtgggtgtgatgaagtttggatggactgggcagcggtctatgcggcttccggattcattgtagcacaagaggggattgcccaccttggttttaaaggtacgggtgaaacctgcaatgtggtgcacttggttaggggagttatgcgaagggacttgttgcaatcactcgcatggtgacatgcctgcggaagcacggtgacatgccggtggattgcgtcttgtgggtatagttgtacacttctagccagagtaaaactattcgaatggacatgcttgcggttatgggcgatcgaccagcttcaccatgtttagtctcactctattatttaacttgacttaatgaattggtatagttcaggtggttggctggacctgtttatcgtggtgtagcattgttaagtggacattaatcttgtcttaattaattaactgttttattgttttcaactacaaatgtttacaactgcattcaagcaaatagccacaaaccctcctttgtctcctcttgcatgcctacatcattagcgtggcttgctgagtaagttggttgtactcagtcttgctattattcttcctttttagaattggtagaaaaaccaagacttataccccagtcgagttttacctatgaagtggagttgaagcctgctaggatcgtatttttctgttgttgctttcttttcagcgtgggaactaagtgtctcttccgtaagtatttacgttttatttatgttctgatctgtatattaatatttctgaacataaatttatacacaaaatagtctgaaaatttggttaaattttggattcacaacattataattcaatgctattcacctatatgtagccatgccattataatgttacacgtattcaatatttgccattacttgctatttcgatgcaattctaaattttttaccaaatttcttaatctctttaaattaaaaatacaaaaagataactactagtttctcgtcttcataacaaaatgaaatttccagttttgaaaaacaaattttctaattgctgcaaacgcattttctgttttatagttctaataaaaaagaaaatccaatcatttagaaacccatcattaattgatgcacattgctgacttcctgctgcctactaaattggacctagtgctactccaccaaaccaaagcatagagccaaacatggcttggctggctatggacatatcactatctagcactaccatgccatgtcctcacagagtcaaactctactcctttcatcattgtctcttgtgtcacatggatatacactttcgatggaaattccaacattgcggtcgcatgatcttgtcgtccatcttatcgtccactcccttttccaaattttgcatgtgatacactggattggaatctgttgctccatataaataagtgactctgagagtagcaaagccaaagcaacttcacacacacagtgtactgatcaacacttctggaagtggagcaaggttgagttacctgtgagacagtaatgaagaggaacaccatccttgctctcttcatctgggccatggctatggtgatcttcgccacggcaatgccggccaaggcaaggatggaggggatccatcctcaaggttagtttggtcattttacccttgttccatagcatattgtagtatatttttaagctaaatcaaacttttcttcatacctgtgacactagtatagcatatcccatgggtgtcggttgggaatctcgtataggtgccaaatttttaagaggttgtgctagtttttaattttagatccacaagagtggacgagagagcatgaaaagtctcacatgtattggtttttaggccgtccctgttatgggttttggagtagtggactagtggcaatacatgcaaaattttcctttatacatacacagatgagaagatttcactcttcttgtttatttggaagtaatcattgatttttcttgtgcaatgaaatgatcgcaggatgcagatgctgctatttcagacttaggccgatgatccagtgtgccaaggcttgctgtggctctgacgatgagaactgctgccttgtgaacaactagttcatctcgggaataaataaaccgagtcggtcttggacctttgcttaatttccttgtgtttcaacgatctcgctgaagaatgcagttatatatatgaaataaaatccagctcttgctgttcatacctaaatgtgtgtgtcctcatttccaaatctattgtgtgcggtcagcaccttgaataatactgcatcttattaactgcgtaccactgccaccagtaggttatttgtaaaagatgtagacataaatatccatgctacatatattctacagttctattcatgttggcctagttgaagcaaccttgacatttggcacttttaaaaacacataatacgaaaacttcaactaaatatatgtatatactccctccataaaaaaaaaacgaatataacgcattacagtacaataaatctatacagatatatgtccagatttataatagtaggatatgtcacatctagtattagattggtattttttaatgtaacagagggagtagaccccgtcctcatcattagtcctgaagaccttgacagtactacacaaggagcccttggactagcagtcaaaacccgcgggggctgaccgcgcgtccgacatgaggcttgtgggaagaatatgtgagagaaaataggatacccgataatatctgagttcgaacccgaattcgtaaaagaatgtgggctagaatacgggaagagttgtatccgcctatatgtctcatgctataaaacatatgtgaaaatctattataaattcacctatatacataataaaatgttagttgattattatttttataataagctctcatgtattattatataatttgttctttgatgtatctcttttagcacttcaattgtcttcttacattaaatatctatgaattaaatatacaaataaatatcgttccgaatctgattcaaagaaaataatatgggataaggtacggatgagtgatatgttatctgacattatcagtgcctagttctgaatttaaagaaaagatatgatttaggatatgggaatggtgtgatccaaccgttttcatctttacctgccactgaccactttactcatgtgacaccggggctgaactggctagccaatgcgtcaggtgatcatcaattcagcgccttcttctttctctagtcactcgaacgctggccacatcggttgacctaatataccaaagcgaaagtcaaaatttacaattttaaacttaattttgatgttgaatttaagatattttcaacatatattcttttccagtattggcttttaagtcgctaagaataaatatatacaaattgtaactatatattaaccagcatcaatacaaaattatcaatttttttacatataatattatttaaaatttgctaaatatctatcttattgtcttaggactttgaaagaccaaacattaattatcatcccctgttttctaaaagtcacaccaatcactacctcttacttttttattacccatttatttgcttcctcgatctaccacattttctattcgtcctccttataacctttaaaaaatgggaccttttattgtttcgttgggttttatttttataatttttagaagtcctgtcaaacatcatcattgtactcttctacggcccttccactgcctccctctttattgtaattgggattctacaaatcgaatataattcgttggagttaattttttactttgtaaaagtcccgccaaccattggtggctcaagcactatactctaggagtataacccatccactgcctctcttttttattatcattgtgattttaaaaataaaaaatgattgtcattgtggttttttttactttgatgaagtcccgccaaccaccgtgataggttacttaacggccttccatcatccccctcttaatcatcattgtgattctatttaggattttttttatagttttcctatgtcccatcaactgccactaccctactcctgctcgtttttaccttaccgccggtaaccgtgcggttaccgcggttaccgggcttaccgcgggggtacggtaatataaatacctcggtaacctccttaaatttagataaatttaaaaaataatttgaatttttgataaattttgcacggttttgtacggtttttcacggataccgcggttaccgtgcagtaaccgtgcttaccgccggggcgcggtaacccgggccccggcggtttgggaaaccctgttacgagcatgttgtttcaactctttattgcaatttatcatcgttgtattctagatggactattatttattttttttcatatctttattccaatattttgatatttatgaattgtgttcctacttgaactcttataattattttctatttttggaatttatttatttttttattccaacttttcatt

SEQ ID NO: 77932 - DNA, 4564 bp, Oryza sativa
ctgcacccctgttcgcatgagggataacctgaccacacacaaggaatttatcgcggcggttcaagaacaactcatgggattcatcaacgaagaaatccttgatcccaagggtaaattctactacgacggaaacacaattcaccggtccttagcttctgagctagcagcgagtactctacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatataatataatatatatacatatatatatgtatgcatatatatgtattgaaacatatatatgcatggtttatatatatatatatatatatatatatatatatatataaaccatgcagcaacaggggcatgcaaaaaaaaaaaaggtcagctcgatctttagtcccggttggtgtcaccaaccgggactaaagatcgatctttactcccggttatttcacccgggactaaagatagcgatctttagtcccggattggtactcccggtttggaaaccgggactaaaggggggttacgagccgggactacaaagagtttctccaccagtgggcggcgctccgccgcgccgtgaacgtgcacggtagtgctagtgttgagcaccagtagcactacacggcgagcctgctcatcgtcgttgataccggtctcgctactaagcctgcggggccatggtgttgtctcgtcctggagtagcgcccgtgacataagccaccagttacgcaagtaatctacttgccgctcgttgaggctgatttggccatcgttcacggcgtcgtagtgcagagccatcctcgcgccctcgcagaagacgacggtcaggtgcaccagatccagtttggtgtcatcgtctgcagcgccatatggatcaggtggttgttcgtagcccgacagcttatggacggcatccagcaggacgacctgtcgcaggtcaatatcattaaccaacatattcttaacgtcgtcttcatcgcgaccaccaagtaagcttgggtagctgccgtcgcatcccagaaatgtggatggctcagggagaatcggcttgctcatccccgagaagcccatgtggaaccattgtcctttcaggttcctgaagccgatgaggttgacattgtcatcccggacggctaaggttgctctgtcgtcgccgttgcccaccaggttgatgtacatccacctcgccggctgttttgggcatcgttgcatcgcgagtacgggacagccggcgtagacgtcgtcgaggtcaggatgctccgcgagcctgtcgcgaaggttgttcatgaattcagggtagttgcctgtcctcacgttgaactctacgttctcaactctcaccgccatcctctgatttctgatctacacaatgattaatttgcagttatcaaaaaccgtaaattgtactctctcctgttttatagtacttaacagtttagacaggggttgaggttaaacttttgtaacttcatttgactatcaataactttaaaattattttgtttaaaggaactagaacaacatatatagatttatctttgaaagtacatcaataaaagtaaatatacatttatttattgtatatatattataataaaaaacaaggtaaaagatatattttgaaaattgtatcattatttaaaacatcaagaattattaaaccagagggatcgagtttctttgtacgagctatagccagtaatatcgatctatgagtatgcttatatactagtatatatgttctcttgtttcagaaaaaaaaaaaaccaattcctgagctagattttctaggacggagagggtgtatatgtcaagctggatgttaacgttttaaggtacaggtacaccacattaaaaatgagccttggattttcttttctcaaaaaaagaaaagagccgtatgattttttttctcaacaataaaacaagaaatgagcctttgtattcttttgatgtttttatctatgttctagatgacaatcaaatttgtttagctctctagctaaggtgtgtttggttgtagaaaaatatgttgttttgattcttagtaatcagaagaaaatttaagtttttggtatgatcaaccagctgaatggtagtttggaatataggattgtgatatgatatgtctagtaagtaaaacacacataactggtgatatatattaagattccgtttgaaatacgaatatatatcatctgtttccctcccgatgaaatcgtatcaacctttctttcatgcgcatgagctatacgatgttgcattccccgcagtctaatacttccaagttgcccacaactaaactgaaaatttgaatacaaaaaacctcccatacagaaaaggaaagtttctttgaatcgttttccatttaaatttacttttaaatagaacccttttggtttacactactcgaggttgcatggtactacctccatccataaatatatatgggattcaggtattcagtacgtattatctaggtatatatgccgaaacttaatacctccatccataaataaaagggattcagctatacgtgtaacacaataacttaatatcttcatccacgaaggatccaggttatgcatatacctgaacagagccactattttatgaattggcaataataatttgtcacaccaacacgtgtagcatggctaaatccttgccatacgtgtttttaaccggccatgacaacattgtattaccacgcagatatatggattgtgtggttaaaaggattcatataagaaaatggtaagtttatgcagagtttatttttaatatcaatgaattatatatatactattttggtagcctgaaacaagccatcacatttgatgtaaaggcctataaattcctacgttaattaataagagaaaagagaaagatttgaacggttagattatgcatgataggtccaaattataacagtgtagattggtcaacaaacttgtttacgaaatacaattgtatttataaaaacataattaagtaagagttgtatatcacataattaaacaaaaaaaatatgtgttttctaaaattcacccacaacaaactcgcacgataatctactagttattgtatcatcaacagaggtaaaaacgagcaaacatattcactagatctggaggccacaaaatttccgtataaatccaagaaaaagaagatttgcaccattagttcatactaggttcgaatattataacaacgtaattaacattacttttaaaaaaactaataagtgattttttccagaacctatacacatgtcggattcaaaacacccgacacagttgagtggagcttattggtgctagatttacaaccgacaccaatgtggaacgatgaaaaaaaaatcaatttttagcatccctatatattaagaattttcggcagcggaggaggagaggaggaggcgctacgttggcagtgatagcggctgtagcgaggagggttagggagagagcgagaggttgggacttgggagcgagagagaggagcaacctgatcgagatcgagagagagtgtgtgcgcgtgctagaaaaggatataaaaaaactagatgggcttgctagtggttggattgactccatccctaaagttgcgtattattattttttaaaagaaaggcacttgtatcccactttgtatcccacacgtacaagtatcggtttattaaaaaaacacagatattagggttggttttattaataaactgatatatatgagggtgtcctctgaaaatcatcactagtgctggcttttaattttaggcctgcctgatgaattgggaggatggaaatagtctgatagatgaaccgacgtatacgagggaatcctctattagggtctttgtaaattgatcggcatatatacttgtatacgaaatagaattctacttaccaaaacagcatgaaaagttgtactagtattatcaacgtaaaatgggagttgtactacatcaaatctagctaattgaacttcacactggtggagaaatgctttctagtcccggttcataaccccctgtagtcccggttttccaaccaggactacgaatccaggactaaagatcgctatctttagtcccggttcaaataaccgggactaaaaatcaatctttagtcccggttggtgttaccaaccgggactaaagatggaagcatctttagtcccggttgataacaccaatcgggacgaaagatatttttttcttttttttctgcttttaatattgaatattgatttcacacaatcccatcccatatccaaatcatcacatattacagaacatctccaaatcctcaaacaaatcatctccaaatatatcacaaactcttaaaaaaattacatcacaagattctaaaaaattcatcacagattcacatctcacacaaaaatacatcacagat

SEQ ID NO: 77933 - DNA, 3404 bp, Oryza sativa
tttagtttttatttctaattttcgttaatctcgtatgtgttctatatgagtaaacctttcaatatttctaattttttatttccattttttgttgtttgtaaattgtaatcttacttgaattcttactattgttatttgataatttattctatatttcgaattttaattaatctctaattgtgttctacatggactcttctttcaatatcttttattccgaatttcaataatttctaaatgcatttctactcaagctcctctcttctttttctctgattaatgtgagattttgtagcctccatagggaactaaatataatacacacgatggatttaaatatgttatcttttacccactctcgaagctttttttatttttagtcttgcgttggagtactttcatcgttgaaaatagatgttttttcacaggtggccagcgtactggggccacctatgataaatcttttacataggcgacccgtgcctcccaccatagatcaaacttattgcaagcgggcattctcatggatcgcttatgatcctgtacttgggtgatcggggttttctgtgaaaattattcttttatgcactatgactaaaaaaccatataccgttctaatggaatatatagctaggtcaacatgattttcagatttgatacctccagtaacatatttccagaccgtcagtatgatacttgtggtatcagatctggtacgttcagtatcagacatgatgccccgtaggtatcagatctgatacctaagtatcatgctaacatcattgtgatacctacggtatcagacatgataccctgcatgtcaatgtcatcatgatatcagctttttggttggaatggtataccgttgtatagtatttctgttaaaaattaacatatgtggagcataaaattcattctcatccaacctgtggatcttctccttctctgacatgattgttgattccggacgtctgcctcatcttcttcagccttttggccttgagcatgtcggccacacgttgacaggctagatctatcaggcccttgacgcccatgacattggctgcgctgatcaagcgccgcagcgtgtcgttgtcgaccttgatgaacaccctgtcgaacttcttgagctcgtcctcgtgcattgctttcatgtcgccggtgccagagctcaaggtggcgtgcttcatgcagtaccgcttggcgatgacgttgtcggcgacgttagggatgggaatcccgttgtcaccagcgtggtggtcactgttgttcgtattgttcaccactgtctatgacagtcttgccaccgcctcctccacttcaaagtgttcttcgtcggagctgatcaactcaaccatcttgccaccatccgtcgccatgcatcgccattgatttggctctcaagttttcttcaaatctaacccaacaggctgatggatatagatggcgatgctttgactcttggaagtgttatatatattgtttggcgatatcgatcgataacacactgatgaattttgtgttatcttttgcgatttctactagtatactaggaaaaaatgcttgtgcgttgcaattggaggtaaagatcaatggagaatgagtttattctttcacagatatctgatatatgtcaatacttattatccagtagaagccggttaatttaaaaccgtacctatggaccttttccccatcttcacgggatgaaaaaaatatagaactggaatctttcgtaactttaggtcctggttaaaaaccagcaatgtagatatcggttttctaaaaagaccgataccacaattaatttagttgtaggtatcataggtgctggttccagttaacaaaccgacacgatcttatctaattgagctgagcgaacctttttttttctccgcccatacgtctcctcttcttttttccctcccctcctttactccacccacacacctctttcttttttcctcctctttttctacgcctcctctctcttctcctcaaacctaaaaggtggcagcggctgctgctcccccttcttggcatggcggcggctgctcctcccctccccggcacggtggtagcggctgcgtctcccctccccgactgccccctccgctttccgacatggagcagatggcggctgctgctccctctcaccacctgccaacatcaaaatttggtaagccctgaagtcatcatcggcctagagtcagtatcggctttagagtcctagattcgcccaataggaattatcaagtcgccaatagtcagatctttgtagattcggctaaggaaattgatcaattaaaggaagtttatctagaggagaccgagttcaaggaggatgcggcataacagtttatctattaattaggaagaatatgttagtttccttttatctttaggaaagtgtgtttagtgttcgataaggactttatgttttccttttatctttaggaaagtttttttttccaagaaggactagtatctacccatgggaataaatatgtacacccggggtcattgtaaactatctctcgatcaataaaactactctcggcgcatcgctaccctcttttccgaggttttttatttatcatccagcggaacttggcacccgatgcgggctgcatcagcttttcgatctcctgcgaaggggtaagtcctacattccgctggccctagcaattgtatcggctacattggtgttgttcaaggctacatcgcttcgatctcttggatcgctctggttaggttgatatatttgcctacctatttatcatatgtcttggttaatctagtctggtagctcaatttacttgtatcggctggggtctgctttagggcttttgccggtatcggctaaattgcttttccagattagattagctaaggtatccaccaccttgaaaattagtcaaagacttgattgtttagactttatacttcttagcatactttgtgacgcatcatctctagtcatgcttagaatcataaagattaacctgtctttgattataataggaaaaaatacgaattcccccccccgaagtataatggtcgtccgaattacacccctgaaccacaaaaccggacttcacccccaactatgcaaaccggacgaattatccccctcaacccaatccgcggtggttttggtctacgtggcagtccagtcaacaatttttttattaaaaataggtgggccccacctgtcagtttctctctctcttctatcttttctctatctcactctctctctctcctcctttagacggtggcagcggaggcagcgagcgcggcgaggcgagacggcggcggcggcggaggaggaggtgagcgcggcagcgaggcgagcggcggggccggagtaggcgaggcggcggcggaaaggcgagcgcggc

SEQ ID NO: 77934 - DNA, 4779 bp, Oryza sativa
  unsure (1)..(4779): unsure at all n locations
ccaaccgggactaaagatagatctttactcccggttatttcacccgggactaaagatagcgatctttagtcccggattggtactcccggtttggaaaccgggactaaagggggttacgaaccgggactacaaagggtttctccaccagtgtgatgggcatatgccgaggtggcaaacgatggaccggttagcatgatgttgccctgttttaggagaaaaaaataatccaattgaaactagtatagacattatttgaaagcgagaattttacaagattttcataaaaatatatcgaatcccacaaaaataattttaagagtgaaaatttcagagtggactccttattgaagttccatgttacacccccttcagcccatttttttttgcttttttaatacatttttcactttggactcctttttccctcatccttaagattacttatttttttcacgaacactcatcctcaagattactctccgtgtaccaccgtaaactgcaccctggtcaagctcatctcgattatgccgttgcattgatgtcctttgtatacccaaagtggcagggtattcaggataatgggactaaagtgaatcaagaagatgtttaaaaagggtgtccaaagtgaaaatatgttaaaccaaaacgaaacttgggttaaaaactaaaagtaatctattgctttcttgattaatatgcatgcatgaatgctagttgcaaatacgatttcataaattttgagtttttcatttgcactataataagaaaacaaacaatttatatgcagcaccaataatgagtggtctgaaacatatcatggagctacacaaatcctgaattgctcattcgccttcactagtcatccgatttgtggattaattgtcttgggtttagactctgttttactccatttatgtacagttttggctattatagatatatatttcagaattgaaagtatagaacaaattaaggttgtgtttagttcgtgtgacaatttttttaagtatacgtacacacatttgaagtattaaacatagactaataacaaaacaaattacagatctgtaaactgctagacgaatttgttaagcctaattaatccgtcattagcaaatattcactgtagcatcacattatcaaatcatggcgtaattaggctcaaaagatttatcttacaatttacatgtaaactgtgcaatcggtttttttcatccacacttaatgtttcatgcatgtgttcaaatatttaatgtgatggaaaagttagaattttgacgaaaaaaaattaaatctaaacacggccctaagtgtgatggtttatgcatgaaagctggtttctgaatcagattacctagctggtttctgggtgtagtggcaggtcggtggtaggtggagtcgtcagtacggctgcggctatagatgacgtcgttgtagaagctgatggtgccgcagggcggcggcgtccggcaggcgcacggcgaagatctccgccatgtggcgagtggagcagttggtcgtacgcggccagatcgtcggcggtcggggcgtcaccgtaccccgtcgccgccgccatcaatgaatccagacgcaaacggaaggaatccaaaaatcaaaaccagcaagcaaagtgcaaagaggaggaagcttgatggaatcttgtggagtacctaccaccttcctattccgaagaaggggaactagagtgactactcgaccgtggatgtctggatgtcgggcgagttcacaaggggtgtggccagcccatctcaacccaattaaggcccagccttcttacacaaagtacggtggtgtgaatcgaaaaggaataagttcactttgactcccttaaattaggggccgaatgtaatttgtatccctgcattacaataccagatatcttgacccccataactattaaaacatgtgtaattttacttccttgatggttttgaaaggcggtctcgttggcgttgcgcctacgtgacagtgttgacctgatcatctcacgtggcatttgacatgacgcttgagctaatatggcatactctctccttcccttcttccttctccctcccccccctctctctctcccttatctctctttctctttctctcccctttctattcaccttcatccttcccaagggagcgggcgttggagcggcggtggcggtgatgggcgggaggacgttggagtggcaacagtggatcgcctccagctcaaatgtcatgtcagatgccacatgtgacgaggactaggtcaacaccgccatgtagacgccacaccagcgaaaaccgccctccaaaaccaccgagagagtaaaattgcattggttttaatagtttcagggtcaagttatccggtattgtgagtcagggatatgaatcaaattcggctactaattaagggagtcaaagtaaaactattccaatagaaaatacgtccactgtccttttcttttgtttgattagaagaagtgcccatgcgttatacaccggataaaccaaaattacaacaaacattaggtagttagagtttaatattcgtcatgttcatctgtcaggcaacttctttagaataggatatttcttatctgctagttacaacttcagctgaggttttgcaaaaaggaaaaaaaatcccgcgtactaaaataggtccagtgacatatataatattcatttgctacacattttcattcacttcccgttccaatatcatagaattgtacaccataatcttggcatgtggaatgcaatcaggaaggaaagagaagatgaaaaagtcttgaagagagagcatgttctttttttttttgaaaactcataaatttatttatttttaagagtattaccgacagagctgaagagaaatatcatctccaatacatcaccaaaaaagataaaatatacacaacgaaaccatccattcagaagataaagccaattgaactaagaaaaacttcctccaaaataatccaaacagcagtaatgaatgagatcgacaaggactgcggcattgccacgacgactacgtgagcatgttcatcaaaaggttaagcaagatgcgcggtagtgtgaaaaaagagagagcaattgttcaatgatagagggagacgatgagacatgctaaaatcctaggtaagttgagaggagaggacgagggaaacaaaatcagaatcaaaccccaacacatacatactacgaatgttattccattatccaaaaataaagtaccccatgtaactgtatagctaccaaagcaagattaagcctggtatagatcacaccatggacttacgtacgtacgtagtacgtagaattgattagcacctacagaaattagtacgatcaaacacggaccaaacagacggcacggaaacaaggatacgtgatgagaatataagtcgctcatgacccagaagcccaaagtttacaaactcatcgtcgtcttttaccccttttcttatcggtttatcttatttctgctgtaagcctaagttagtatctaaattgacggtctgataatctacaacacaatactaatctggtatgtccatcttatttgcttgggcctcacaaacatattctttgttacgctagtccctttgtttttttctgtgcaatgtctaagaataagaccatataattaacgcttgtatattgacgaacaggagtttttccattgtaaatgagtacggagcaatcaacgaattccggcgaaatagaagatctacgtgaccaaattttcctgctcatcagactttctctgttcttctttgcaaaatatgttatcataaactttactttgcaatttttttaatatatatatatgcatatgggccgagcaatacaaggtaaatccatccatatatgtgggaccaaacttacagctcttactaaacactggagaagtgtttcatcgtacaactatcgtacaaaacatatcgtacgtatagcagccctcgtttatcatcatggaccataagaacaagtttaatagttacccatatgttagctattgacgcatcatctataacaaatctaatagtttaacacattcaatagtttcatttaacatcattagtacttggttcatttatcacgcacaattttttggagctagtgctacaacatctagattcgtgggtcctatctagaatcgtagtactagtttacattccatccagtactagtttacggttagctaccaagaaatctgaatatccctgactctctagacttggcggtcggtcaacggaataatttaccttgacggctatcaggctatacttcgaccgcgaaggacatgctgttttgttttcttgcagtgaatttaaggttttggaggaggaaaggtttactattacacatgttaatagtaatgatgcatgtgtttgaaccgagaaaatgtgcgagggtcgacatgtgaagtttctctttggaatatggtaagaaatgataaagcaatggtgtggttgtacactgttacaaagaaatactgtcctgaaataagaatctaaagtacgtatccactatcaaagcgacgattttataccgtcctcaaataaaagctaattttaacgtgtcttgtacagttgtacgtagcaaattctctcaagggttgtttagnttgatgacatattttgtcacagttgtgattgtaaattgcatggtttgaaaatatatcattactatttacttatttataaccatatcatcccactatatctaaaattgatccccactactatgacccaccacctatcaattact

SEQ ID NO: 77935 - DNA, 5461 bp, Oryza sativa
ggcggcttccactcggtcagaccggcagatcaatctcagtcagaccgacttccgtcgatttcgagggtaacttttattttcgctaaaagttttcggtttttggatataccaaccattcacccccctctggttggcttagttcttgtggattcgatcctacagttgccccctcacctccctgacgtggagccaacagcggctgctattcccccctcctcggcgtggcagtggcagcggctgctcccctcctcggcgtgggggcagcagctgccctcccctccctggctgcccactcacctccccgacgtggagccgacggtggttctctccagcgtggcggcaattttgatttgtgactattttgaggattttgtgaattgggatgttgatttgtaatcatcatacgatggggattaggtttcttggcgatgaaattcatgagctctagattaaatttgcctttttgtgttgtttttgttgtcttgttaatttattgatttggagatctaacttggggtttttttaaggactcgaactcaaacgacggatgaatcgaagccttaagatttttaattttttcattaacgatcacgagttgtgtgcactttggaaaaagttcgcatgacgtctcttatgttgtcaccaagttataaaatcgtccgtgaacccaaaaactagatatatgagatcccttaatgtacaaaactaagacactatgggtccttggatagtattgacagcggttaggtccttaggcagtattgtctgcgattaggtccttaggcagtattgattgcggttttatccaatgtgacagcttgagaattgcaatggaaaaggggcgagcgatcccgttggagacgtgagtacgtgacaccgtccctcgcattgcagtatagaaaaatatagtaacaacttatagcactaattagttcctttacatctaacgttgaacatattatgaacgaacctgcatagactgtaattaactaatactactacctaaccggtaattaactaagacatggtgcataactgcatatacttaaagttgctcatcgatctaatacatgtaagaataggatcagagccattgttcctcgtcctcccggcgaaactcctcttcttcctccggcgtgaagtcgttggtgatccccaacgtctgcctcatctgctccgacgtcttgcccttgatcatgtccgccaatcgctggcatgccaggtccatcagcccctggatgcgcatggcgtccgccgccgtgagcaagctgtacagcatgtggttgtccaccaggatgaactcgtcgtcgaagctcttcatcatcagctcctcctcctccttgctcgtcttcgccgtgtcggcgttgatggcggcggcggcggcggaggcgtgcttggtgcagtactcgaccaccttggcgaggacgtcgccggcgacgttggggagagggatgccgttgatggcgttgtagtcgtccttcttcatctcgtcgagcaccgtctgcgacagcctcaccgccgcctccggcacctcgaagcgagctccgtccgagctgatcagcgtgaccatctcaccggccgcggcgttggtctcctgcggtgctgcgggtgccgccattgatcggtcgaacacggacgacgctgagattgatggagaagaaaggttaattcctctcctcctggaaggctgtaattaaaggtgattgcgcgcggcaatcaggttagttagtggtctctatttatttcacgaattcggctaggtatctaagcggaatacgttgcgtatctccttgtgtatgaagaaaccacatcaatcaggattcgtagtagaattggttgcatatgcaacataatctcgattggactctgcactttatctgtaagccggttggtttcatggaattaacgtattttgatcggaattggcatggaactgaacctggtttttagaaagaggtagttatagaagattgacatacgacaacagcagcaactaaaacacatcccaagtattgaatcgttcaagtctcatcgtcacttaaaaattgcatagcatatacggcgtgtaatatctacagctagaacaaggtatatctggaattattgtaggtgggttcttcctgacacgtaaccgtaatctatctattattatatgctaaagtctattaaatttcctacaaatgcttaagctgccatgtgtcatcatataaacactctcaagtcaccacaggtcactctaataaaataaaaaaatctaaccgtcgatttttatttaaattggtggacccattagttcattagttttgaatggttagatttttatctttacgaggaaacaaaatctccctccgtccaacttacgtatagtacgatccctccgtagcagtgtacttcctccgtactcgtaaagaaagccgtttaggacagcgacacggtctccaaaacacaactttgacttcatgtttctataaaattatttattgaaaagtgatatatgtatacttttatgaaactatttttcaagataaatctattcatataatttttacatttccaaactcaataacttgagagttattcatgatttatattcctaaggtttgacttaattataaacattgtcctaaacgacttcctctacgagtacggagggagtacgtactatattttttcctcctcctttttataccatatatataataattaaaattgaaaataacgggcctaataagcccatcaacctactaatccccactccccacccatcgagccatttgtgtacgtacgcttttcttccacctctcctgcagcggataaaaaaaaaagctgcaagaaaaaaggaaaaaaatgcatatatccgtatgtacccaagaaaaaggcaaaaaaaaacacatacactaattgacagaaaaaatacgtacgtacataggtacatacgaataagatatagaaaaacaaactatttattcttatcgttatatcgttatagttatagatgactatttaaaacgtggcacatccatcttatctctaatattaacatattaattatattttaatttaaaaattatcacatagaaccatattatactcttttaggcctttcggatcgatctttatagatgactatataaaacatggaacatctattttatttattaaaaaaatattgtgtcacatattaattatattttagtttaaaaattatcacagcaaccatattatgaccctctttgtttaggcttataagcaaacttataagaaaaaaatccgggcctaaacaaacaatcagtgttttcgtttgtttttttaagccataaaccactctaacactattaatataataccccgtatattaaaagatatttaggtttttttagtttgggttgacttgttaaaataaagatgttaacagaaataaataaaagaaaaatatttttagaagtgggccaacatgagaaggcccataaacccagcccattagttctccccctaaaacctagagagaggaaccgaatccacctcccctcatagtgccgccacccctcaccctggcccgcgcctccttcctcccttccttccatctacagcaaattgctctccctagatctccaccttcatagcttggatcaagaagcgaagtagaaaaacggaacgaggaggaggagaggagtagaaggaggggttagaccggagtctcccgtattgtctcctcacaagttctctaaagaaactataggtgagacttatctccttgttgtatcagttgttctagcatggctttagtgcattaatttgtagttagggaaggctagagaaggagtttgggtagttgtggttcggtttgttgcagttctgcatgtgggcagatttgcagtgtttcagtatttcgatgtttcggggctctaaatgttattttctgtgaaagtgtataactaggaagttgtagataatgtttggatatatcttctagccaaagggcgtgattttatctcaagtggtttaggagatataatttttttagtatgactgttgttttttgtcataatctggatactagtagattgaactgtttttggaggggttaaacagtggaatcagccaggccgcctttagacaaagttgtagaggtttttcttagctttccatattggtaaagtacaccctgattgggcaagtagaactccagttatggttgttttagtgtggacagtctgaaattctagacagattctgaagcctgctttcaagcgcatattagtcgatttaaatggtagaataaaaatatgctttctacatgaaagttgtaggtattgttctgtagattttcaaaatgtatacattttcagtcatagccttttcatatttcaagatataaaggtttgaagcagcagttttgtgtatagtccaagcggcgttcctagttattgagttttgataggatggggcagtaggttcacctttttcattattttacacgcatgtttgaatatgtgtttgctaaggttttgtttgtgattaggtggtggtgcatcagatcgtgcatgataccaatcctttgttggaggcaactgcatgacgaactaattgtgtgattcatggattgtttactctatctatttatttctgatatatttcaacgtgataagtaactgcttatgttcatattattgttcacgccatttagatttcaagttgatcttatgcgtacgatgttattcttgttttaataatattgattctggttctgtttaaataattcaagttccctggttgccatggatgtgtttcaatttggttctttgattctggtttcaattattcaagtaccatgcgtagtcatgggaatgcaatttggttctttattcaagttcctgtgggtaagcgctgatcacgcttactcggctttgccggcaaatgctaggatgtattcactattgtccgggatggaaactactatttcaattcatgccagcccgggatgggaactactatcttctttgacttggtgtttgaaaatgtgtttcctatcaaagaaagaaagccttatgttcatgctttattgtcaatgatgtgtatatgtgttttctagttccatactgtacttgctgagtattttatgctcactcttgtgttttatttggttttaggtacgcattgagaccgacatgtatgggcgggaagtagcacccctatatacacatctacttgacactatcaaactatattgcttaggtccataatgacacttaaattatatcctggtttggtcttgtaataatcttttagatttctaatagtttcttccccatggattataaggatggatcgtattatgggaatgatattgctattagttcaacttataattgcctgttgtggatgtctgtatttataggggagactctgccaaaatttctaataattttggaagttagtggtttgagtgttctttggtggg

SEQ ID NO: 77936 - DNA, 967 bp, Oryza sativa
cgccgtcgccacgccgccgccgtcgccacgccgccgtcgccacgccgtcgccacgccgccgccgtcgccacgcgtcgccacgccgccgccgtctccacgtcgtcgccacgccgccgcgccaaccgccgccccgatgccgccacaccgccgttaacgaacgagaacgagaacgatcgaacgaacgagagcgagaacgaacacgtcaacgtacgttgccgcgagaacgtgaacgagaacgagaacgatcgaacgaacgagagcgagaacgaacacgtcaacgtacgttgccgtgagaacgtgaacgagaacgagaacaagaacgatcgaacgaacgagagcgagaacgaacacgtcaacgtacgttgccgcgagaacgtgaacgagaacgagaacgagaacgatcgaacgaacgagagcgataacgagaacgatcgaacgaagacaagtgagaacgagggaacgaacgtgaatgagaacaagcgaacgaacgtgaacgagaacgagcgaacgaacgaggacgaacgttaacgtgaaatgcaatatatatatatatatatgtatatatatatatgtatgtatgtatatgttacttcgcatttatcctaatacatctttttgtatcttgcagaaaagacgtgttgtcggagtcgtccgtcaagcctgagtggaagagctagccctagaaggaattggagcaggcaagtgacgtagtaatataaatgattgttatatttgtaatgcaattaattaagattattagacctgtaattagacttatcatataagattgtgtagtgttctaatattatttgtgttttaatataagattactttatttgtaattagacttagtatgtaattattgactacggaagtggtgcgacaagtagcaattgactattgtagtcttaattagacttagcatatacgcacgaaacacttagcatacatgactattttagtctta

SEQ ID NO: 77937 - DNA, 788 bp, Oryza sativa
  unsure (1)..(788): unsure at all n locations
ccgcgtgataactactactatanggcgaattcgagctcggtacccgaggtgagtaagtcttgtaggatcaaatcacaaaaactaatccaaccaggggggtgaatggttggtatacccaaaaaccgaaaacttttagcggaaataaaagttaccctcgaattcgacggattgcggtctgaccgaaattgccctgccggtctgaccgcctggttgccgtcggtctaaccgagattagatcttcggtctgaccaccgagatcatctgccgcttgctgttgccgccgccggtctgagcgcctcgctcccgccggtcggaccgccgcgatgccgccggtctaaccgccggttagtcgccagttaaaccgccgaaacccggtgaaacacaaatcaaagaactcttaaagtggatgacgactttattacttctctctgtgtttacaaagtgcaccaacagcactccttacaaaaatttcgactaaactcgaaaccctaactcaaaactcaactcaattgctctcaaaagcgataccgggaagcctcacgctccccctctatttatacccgaggtaggcagcctaaagccatgaaccaaactcatactaggagtcctaaacaccttaggaaaccctctagtacaagatagaaactttagataaccaatcgtaccaaatttggactccttncaaaatcgactncgcattccatacgcacacaataactncatcgtatgccatatggaatctncatcaaccacgtgcatcaactctagccttagtatnctgcatgatc

SEQ ID NO: 77938 - DNA, 7077 bp, Oryza sativa
  unsure (1)..(7077): unsure at all n locations
acggcttagattgaccactcgataacaccgggcgaattntagctcggtacccnnnnnnnnnnnnnnnnnnnnnnnnnnnnnnnnnnnnnnnnnnnnnnnnnnnnnnnnnnnnnnnnnnnnnnnnnnnnnnnnacttgtacagtataaagtcgaccaagaacacaaaagattgcagcatacaattgggaaataaggggggataattggatcacacacctgggtccttgatttgtttctcaaatctttctacccaatgatcaaactaacctagctagctcctcttcttgatctttctcttcttaacatctgttacgagcaaagcgatcacctgtttgttcacaaaaattgtttgatcaacatgaatagagattataaaagaaagaagagcacagatgcgctagttccagatatatagaatgttaggaaagttaatctctcggctaaggaaatcgggagaaaatcacgcgttatcgttttccacccgttaaccagcgtgattagctaaatcaaatcacgattaaatttccttaattgcacgcgcaataatcggtagcgctttcaacgtttccttttggagcagcccccgattccctcagcgcaaaataaaaggggaggccggcccgtgagaaagatgacgatctcactcacggttccaatctccccgacatcccaaaaccctaatttcccgattctcagttgcactggaagggattcgtagtgctattcccggacagtgtaggtggcgaccggaaggccgctgccactccgcaggtgatcgccggtgaccttttcgggatcaagccggtgtactcactgctacgaccacttctacaccgacaattcgcgaggtggttcgaggttctacatcctctacatccaccccgaaccaagcaagaacaattgcaatggcttcaaacaacggtcagttatcctaaattccgcattagggtgatcatgttaggcttagcacttatgtcttagtagattcgcaaagtctacatagagtaccaattttgtctcccgaattcaaacaaaaagaactaacagaaattgggaagagtacagcccccaattttagttacttcttttccgaggtagaatgaaggactaaactcgcttttgcggctatacgctgcttccacgcacaagcgctcagctaactttctgagaaattacttatatatatagaggaactgatgttcgttcagaacacggtaggaaattaaaagaggccgctgttttgccaatatataggacaaaggcctggtttagttcttaactttttttttttcaaacttctaattttttcatcacataaaaactttcctacacacataaacttccaacttttccgtcgcatcgctccaatttcaatcaagcttttaattttagtgtgaactaaacacacccaaagaaaagatgccagtaggaattgttcatttcaatccatatatttaactcaccagtcagcttcattgcaaagtcagaccttcttaaagtaagagtgtcacgaaactgagagggaacgattggactaatttatattcattgcttaatagtgatagacacaatcctatttttatatagatgaaataactagcctctaagtgaagactcgaactaatcttatctttacctctaattgacatcttatcccaaacagtgccacagtaccacgagacactgttcatccaacagatttgggctcgtgggcctcggcctctcagcccgatgcccattatactacacctctcggttttaatatggacttctaaaacttagacgactccctaaataaaacataatactactaactaatttagccttttacatcttggcttttgacactgcaaggaaagacaatgcaaatatatagatctaatattatgaatgatagcaatatcattgtgccaacaacacccacgggtggacctcatccagatgctgttacgagaaggaaaaaagttatctatgtcctgagtgtgtaaaaccagcaagcttgatgaccatagtaatcaacagaggtatatatatatatatataaaaagaaacataagataatatgccacttggagttgtccatttcaatccatatattcaactcaccagtcagcttcaatgccgagtcaaaccttttcaatataactaggatgatagcccgcgcgagatgtgtatttgtctgaaagcagttataacaaaataaactgaaatgaaattaaagtaaggtgttttctatttttaactcggtgttcattgtatatctttttttaagaaatctcgataaacttttattggcaataaatgtttttttacaaccctgtcaattctctttttaattgattcatatatatatgcaattcattatgcatgtgaatcaataatgataacttctttaaaaaaatatttgttatattttgaatttagtgattgagtgattctaatttcgaatttgtttcaaatcaaattattgttttattctagatttttctttttaaggattttaatttatacttaatttcgtatcgtgttgtatttggactcattttttaatagttattttattattccaaatttcagatatttataacttatatttttatatggactgttgatatttcatattctacatggaatcttgttatacattttttatagttttattgggttttctaaatttttgaatgagaattttaatcaaattgctatttttctgaatttaattttgaactcctcagcgatagaaatgacactgttttctagtacttgtcggagatgcggaacgtctccctccggccctcatctcagtcctttgtgcttcacataatcatgtagcgtgctattaggctaagaaagtcatggaaagtcgatgctagtgcttcgatcggtgtccacctcactaaggttgtgttcttcccactcctttcccaacttagctcccttgtttttcgtgcgcacgctttccaaacaactaagccgtgcttttttctaaaagttttctatagaaaaattactttaaaaaacatataaatccattttataaaataaataattaatatttaattaataatattctaatgtaatgagctgcttcgttttacgtgtgtgggagagattagctcccaaacccatctaatgaacacaacctaataatatcttgcaactccgcctccgttgagtttaggcccagagtatgtatcatggttccaagctctttggtggtgattgaatctggaatttagactcaaatatttgtagtcagaacagctacgttatcaaaattttatatagtaaatatgggtaaatggatcttgaattatgtatttaattgtaaataacacaacaaaatgcaaataaattgagaaaaatgcatgtaactttgagagtcatgatcattaactatccgattattattatttatacattatgtgtttgttagaaaataggaaaagttggctcgaaaataggacaggagagtgggatctccgaggagagttagagggttgaaggactacgtacttacatatgtgcccacatatggcggggttgggggtactggatttttttaaagatctaatggttaaattattgggtccacctatttaaaggaatatcaatggttttttttctttttttatcaaaacttttaggattttttttctaatttattagatcgtcatggcgtcttaagaacatttgtaaaacgccatgtgacagtttgagagcgtttgtagggagttcaatgaacttttagtatatagcagatgttaatggattttcagtatataatatatagatagatgtgtaaagaatataatgcagtaaactttcttcaaacattatagacgtttacgatgatgcagtctacatttgcaaagttataattgttgatttctaataattaatgttatttcaattatccttaggaattataaaagggaaaggcgagagaaatacaggtgtgattagggtgaacagtttcgcacgtacatacgcatgtatttcatatgtacggacttatgggagaggtggggccattgtatgcggtaagattaatctagtccaacgtttataatatcgaacccattaatttaagtgaatattttaagggttagatattttgctttttaaaaattttctattatttattagagcgccatgtggagcataggagcatttgtagtgatgccacgtggcaacttaggaccgatttaagtgaacgttgatggacaaatatttttttaaaaaaataatgcaaaataatgggtacataatattatataatataatggtggaaactttattttcaaatattgtagagctaatttatttatgtctacttgtagagatttatatgctgtatattctatatttgtaaagtaatttttattcaagatttattatcacttattattattattattattattattattattattattattattattattattattattattattattattattattattattattattattattattattattattatcatctcaattatatacctgaaataaagaaagaatagtaacgtacctagaaaaataaaagaaagtttatgtacgtacacaccttgaacgcatgcaagcagtaccgtacctatatggatcggatcaacacaagctccttgaacgaaagccagcaatacatacctatatatggaacggaacagaggagtacttttgagataaatctaatctaacggtttataatattggatccaccgatttaagtgaaaatcgagagatagatattttgcttttttttctcagattttctagaattttctaatttattagagcgccatgtggcggcttgagagcgttttgagaaaacttaatggacttttagtatataatagaagacagatagatagatagatagatagatagatagatagatagatgtaagagtgtcatgacccaaatttgttatgagatggtttaggaaatttgtgtgccgaattctcagctttggttgttttcccttgacaaaccacagcatgactaggtagctcattgagcttgtctcggatcacagttagaattgtgttatcccaatttggttctgtcgcattcaaaaaataaaagatatatagttcagtctattgaatgcaccatggagttgatagtgaactgcactagattaggagttttctatgactttgtttggttgataatgaggatttttattactgattcttccctttttgaataaatacaaatcaacctagtatctttctgtacatgggtttaactttgtgacaggaaaatattaaccttcgtgaatcatccaaagttactgcatgtaacaatttctactactccgaaattagagcaatactggcaaatttatctagcaatatctgaaacaatttctagcaatgtttaacaaatttatctattattctagttaaattattttgtaattgtttggtttgcattaacaaatattgtcatagcgttagcacgggtaaattactagtattgttgtcattcataatattagatctgtttgtctttccttgtagtgtcaaaagccaagacgtaaaaggataaattagcattattatgttttatttatggagtcgtctaagtttagaagtccatgttgcaggtcgacaatgaactgctcaaaaggaagggttgatgaccaaagcaatcaatagaggtatagcaaaaaaagaaagatgagataatatgccacatagagttgtctatttaaatccatatatacaactcactagtcagcttcaatgccgagtcaaaccttttcaatataagagtgtcatgacccaagagggaaatacccgacaatccttgatgacgaagaattatagtgttgaagttcctgcgcatgctccacttgaatgcttagcacatgctgcacaagtatagtcttgtagtttgtggtatcgatgactcctaaaatctccccatcatcattttccatctcaggatcattggtttcacctagaagcttagcaacaagagaatattcttcctcaacatcactagaacttacatatccaccatcatccgtagcgatgcacgcatactgacttgtacaatccttcatgacatgtcacatgcccttgcagtggtggcatatgatcctaattcttcgccccgtagaagccactgacgaggagcttttcatgggtacctgcactttaatagacttactcacctcggtagctcatggattcatgatggaacggggacgggtgtcgatggagcctggttggtggaaggcacaccagagcgtgcaagaggagataccgtccttgttgaaatagcatttccaaaacggtactttgttgattgttgccgttcctgcaattcttgttctgccaaacatgcaagtagaaacaatcttcatattctttatagctaacaacatcttgaatctcacggttcaaccgcccatagaaacttacaatactagcctcttcatcctctattacatcacaacgcaaacaacttattttgtaactcctgataatattcttctacagatttatccccctggtctgagcgttgcaatttctttaaaagatcacgtctaaaagaaggagcacaaatctagtgtgcatatagttgtctttaagagcaggtataatagcagactataagcaagctataaacacatatcaagaagataaaagaggagagagaagagcagcgggctacagatttgtagccagcaacagcacagactccaagacataatgtatgtgtgacaagtgggatcatatattaatagtgtagtatatgtttatagataactattgtatatattggctattaaattgaccatagatgatttggagctaatagttggttatactattaaacttgctctaacgcttctcatgttgtaggtgctagtccatcaatacttatttgagtccatcacaatgttgcaaaatcattaaattcactagtagcttgcctaaccctatgctcatcaggaataaatgtgcactaaattttttatctacagtcatttctcaatcaaaataagcttcagcattataggcaccatgaaaagagg

SEQ ID NO: 77939 - DNA, 3976 bp, Oryza sativa
tctttctcaatcaaaataagcttcagcattataggcaccatgaaaagatggaatcgtaacttaactttaactttagcatatggatcatcacacacattatgaaaattacctccaatacctcgacgattgaagctcagcaagtttctatcaatattatcctattttagattcaccaacctgtcgagacaattattgatcgttgtaagattggcattcagcatgcgctggaacctctcggtagaggtttgaaccatcctctcgatcacaacagtcatatctctgttgatagctccacattggtctttgaggactttgacaagttcctccctgagcacgcagtccttaaatttatcgttggtgcatgacatggttagtagaatatagaaaatagcacaaggatattatccctatcaactactaggtgatgagagaaagacacttgcactcaagcatcttaccacacgcatacacgtagcaagagatgcaaccagtggcgagaagaatcacagtaggaagtatagtgctactatgcatttttggtggttatcagttgagtacttgagttattttatcttggacctccttgcatcattgtgcaggaagtacagccatcagtaggcatgaaaattcgatctgcattagcaaatgaggtacattactatggtttcctttcagccgtgttccaaagtgaatgcctattgatataattttggagcaaaatgcagggaagttctgaaacaggaaacaccgtagatgtcaaatcatctgaaatgcaacaggtggtacattgcagcacgcaagaattgctaccaagtactactatccaagaagaggtatctctttgcaaggaatacaccattatctggttgcagttctgtattaaatacgtagtgcccctgtcactttgttcaggactatgccttgtcaaatatggaaccggaacattcatgtactgacatcagtgacatgggattgacctgctcttctatcactggtatagcatcactcttattatttgttgccaagttcattacgtgaatggaaagtatgatcacatcattacctgactggcactcccagataaccttgctgagaagactcctgccagcagtacccaatcctccccaaagttgagtgaccaactgagagagatttcaaactcattgaagcttcttagcactcggccagtgagcgtgagggcacaaacgtggggcatagaatgcgtctagcgaatcaatacgattgcaccggagccaaaaactcctgaagtgcatttgaaatttgagcaagcggaagatcccaaggatatacttacagcccgcagcactgggattaaggttaacctgttttttaactcactgactcattttattcgcttaatgtgtttgtaccttcttataatcgttttgcctgatgaattctctcttgttttttctgccccacagaaatctctagttcaagaatgcttgacttttctcaacagtgctaataagtgagtttggcattatctttacaaccgacttcacactactgcatttctaatgcatgtttgtttctgtgtcttttgcagggaacaatttgtagggtcgaatcacagcaactaagccaaccagggagggggggttgaatggttggtatacctaaaacccgaaacttttagcggaaataaaagttaccctcaaattcgacggatcgctgtttgactgaagtgtatacgccggtctaaccgcctgatgaacgttggtctgaccgagatcgaactccggtcgaaccgccgagatcgtctgccgctccctgtcgccgccgccggtctgaccaccgtgtgcccgccggtctgaccgctgcgatgccgccgggctgaccgccaaaacccggtgaaacacaaatcgaagaactcttaaagtggataacgactttattgattctctctgtgtttacaaagtacactaacagcactccttgcaaaaatctcgactaaactcgaaaccctaactcaacgctcaactcaattgctctcaaaagcgataccaggaagcctcacgctccctctctatttatacccgaggtaggcagcttaaagccacgaaccaaacccatactagaagtcctaatcaccctaggaaaccctctagtacaagaaacaaactttacataaccaatcataccaaatttggactccttccaaattcgactccgcatcccatatgcacacaatacctccatcatatgccatatggaatgttcaccttccacgtgcattgaattctagccttagtatcccgcatgatctctgaccactacggatgtcgtcttatccccgagccgactcccgatccatcaccgcaaatactctcccggcatcttgagtcacctacacatagaacaaacaaaagaaaccatattccgagaccaaactatccccaacttgactcattagtagcaaacaacagtattacatacgcatagtatccatctagaagccataatcatgaaacaatcacggatatctaaacaaacaacccgaaaccgaaaccgacacagagtcggccggtcaaaccgcgggctgcgccggtctgaccgcgtgatacatgccggtctgaccggaccacatccagcagtacctgtagatcacctgtgaaatccaatcatctccaaaaccacttcgtgaataaattccaaatatcaaaactaatatctccaatgccaatcgttcatcatagaataacaataaaaaacacctttaattttacacaattaaaaagcttaaaggtttgctccgaaccatatcgtggcagcccagattgcttctttcttactattaacccactgatacatgtttagggaatcggagaaaaaagggcaaactacatacttgagcttcgtgaggagtcaccagagcggcagagctatttaaagaggtgagcactctagatcaacaagggagtaggcattaattagacccaagcgaccagaagttattacatgacaatgcaacccagagctgattcctttgcttttgcagataagagcaggtacaatagcaggctattaaccggctataaacatattttaatgatataaacgatgagagagaagagcagcgggctacagatttgtagccagctgcagtacggacttcaagacacactgtgtgtatgacaggtgggaccatatactaatattatagtaagtaactattgtatgaattggctattagattggctataaatgaattggagctggtagtgggctgtactattagacttgctctaagtgatctgagagacatcatcggaatgaattcaaaagaggtactggagaatctgattgcaatgtgtacatttatctatgttctttagggccagtttggtttgaggcctaaattaggcttgccaattttttggcaacctcaacaataattgtgtatgtttggattgaggccaaattttggcatgcctatataacataggccatttcaatagccaaattagtttaatttggcttcaatccaaacatatgttggccttaccaaaatttggcatgccaaaacttgccaaaatttgacatgccaaattttggtaaggccaacattggtcacgaaccaaactgacccttaatcactggaagatagtttttgttttcacaaacattcactggattacactgttactccagctgcttcatttgcaaactccatgggttttggatgtactaaaattgccactgctttgttatcttcaccagataaaaaagatgatgtccgggattattgactcctaggaaagtacgcagcgctagtacgatggttctcctgtggagtgtccatatgcttctttggtcaaaggtgtcatgtctttgttttgtactacctccattttttaaatagatgacgccgttgactttttctcacatgtttgaccattcgtcttattcaaaaaatttacgtaattataatttattttgttacgagttgttt

SEQ ID NO: 77940 - DNA, 12157 bp, Oryza sativa
  unsure (1)..(12157): unsure at all n locations
gggcgcgcagtgttaactcgtagatcggccgcccagttgtgacagtgccttggacatggatccaccggacccggtggctttatttttacccatacaccaaactttgtgttgaggtttttgccaagttgggtcaattaggcgccaagggtccgattccatggaatcgggtataagagcgttggtaagcaacgtggtttaacttcgattcggtgagggtattggggggtactttttcttaatgtgggtaatgaatcatatggttgaatttaaggtttcgattcccttcttttcattgtgcctagaatgctgaagcttattttgattggaaaatatcggtagatgaggagtttagtgctctttattccgggtgagcataggtttaaccgagctcttagtgaatttaatatttttgccccagtatggtggactcaagtaggggcggtcatctattaaaaaacggagggagtattttgttttatccagttgcttcttaagagctcgccgtgtttcgttccaaaataattcttcaaacttcaaacttttccattacatcaaaacttttctacacacacaaactttcaacttttccgtcacattgttccaatttcaaccaaactttctattttggtgttaactaaacacagccagcgaatgctttggtcaggagttggcattctgtgagagaatcagtgctttgcagtggtttgctgctattatgtgttctttgtaatcatcatacagtgtcgtaccaatattgataatggtgtggcgttaatgtgatttcctctcttttgatgtctgttgctattaatgccgatttattgttttagaaaaaataatgagtcgatgaatattcctctttgtcgatctgagaagcacatttctagttgttttcgtattccgataaatattcgttctgatccatatcgtttcgtttttgtattcgataatatttgactctgtttttgtatctggggtttcctgttttgattttgatttctgagaaaaatgaaaacggaaatggtagaaccagtttctttccgtttctgaaccctttttatcccttgaagaaaacaataaaataaagttaatatgggtgttggggctggtatggaaatgacatggacaagattagatattgtaaccacccatataaaacttgctcttaagatactatgtgctaggagaaagtcctattaagcaaggcagatgctaggacatatgttggatatgtagaacatgaattagtgggagggagaaacatagatgttaagtttaatatgttttttattccaaaatatagcaacctatactagaacatcacctattagtatgaatatgatggattggtcttgaatatgaaacattttgcctcaaaagatggaacattacacattcctaaaacccgagttttttttaaaaaaaatactatatttctaaatgttgttatcatgtggtagtatttcaacaggacatcatttcaagaaaacaaagccctatactccggtcctctctacttaatttcactcggccagctgaagggtgtctaatttggccgcctgcaggacaccctttatcacaagagcttttagggatcgaataagctcctatgtccgacctagaactatctcagggtcatatgtatatatggtccaactagctgaaaaggagaacgtgggagttgtggaagattaattgaacctgaataatctaagttttatcataatattatttttcctgatgcaacacacatgtttttttagtatgtatataatagtcttccatgtaaatctccacatcaactatggggtatcatccaaaaaaaatacacatttcggggtaacacccacaaattcagttcttgagattctcatctcctagcctacccatggtctgatcaggctgcactttcttttggctctctcgatccaatacacaataacacagtatattaccagatatatattctgagagatgattctccctgatccccaacataacttacgttggcatgttctgtgctgtttgcatctgaaatcatcttgaacgctcatcattatttatggcctgcacgtcgatgccaatgaactatcaaatccaatgaatataaacaatacatttcgtacttcgtttcatctttcttttcctacaacataactaaatctaaacaaataagtattctatggcatagtattataaaagttgagtcttggaaaagctagtatcggcttattgtgtacttgacagccaatggaaatcagtccgtttgccatagttgatgaaaatacggttaattgtattaccaatcatgaaattcacacgaaactaaatattacaaataagtataacataatttatgacatggaagcagagcaattctatcatgacaattttctgtgaacttaataagaacacaaaaaaaatcaaaaaatttaatgagattactctaagcggggaattaccagttttaagttttaacaaaaaaaaaaaagagttattccgtaggacgtaccagtcatgaccttaaaaggttgtgttatctccatcagcttggggcaatcttctatacgaccctgcactatttcagagacagatatagcaccaacaatagagatgaggtctggacacctcataagttgaaggctaagtcccttgagtttcattgcactcgccagatggctgttgtcgatgtactctatgcttggacaaagtaataagctgagcatccgaagagaggatggtaatgtcattctcctctgcatattcaacttgggacagtttctaatacatagcttctccaagcgagaaaaaaggtggagctcatgaactggcagtaatgctaattccttgcaaaataacacatcaatggtcttcacgaaaggcatataagcgggcataaagaactcatcaagactcaacagtgcattgcaaaacgaaatggtgactgttgaaagggatgaaaatactccaacagtgtgtatgttgcttgcctcagagacacagatggatgtgagggagccacaattatcaatacgcaaattctccaaggatggaagattactcatccaaacttgcaggggaatagatgttaagaaccagcaatgtatttccagatgtgtcaggagggagaggccacgaaagcaactcacaaagtgatctgtcgaatggccaaagttgccaagggtaacccttctaagagaagagggtaaagccaccaaaccttgccaatcaatgttaggacactggtggacatccaacacctcaaggtgataaatgctgtttgactcttctaaatcagaaaagagtgggtcaaagaatgataggctctgaatgttcctgcacccataaagttcaagtgaagtcagcactttcaggcagtctggctggagccagctggggcaagattgacctaggtaattctttattatcaaatgctcaagattccaatgaggtaacaattcaatctgctcctctgtcatctgtaattgttcatcagctatttccgttgtggaccattctaggaattgcttatctttaaccttgttaaattggaagccctttgattcaattttgtttaaggaaatcagatcactgaaaccttgagggtatcttttgaaaacacaacccttggcatttatagtctggacatgatacaggcaactaacagatgaaggaagggtctcgaaagtagaacttcccaataaaccaaggtaacgcaaatgttttgagttgcctatgctctcaggtaactttctcaccgttgaaaatttaaaaatcaatacacggatactcgggagttccttgaaccaacaatcaatcacgggagcgaattgtttaatacttcggtaagattcattgcatattagggaccgcagttttttattttgtgtgcaaatagtcactatttctgtacagctgatatttcccttggtgaatattgacagatggcgaacctttgatgggattttagctaggtcactcacatgttgtatgatgaagcactcatccttggagactagctgtgcagtatcatgtatcaagtcatgaattacgtacatatcactatagccagctgctttctgaaagaatgaccgatttacaaggtcattaaagcaagatgatgcatcttcagcctccacatacccttgtgctacccaaatgtctgctaaaaactccttgtcaaatttatgatcctttggatacagggcacatattgagaagcatcttttcatgtgtcgtggtaggtaaacgtaactcagtcgaagggctggcaaaatgtcagtctcctcttgttccaatttccacaattcacttctcaatatgtcctcccagtgctctacacttaagttacttttcaacaagcgtccaagagttttggcagccaaaggtgaacccttcaacttgggaagtatagctctaccaatgcgctccaactctggacgaatgtgctccagctctgggctattgcgagagctgttggatccgaatgcgcatagtttgaagaaatcccagaaaacatcattttgcagtccgttgagctcatagggatcactgttgctgactaggttagcaactttggaagatctagtggtgaccaaaatcatactgccctgaagaccattgcttaaagttctatgaaatgttctccatcctctctcatcttttaagacatcatcccacatgtcatcaaggacgagtaaaaacttctttgacttgacactatcacgtaaattaaccataagagtatcccttgtatcagaatcttgtgactttactccaagagacttcagaacatctcttgttaacctgtttacctcgaattcatccgagacacatatccagagtatgcagtcgaagtgattccgcaccactctatcctcacagatttgttgtgccatggtggtcttcccgatgccgcccataccaactattggcagcacaggcaactctgtcctccttgcttcagctgtagtgctgcatgccacaggtctgcctctcttgcgtccacgtactcctagcttttgcttcaactccttcagttctttttcacgaccaaatatctcatctggctcgtctaggacacggcatgtctctggtctgactaatcgatcaaacttctttggtgttttgtgaaagcctaaacccttggattggtcaaaaacctgctttagtctatttttgattttcattactttactgaagttgacactgttcaggaactccaaaaagggttcatgcgagtgatcttgccccaagttcttgctcgtgtccaccttcaccttgagagcatagtaattgtactcatcaaggaggtcctcggcatcgtacgctacatccttgatctggcgaagatgccagtcttctgtatccttgtggctatgccattcaagacgatcgatgaggtcatacattgtggatgtagttgattggatcagccataggtcgttctcgagattctgaagatcatcctcaatctggtgcagtggagctgttctgttgtctctagctgatgctgatcctacccctcctggatccacttgcagcagatgctgctgctgctgagaacgtacggcagccaagacacgtggtgcggcccagttgaagaactcacggaaggcattggcatcggcagcaagaccagctgctcccttcaatattccaacgatgtcgtccatagccaggttgagcactgtgcatgattataaacgcaaacaaattaagccaaaccgttaatagctccttgtacgaagagatgcatcatggcaaatatataagacacatgattgctcaggaaattctatctcaaataggcacatgattgcccaggaaattcaactaggctatctatctatctatctatctattatatacttcctccgtattttaatgtatgacgtcgttgatttttcgaccaacatttgactattcgttttattcaaaatttttgtgcaaatatgaaaatatttatgtcatgcttaaagaacatttgatgacaaatcaagtcataataaaataaatgataattacataaattttttgaatatgacgaatggtcaaacatacaaaaagtcaacggcgtcaaatattaaaatttgaaggtagtattaaaaatctatgaaactttctacaaacgctcctaacgcatcacgtggaagtcctacaaatgcttctaaaacgccacgtgccactttaataaacaactggacctattatttttaattattactattagaattgctttttccacctctctctcctatcccaccttcccacatccaagcatccccgcacgtacctacaaacgtacggatggataaaaaaatacctatggactatttgctaaaggaaaacaaatactcaatattagaagtttcagggttggacacagttattaagaaagtaggtagaaatgagtggtgtatggttgtgattggataagtagtgcatgtaggtgggaaaagttaatggtggagggttgtgattggatggaaagagaatgttggtggagaagttgttatatttttggacaaattctgatgactaaaagttgttatattttgggacgaagggagtaaaaaaaaactatttgtcagaaaaaataaacaaagaacatacaggtatgcaagtttgcacctacggttggaaaaaagaagcgatcaatcctcacttctttattttctctggttgttcactatttaaaattttataaagcatatgatgtatcttatctataaaaaatataacatccatattacctatatttaattacagaaagttgtgttttaataaccgacaactaaataagatccgaagccgtcaagtaacactccaataaattagagaaaataatagaaattatgaagaaaaaacaaaaaacatcaatttccacttatatatggtgaccaattgttttctactagcaatatttatgtatgtacatacatattgtttttaaatactttgatgatcatagttatatttcattaaacttcctgtatacgcttctaatccaccacgtggcaccctataaacacttatgattcatcacgtggagttctaaaaaaacagagaaattcaaccgtcgattttcattgagattaataaaccattattctccctctttccatgcctctgtgcggcgttctcactctgtaccaaacctaccattcctccgttcctttcttttttttcttatttgataattaaacttataattttctttatgggcctaaaaaattttatagatagacatcgaccgactagatctagcaagctcttactctatactctctttatagtacgttaaacatcataaaaatatttctaaataaccacatgacacactaaaattagagaaaataaaaaaataaaacattcgaccatcaatttcttcttaaaactatcacatgatataaaaaaaagtttgagatttatccacgtcatcatgagtaaaacttttatttccagtatacctctacaaatgcttgtaggccatcttatagcgatggacataataaactactatgattgttttaatgcctaattcttttaaaaaaagaagataaaattgtataggtattgcaggcttcgcattgaagattatgcacaaacacaccgtgtaaaccaactaacacacacacttttgaagaccgtgtatatatatattgggagcaagaaaaaaaaacataattctaagacagttatactcttaagaccgcaatgtagcattgaagcttttacacataaaactattttagtggagcacttaacccgtaagatagtattgaatcaatatactcccttcgttatagaaaaacatagctcattttacatcataatgatatttttattctttcaaaatttttatatttatcttcatacaagtcatattaaacacaccaagagacagataattataattcaattcagtaaattctatcctttaaagtaacttccatgggtttctctacaacctgcatgtataagcctctaaggtggcaatataaaataagtagcctttcttataataatattattaaaagttattttttcctaatatattattattttacgattcatgttggctaggtcttttccttaaaaagaagcgctatataatatatgtatatttgatcaattaaaaagagggctagcaggatggtaaaaaaattaaatttacaagcaataaaagtttctcgagtcttcttaaggaaaaaaaacttaacaatgaacattcaattaaaaatgaaaaataccctattttactttcaacttactttgttagaagtattttcgaaataaaataatatggatgcccgttagaagtattttcgaaataaaataatatggatgcccgcgcggatgcgcgggctaccttcttagttatatgctaattgtctttcacttaaattggcgggtccaatattataaaccattagattcgattaatctgaaaacaaaccatacactacatgaacggtaccacctatcctccttccccgtaggaaatagaatccaacttttaatctacccttaatttagttgtcacccccatcatgagttcgttagaagattcaatcacaggaactttgagtcccttgctcttagcgattttcacttgtaaccatattgcaaggtatatgtgcagatggtatgcatgataattagctaggagtagtttattactttgttgatacaaaagcaattcaaaacagttatcaaattagtctttcttttattcaaaagtcgatgaatggttttttatatatattaagaaaaatatataacccatgaatcattttaaaatgacattgtccaatcttcagtttgcccttaacctatatataggagataattggatcacacacctgggtccttgatttgtttctcaaatctttctacccaatgatcagactacctagctagctcctcttcttgatctttgtcttcttaacatctgttacgagcaaagcgatcacctgtttgttcacaaaaatcgtttgatcaacatgaatagagattaggaaagaaagaagagtacagatagagtaccaaatttgtctcccgaattcaaacaaaaagaactaacagaaatttggaagagtacaacccccaatttcagttacttcttttcctaggtagaatgaagggctgatgaactcgcttttggggctatacgctgcttccaagcacaagagcgctccgctaaccttctgagaaattacttatatagaggaaccaggatgttcgttcagaacatggtaggaaattaaaagaggccgttgttttgccaataggacaaagaaaagatgccagtaggaattgttcatttcaatccatatgtttaactcaccagtcagcttcgttgcaaagtcagaactttttaatgtaagagcgtcacgaactgagagggaacgattggactaatatatattcattgcttaacggtaatagacataatcccatgcgcagatcaaaaacagcgcattgacatcttaatatattggatgaacagatttggcctctcagcccgatgccttcttttgagtagttcgctctcgagctgaaatatggacttctaaaacttagccttttacatcttggcttttgacactacaaggaaagacaaatagatctaatattatgaatgatagcagtatcattgtgtcaacaacacccatgggtggacctcatccagatgctgttacgggaaggagaaaagttatccatgtcctgagtatgtaaaaccagcaagcttgatgaccatagtaatcaacggaggtacagcaaaaaaaaaaaaaaagaaagataagataatatgccacttggagttgtccatttcaatccatatattcaactcaccagtcagcttcaatgccgagtcaaaccttttcaatgtaagaattccatgacccaaatgtggtatgtgttcttggtttaagaaattcgtgtgctgaattcttagctttggatgttgcccttgacaaaccacggcaagactaggttctgtcacattgagcttgtctcggatcacagtagaattgtgttatcccgatttggttctgtcacattcaaaaaataaaagatagttcagtctattgaatgcaccatggagttgatagtgaactgtactagattaggagttttatatgagttcgtttcgttgataatgaggatttttattactgattcttccctttttgaataaatacaaatcaacctagcatctttctgtacatgtgtttaactttgtgacagaaaaatattctccctcgtgaatcattcaaagttactgcgtgtaacaatttctactgctctgaaattagagcaatactggcaaatttatctagcaatatctgaaacaatttctagcaatttttaacaaatttatctattattctagttaggaaaaaatatgaattaccccccgaattatcgcggtcggccgaatttcccctctgaaccagaaaaccagacatgactcaccctaaactttcaacaccggacgaattacccccctcgacccaatccatagcggttttatcctatgtggcgtacgcgtggcaacccagtcggcattttcttttttaaaagatgttggggcccatctgtcatatactccccctctctcactctctccctctccctcttttggcgagcacggcaggcggcggctgcagcctgcggcgtgggatgcgaaggtggcgtgggacactaaggcggcggtggtggcagcatgggatgtggaggcggcgccggcggcgtgggatgggaggcggcagcagcgcgggacaccgaggcggcggcggcggcagcatgggatgcggtggcagatgccagccatatccccaccgcctctcccattttgcagttccgccacgaccaccaccgacaaaggtgacgcaggtagcgtggtaaacgaggcgatgcagccgcctctcaggtggcccggcgagctttcgaaggcggccgtctcgatgtagtgcgctggccgtctcgatgtagccgcctctcgacgcaggatcccgacgccgccgggaggggaccgggttgtcccgcgtcccgccctgccgccacctccgcgtgccgcaccgccgtcgcctccgcgtcccgcgcaccggtggtcgaagcctaccgcggtggcctccgctctcctctcctcgctcctcctcgccgccattaccgtgcccaccacaacaaccaccctccagtcctcactgnctcgctcgctggtgtcctcctnctcctcgctgccacccgggncaccacagacgccggctccccacccaagagccgctcgcccactacaccgccgtatcccacgccgccgccgccgcctcccatcccacgctgcagccgccgccactgcctccgcatcccacgccgcagccgccgcctgccgtgcttgccgagtgagggagagagagagagagtgagagaggggaaggagagagagggagtatatgacaggtgggccccaccatcttttaaaaaataaaatgctgactgggttgccacgcgtatgccacgtaggataaaaaatctttggattgggtcgaggggggtaatttttgtctggtattgaatgttcagggtgagtcatgtccggttttcgggttcgggggaggggggggattcggaaaatatattgtgattgtgaaaaacatattattttgtaattgtttggtttgcattaacaaatattgtcatagcgttagcacgggcaaattactagtatttctagctatcattcataatattagatctgttttgtctttccttgtagtgtcaaaagccaagatgtaaaaggctaattagtagtattatgttttattcatggattcatctaagtttagaagtccatgttgcaagtcgacaatgaactgttcaaaagtagggttgtagtgttaaaaggagggttgatgaccaaagtaatcaatagaggtgtagcaaaaaaaaaaagagaaagataaggggatcctttagagtgggctgctaggcacgctaaatgagttgtntgttgtctaactagnagttgatcacaaatgcctcttggngggggggggnggnatggatagaaatatgtaaaaaagtatttatagtgatgtaggtgctgttgcganctggtcaagacctaatagactcagatgtcgttgtc

SEQ ID NO: 77941 - DNA, 1155 bp, Oryza sativa
  unsure (1)..(1155): unsure at all n locations
agagtttgaacgccagctggnnnnnnnnnnnnnnnnnnnnnnnnnnnnnnnnnnnnnnnnnnnnnnnnnnnnnnnnnnnnnncttggggataagacgacgtccgtggtggtcagagatcatgcgggatactaaggctagagttgatgtacgtggttgatggagattccatatggcatacgatggagttattgtgtgcgtatgggatgcggagtcgaatttggaagcagtccaaatttggtacgattggttatctaaagtttctttcttgtactagagggtttcctaaggtgtttaggactcctagtatgagtttggttcgtggctttaggctgcctaccttgggtataaatagagggggagcgtgaggcttcccgatatcgtttttgagagcaattgagttgagttttgagttagggtttcgagtttagtcgaaatttttgtaaggagtgctgttggtgcactttgtaaatacaaagagaagtaataaagtcgtcatccactttaagagttcttcgatttgtgcttcaccgggtttcggcggtttaactggcaactaaccggcggttagaccggtggcatcgtggcggtccgaccggcgggagcaaggcgctcaaaccggcggcggcaacagcaagcggcagatgatctcggtggtcagaccgaagatctaatctcggtcagaccgacggcaaccaggcggtcagaccggcagggcaatttcggtcagaccgcaatccgtcgaattcgagggtaacttttatttccgctaaaagtttttggtttttgggtataccaaccattcacccccctctggttggcttagttcttgtcattcgatcctacaagtggtatcagagtcttgttttcttctttggatttttatcgatctagagtttttgccatggctactcccgctcgtttttcaactaagcctcatgttttcgatggaacggatttttctcattggtgtagtaggatgcaatcttccattatgggtgaagattatgatatttggagaaaagtttcccatgcttatgtgattcctgaagctattaatactgctgctgaaaaaccggcttttgaccaaaattgcaaagctcgcaacattcttttgagtggtattacataattctgattatgatcgtgttgcgcat

SEQ ID NO: 77942 - DNA, 11935 bp, Oryza sativa
ctcccatagccactttagatttatcttcatctaagcacttcaacaagacaccatctatgttttggcgatacaaatctccatcaagcaatgtatatttgaatgcttgccgccgaattttccgatcaaccttaagtgtgggatcttttagatattgaatcaaaggaattccccaatcctcttctgtatcttgggcacaaatgtccgaattctcaattaattcggcctccaaatccattgaagcgtgccccccagctttctgcccaacaccggtcagaccggccacgcagggccggtcggaccactcagggatgccggtcagactggcggcatgcggccggtcagaccgcccctggtcaccggtcagaccggccgtgcaatgccggtcagaccgcccttggtccccaattctgccaatttcgcacaaagatctaaaatcaagcaccggctcttctaatatcagaaataaccccttcttcacattataaccagatgcttgttgtgccaagtcatttgctctagaattatcacgcctagcaatatgtctaatagcaaaattatcaaaattggcaataatatccaaacatgaatcgaggtacctatttagtgacccgtccaagcatttatagattccggcgacttgttgtaccaccaattccgaatcaccaaaggcctccacatatttagctccaaccatctccataacttgtaagccgaacaataaagcattatattcagcttgattatttgtgcaataacattccaaacgaaccgatgcctcataacacataccattagctgaaaacaaaactactcctatgccttgaccttctttgcaagaagaaccatcaaaataaatcttccaaggtataacttcaactaagcaaacctctccctcataagcaacatctatatgatggtctactataaaatcacatacaatttggccttttatagtttttaatggttcataagccaaattatattctatcaaagcatatgcccacttgccaattctcccacttagaattggcctttgcaacatgtgtttaataacatcggcttgacaagtaactatgcatgtactagataacaaataatgcctcaatttggtataagcatagtataagcataaacaaagcctttctataaagacatacctcgtttcggcatctaaaagatggcggctcaaatatgtaatgatatattctttgccatcttcctcttgcgtcaaaacggtaccaatgactttgtcttcggaggcaatatataaccgaaaaggctttccggctttaggcgctctcacaacgggtggagtggacaaatacctcttcaactcttcaaacgcctcttgttgttttgccccccaagtaaaatcggcttcttttttcaagcgaagtataggaacaaaagcatcgattttacccgctaggttagaaataaacctcctcaaataattcaccttacctagcaacttttgaacctccgttttgcatgtcggcgctttgaaatcacgaatcttttctatcttcttaggatcaatctcaactcctctctcatgcaccatgaatcctaagaacttccccgccgacacaccaaaagcacatttaagtgggttcatctttaaaccataccggcgcatcctctcaaaagctaatctcaaatcggctgtatgtccttccataccatccgatttgacaacaatatcatcaatatagatctctaagataatacctagcaaatcatgaaagattaaattcattgccctttgatacgttgcaccggcattcttcaacccaaaggtcatgacaacccactcaaataaaccaacaaaacccaggcacctaaaagccgtcttgtacatatcctcttccgccataaagatttgattgtagccggcattaccatctaaaaagctaatcaccttatgacccgaggcatcattaatcatcatatcggctataggcataggatattcatctttgggagtggctttatttaaatctctaaaatctatgcaaactctaatcttaccactccctttcttctccaccgggactatgctagaaacccactccgcataacgacatggcctaataaaccccgccttcaacaaccgatcaatctcttctttgactcggtcatatagtaaaggattaaaacgacaaggtggctgtttataaggcctaaaacccggtttaattggaagccgatgctcaacaagctcacggctaagaccaggcatctcatggtactcccatgcaaagcaatcaacatactctttaagtagctcgattatcctaaccttataatcggctctcatgtttttgtttacaaaactcggccttggtttagttccatcacctatgtctacttcctccaatggataggccgatgtaaacccttgtccaagcttctccacttcatcaaaatcctcaacggtttctccaatatcgacctttgtagaccgatattcttgcaccctcttttgtaaccactctaaactagcctctttactcattatacaaatttatatggcttagccgtgctacactagccggctttacagagataggtacaaatttgccatcggagatactaataaaatcatagctagaaaaatccctccccggtaagcattggatattcccatgacgccactcaaaaatagcatcggccattgcaacctcggccgatgtatccgcttgaacaatttcaacatcatcgccgtcccattgtattaaacattgatgcaaggaagaagccacacaacaattggcataaatccaacaacgacccaaaataacattgtagttaccttgcacatcgacgatgaagaaagcggttggtaacgtcttgtttcccacggtgagctccgccgaaaagatacccctcgcctccgttggttcaccgttgaagccattgagaatcacgttagtcttcttcaactcatcatcctcgcgccccaacttcttgaacaacgagtatgacatcaagttcacagcggcacctccatccactagcatcctagagaccggttttccatcaacatggcctttgaggtagagaggcttcatgtgacggtttgattcatcgggcttctcaaaaaccgcgtctttaggacctaatgagagttgggcaacctcggcttcatccatagcacaaaactccataggcaacatacataccatgttgatatccatgtcttcttttggagacgattcactttcatcaaccgattgttcttccttcttctctacatcaatcggttttgccttctctatggacttaggcctccataccggtggtggtcgcaactcattgaaccttttatctctttgctcttcggcctttttctcccttaattcatgggcccgaagacgttgcaaccttctcttttgcgtagccgtcaaatccttaggcatccacataggattcggctctgttccagaaggtaaataatatcctctattaaccttgcttgaagacgatgaagccctcacatcgccctttgcagccctcccatcaaaccggcgctggagcccggtcagaccggtcgcagaccaccggtcagaccggccaaatgtgccggtcagaccaacacttggcgcacggtcagaccggcctgaggcgtcggtcggaccgctatcaagtcggcggtcagactggcctgatatcccggtcagaccggctacatggccgcggtcagaccggccagagggcctggtcagaccggtcgactgcgaggagctggtaccggcttcggattttttgcttggggactttccaactccatctccagaaggtataagcacatcatgggaccctactttgatagtaatcacctccgaagtcctttcttccaccatggtgcgctttccttctctcttctcttcattaacacgatttttaccataaaatcggcttttgtttggtgaagacaaacgctcatgaattggcatccgtggtccttcccacattggaggtatatgattgtacattggcggcattgccccccatggtatgaagtaaggataaggataacccggcggcggcattggataggaaccccatgacatattttgtggatgaaaatatggaagtgaacgcgatcgtcttggtgaatgaccaaatcgctccctaggaggtgatcttggtcttttccctttgttgtggaccctcccaccaccttgcctctcatacttctccaaaagcatatggaaggttactttggtcttcctaggagccttagaagttgaagccccacccttattctccttctaaacgccaacctccggtttctttagcaccatcatcttaggtcttggctcaccaatgaccacttcctttcccttagtagattcggcttgctccggccgaatcaacaccttcttagcattaaaattaattgtattcaccggaaaatgatcatgatcaagcttcatcttggagccatcggtgaatttcaatcgtcctttatctatggccgattgaacctgtcgtcgaaacacattgcaatcattagtagagtgagaatgagaatcatgccacttacaatatgctcgacgtttcaactcttcttgtgatggtatgacatggcctttaggtaatctaatttgtttctcttgcaaaagataatcaaaaatcttatcacacttggccacgtcaaaactatatttaacctcactttgccgatctttgcgaggagtcggcattaggttagaacaaacaaaaggtttatttttgttagtccatgaccactaggcaacataaatatcatgataaccctcttcttcactatcactagcatcagagtaatcaactacattaacattaggctttttgtcgaatggtctagcaaattttttattatccttaacccggctttcttgagccagaaccctttgcatgagttgactaacatcaagaaattgttggccatctagtttttctctaagaggaagtccggccaaatctctatcagttatattcaaagtataacatccgtttctaacatctctaaatctcttaatataatcaacaacatattcattatacttttgcttaaccgatgttaaatcacataacctaagctcagtttctctagtatagaaataatcatgaaattgttcttctaattgagcccaagtatgaatagaatttgccggtaaagaagtaaaccatgtaaaagcattaccggataaagataaagaaaacaagtgcaatttaaaagtatcactattagcctcaccacattgcgctaaaaattgacctacatgctcccatgtggtcttaccatcctcaccactaaacttgccaaattcgggaactctataatttctaggaaacggcacattatcataataatcaggatatggctttttgtaggctctatcacgattcctagtttcgatcccaaatctatttctcataatatcgctaatcacatcctccatgttattaggcccttgtggatttggtggtggatttggtggcctaataggttgggtttgtggcgcaatatgattatattggccttgcctagtatcaggaggatatcccctagaaacatcattataaacattaggaatatatgggggaatttgaggattagtggtggcaatagatacaggaggatcaaatgttctaaagtagtacaaataactagcattagtcattggatctattccctgtatcgggacaattgcgccggtctgaccggcccagggcccggtctgactggcgtcatattgcgcggtcggacctgcctgagagccggtctgaccagtgggataatacccggtctgaccggccatctggccggtcggaccgacgggataatacccggtccgaccggccatctggccggtcggaccgacggctgtgtcgcggtcagaccggccgtcaggcccggtcggaccggccgtgagcgccgccctgtcggttttaaaccctattggatctataggagattgatcaacagtggtataggctttatcttttaatgtataatcatccataaaagcacctagcctactccttaaaaacccatcaaccttttccttaaacattacatctaatctttctttaaaattagccatagatgaatctattatagatgcaatttgtttgttgatagattgcgatacctcgtcattacttaccacgtcgggagcgagcttgggacgtggcccgggcttgatgatcacgccttgacgagtcctagtagtcaatctcatcaacgcctcccgtgtgagctcgttgatgtactcctcaacagttttacgatcctctccttcaaagtcatccaatgtgaccggtatcacatgagatggctacacctccgtcttggatgatggcttcgtcatggcgaagtcgaagtcgagttgacgatgaacggatctcttccccagcggagtcgccaaaaatcatgttggcaactttcttgacaagttaacaagcacgatcgtagcaccttaagccttgcggtgatcctagagtcgccaaccacctcgatctagcaaagagctaaatctagatgggttttgataaataaaccggctagcggagccgatttctagataactacccgtctcgtgggcaaacggaaggttttcaggacaaacctacaaagagatgtcgcactctcgcagcggcggcggacggtttacggcgcaaaccgacaaagatggacaaactaagaggaaactaaaagcaatatgaaaagaacgattcgattgattgattgtagattgatttttacaatgaaccggccttgtcccttatataggggttggtcttgccctctacaggccctcctccacatccaactcggggtaaaaaccaaaggaaacccgaaacatgccttcccgagcaaggaaacctcgaaacctgacgaaacagggtcgaactcggacctgccggtcagaccgttcacacaccgccggtctgaccggccctcaaccggcggtctgaccgcccaacacatggcggtcagaccggcacactcggaggaaaccggtagatttctaaattttggcaatctttcctattttaatcctaggtgccaaatttaggtgtaaacacaatgtggattagaaaaaattaaattgatagttagttcttaaagtacggtcagatttgcaattgctcctattttaatctcataaacgaattaacgcaaaaaaatattggattgaattcgatcggactgcgcatgaccgcatcggagtaataatttcttcacgcaataaaaacagaccacctcgccctgatccaagcacgaaacgcgaaagatcccagaaacccagttagactcggatttacttcaacagattaaaacagactccgtctcggagtttgtcaatctctggcttcatccatatatacagaccgccaaaactaacaatttccaaaccatccagttgccgagaaacgcaaacaggtttttgatcaacaagctagggcgcactcatctgatcgatcagaagttcacgcctttgttcaacaagcgcgccaccgagatggcatcggcagcagtagcagcagacggcgccgccgacggcaagaagatgatcctgctcgtcagctcggacggcgtgaaattcgagctgtcggaggcggcggcgagcttgtccaagacgctgggtaacatgatcgaggatgactgcgccaccaacggcgccatccctctcgccaacgtcgccgccgacatcctcgccatggtggtcgagtactgcaacaggcacgccgccgccgccgcgaatgctagcgggcaggaggagctcatcaggaagttcgacgccgagttcgtcaacatcgacaggaagaagttgttcggcctgatcaatgctgccaacttcctgaacatgccgtgcctgttggagctgacatgccagcgcacggcggacttgatcaaagacatgatgccggagcaggtcagggaggtatttgggatcgagaacgacttcacgccggaggaggaggccgaggtccgtaacgagaacgcctgggcctatgagatgtaggttgccaaattaggcattttgtgcattagtaggtttattcatggtttaggtgattactgctggagctggatacgctcgtgtgcgatgcttaccttgtaacagtttgagctctgtttttattaatttgcttaattatgaagaatcgtttttaagtctgatgaactgcaaacttgcgtactcctccaagagttcaaaatatatcgctccacaaactttgcaacctctcattcgatagtgtccagtgtccaccaccggcataaagctcctggatccatgacgatagtggaatgtgttgcttctacgttgaccattgctgtcggagttacatgtcacaccctgaaaatttaaaattatataaattgttgtttaattggaatttctagaatttattttaaaagtcttgaaaagaagatctaagtttaattaataaattccaacataaaattgggccagataaaatttcattaaatactttgcttaattctataattcctagatttttctgggatttatttgagctaagaaagtatttttaataaatggaattgcatttaagaaataatttaaattgaaaaagttttaaaaagtcttcttttggctttgggccgaaagtcggcccaaaacctctcttttctctcctcggcccagtccggcccagtcagccgccgcgcgcgcgcgcccgctgccgctgacaggtggggcccgtcgtcttcctcgggccgaaaccctagcgcgccgccgccgagccgccgccgctgtttccttccaattcggccgcccctttccttctccggctgaattgttagaggggaaatgatctccgggatctcctctaccctttctcctttggaatctttggctaaatcgttttggaaagcgttggattcgagttcgtctcggattcgttcttcccgatctttccttcctcgtcgccggtcgccgtgggcctccgccgtcgcctccgagcccctttaaaagcctccccggtgtctcctctacccgtcgccgccttcgccttcgcctctcgtcgtcgggaaagccctagcgccgtgtgccctagctttgccgtgcgccgccgccgttccagccgtgcgccgccgccgtttcagccgtcgccgtcgctcgggaaggccgccgtcgtgttcgccgtcgcgtcgccgtcctcgtccgccccttcgttgccgccgaagaccgccggagcgtcatcgccgccgtcgacccgaaggttcccgccgcttcctccttgtcgccgtcgccgtccgttggtcttccgccgccgttttggtcgccggtgagttcgccgtgccgcccgcttcgtcttggtgccctccgtttgcgtcctagcgccgccgttcgccggcgagcgtgcgccgcccgggccgttcaagccgccgagccgccgccgccgtcggtgacgtcattgccgacgtcatcgggaccgttcgtcgtgagccgccgtggacccgatcgatctcggccgtccatcttggattggtttgatctcggccgtccgttcgcgtgaaccgccgcccgtgcgcccggtccaccaaaccctagcccgctgacgcaataaatccccttttccttttcaaaaataattcattattgcgtcataattcaattttaaccgatttaagtgttttaatccgatttaatctttaaaaattcataactaattcatcttagctccgatttatttggttcaagtctctaaatttttctaaaattgagatctacacattaaaaatatccatatgtactgttcatgcttgtttatgtgctgttttggtgattttgctcttttctgcttagattccgtcgtttccggagagtccgttttcgccggagaagagtttgaagaattccaaggccagcaaggcaagtcacacagatcccaaacaaccctttgagcatgttgaacccgtttaaagctattgttttgttttcaacttatgcattgttttcgaatgtcattgggtggtgaacctttcccatttaattatggccgaagatgactttattttcctatgggttataatttgactagcatggaccttatatattggattggttcagctagatgttgtttatagttgcttagccatgcttagaaacattagcacacattcgggataactaatgactcactaatatttcatgatggtttcatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaatcacaagccagcatgggcaacggctttatcttttgtatagcatagttcattgcggagcaccagactgagaagtggcggagataagcccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtctcacccttctcaccatagtaaatgatgctataattggtaataatttgattagctcctggtttggaatggtatattcctggtttggagatagaactgtacagccggtatggttgttcagaatggttgggcctatacaacagggtatgttgtatagtgttggattaatattgcttaattacctaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtttgcgccgtttatttattttccgctgcttagatctttattgattgagaggaactatcttcctctgtaatgacattttattcgcttattaattagagtaatagttgtactctattatcaatttgttattgtgtgcctcggctgattcctggacgagggttcacacacatgtaagcgtttggaattttggatagaaattccgggcgtgacattacactggtggagaaaccatctttcatcggtcgggctaatttcacaatagtcctggttgcaacaaaaaccgggaccaaagatgatcttttgtcccggttaaaaagggtaacgggtatatttgatctttagtcccggttcaaatgctgtcagggcctgtcaggccccccccccccccgggatcttcagtcccggttaataacaccaaccgggactaaagatcgtaactttagtcccggttggtgttaccaaccgggaataaagaccccggcgatctttagcccggttcataacaccaacttggactaaagtcccacccctatatatatgtcttcttcctcctccagcccgagcaagcttcaaattttcttaaaaaagaggggaggtcatgccaaaatttctagtgaatttattgtgttgattatatacaaatcggaggtgcctaaaaggttagcaacttcatcctccaatgtttttttttcatattacatttggagctaagttttgcacacttttttgtctccaaaattttgttgttagttgatgagagagaaaatttgtgtggagaagaaagaatatatagaaatttagtttatttggtaaagagggctgcaggaat

SEQ ID NO: 77943 - DNA, 723 bp, Oryza sativa
gaatgttcatcgacccccgacttcatccatctccaatccgtgtacttttgtttataaccagactgagccacaaactaagccttacccactagacatgtggaagtacggtagtgctttgcaacaaaggcccgagcttaatccttatagtggccggggtgctacttcccacaactggcatgcacccaaaccccaccgaaaacaggttttaggggctttgaaagaggaagagaggggtatgtccaattccaccataagccaaacattccatagtatccaaatgatatgagaattcccaaagtctaaagttataaaaccacctaatgttgcctaattaatcagcgaagcatctacctaaattcatactagtggaaccatgaatagagtacccactagttggggttttatttattctagggtgaacaaggtaataataacaatagcaataataatatggtcataacaaaggtaaataggcatggctaaataaaacagtgataacgcgggaatttaaataaagcgataatgcaataatttaaatcaacataattttacaaactgggatccaatatgttcaaggatgatgtgacttgccttgctcgctttcccaaacgtcggcttctacttccacgaagagcggatcttccgaagctgcagcgtctacacgaccaacggaaaaaaaaaagcttttactctaataaactccatataacacgcaggaacaaa

SEQ ID NO: 77944 - DNA, 14764 bp, Oryza sativa
ccgggccggcccacggcgccccgacgctgccgccactgcacgccactgtcgcgcgcgcccgatacgtggacgacctttgaacgaacgcgaacgaacatgcacgaaacgcgaacgaacatgcacgaaatgcaaacgagcatgaatgatatgattacgaaacattaacaaacgcggacgaacgtaatgaaacgttaacgaacgcgaacgaacgtgaacgatacgatcacgaaacgcgaacgaatgtgcacgaaacgcttacaaacgtgaatgcacttgtactaaaagtgttagaacgaacgtgtttctacttatacgatttactggtaatacatatatgattatatatgtaacttggcccgtttagactaatacatttcctggtaatgttgcagagaagacgtcggcgtcgtccctcaagccgaagtggtagctagccatcgaaggaatttgcgcaggcaagtgatgtaattaaataagtgattgttagagatttaatataagattgttagacttagcatatataaatgattattacaattttaatatgagattagtagccatttaatataagattattagacttagcatatatatatatatatatatatatatatatatatatatatatatatatgactattacaattctaatataagattattagacttagcatatatatatatatgactattacaattgtaatataagattattagagattaaatataagattgttggagatttaatatacgattgttagacttagcatatataaatgattattacaattttaatatgagattagtagccatttaatataagattataagagatttaatataagattagcagagtttcaatattacggttagcaaatacatcctatatacctaacaaatattttttgtatgcatagatggctgatcgcgatgaggaacagatactatacgatacaatcgcaaagggaagcagccagtagtggaacgaagaagaggggaacgaggatccaaaccagtacttgaacgaggaggggaacgtggagagggatgcggaggggaacgaggaggggaacgatgcggaggaggctagtggaagtcagccctctgctggacagaagagggcacgcggacaacgaggtgccgcgaagaagatagagggtcggcacatcataaccgaggtggacgaagacggccgacctagtgcaccggcagaagcagccaagaattttgtacgccacagcggttggcttgtaagggacaacgtacctgtcagcacggtatactggcgcagaacaagggcacgcggggatgatgacagctttgtcccggactcagagaaagagatgttgtggaccacaatgcttgagacattcacgctacccgtgggtacagaaaacttagtgaaacagtggactctgaagaaaatggcagaacagttccagagcttcaagggagatctctacaagaaatacatcctgaagggactaacaccgaacttcgacgtattcccaaagctaagggatcattgggacgagttcgttgcttacaagacagggcaacaagggcaagcaatgatggccagaaacaaagaaaatgccgccaagaagaagtgctatcaccacttggggtcaggcggatatagcgtcgcgaagccgaagtgggaggagatggaggctagcttgcttgagaggggtatcgaaccggccaccgctaattggccggatcgatcgaagttctggtacaatgctcacagtggaacgcttaacccagttgatggctcccttgtcttcagcgattagatacgcgaggctgccagtcgactatcggacgcagtggtagcctcttctcagggcacattatgacccgacagagagaaggatgagctgtcactcgccctacagactcccgagcatccaggacgaacacgagggaaaggcgtgattccctggaagattggatttaaggaggacatccacacgtacaggagtcagatgaggagcaagagagataccgaggcgaagattgcaaatcttgagtacagggtatcgagctacgagctcagcatgcaagaggaggtgacaagcaaggtggatgaacgtatggccgcacatcggtcccaggatccccagccgtacattcatcctgcaatggtcagcccatcaggcaatcgtagcagctgcgcctcaacggggcaggtcggatcacagagcatggacgccatgcaaacccaggacgaaacctcctgccccgttgatgagatcacgcagcggacaccatgtgagctgcatattcccttcaagaacttatcaatcaaggtatgctcgtagtttgatgatttttgacttgtacattccgcaagttgctgcttaggttgattactaatagataacctctcatcacatgaaggtggggtcaggaatggccatcccaacggacccttccgggacttaccactgcaggccgattccagtaggatactcgagggtcgaagttgagctggtggaagccgcgtacgaggacctcgagttggactacccaggaggggacggtgagacgcatctacgagacacaagccacgccatcatactatggcgcaagtggtacatcattcttcctgggcgacaagcggcatttcgtgcaccatctcctccggctccgccatctcctcctgcaccatctcctccggctcctccgccacctcctgctgcaccatctccttcggctcctccgccacctcctgctgcaccatctcctccggctcctccgcctcctccgcctccaccgtgtctgcctacacctcccaagacaaggtctcgccaagctccaccgcctgcccgcacaagggcaacgaagaaggcgaaagttgacgccaccaaaaacaaggagccaccatacgattgcagtcaagaagagctcgatgcttatgtggcaggagaggtgaagaggcaactcaagcctcggagtcctgaaaagaagatgcctattgacccgagcgtgaagaacttcttcaagggaatgtccaaaacaaacaaggaggcattacagatatcggactatgaccgaacacttcagagagcctatcacaataagtccaaaccagtccctcagcttggagaacaaccaaaccaagaggtcgagccgttggtgaccggcgaagattttggcataacggatttcattgcagacaccggtctatctgtggatcagttggttggagccgcaccaatcccgaaggcggaagtggcatacaagtttgaactcggtaaaccgcttgtcaaacctgaacaactggagtccctaccgatacagatgtacaaattccatgaacggtacatggaaatgagcgccaacggtagagagatgttcggggcgaggatcagaaaccccgacttcttgcaaggagacgatgttctctggatccatttcaaggatctcttcgatctgtaccagttggacgccctcaacgtctctctcctgagcgcatggattttgtgagtatctttgagttcgatttgtttcgttcaataattagctcctggcatatatgtaagcaataatactttcctttcatcgttgcagaatggagattcaaagggcccgacggcggagggtctacgatactgggttcatcgaccctcagaaaatcaactccgaaatgatcgacaagtacgagaaagacacagaggacaatctcgtccatctcctaacgcagcagcatttcaagacgtacatactactgccgtacaacacagagtgagtttttattgtcattgtcaaaaatttcattcccatacatatagcatgtacattttcgattatatatatctcatctcacgcatattccagattccactgggtcctgttattcttcgacttggatgcatgcagagtcactgtgtatgactcaatgaataaagaggagaagatttttgacaaggtcttcaaaccgatagacaggtaatataatgccatctattccaaagtcgcggggaatctattgctattatgttgatctcaggtaataattaattaatcattgcttgcaactgcatatgtagggcttgtgatcggttccgtcaattggtccgcggaacttggaaagaaaaacttggacggaggtttcattttccagtgagtacatgcatgatccaaaattatattgaattgaatctctaattacagttaatataaagagtatattaaatctctcttcgtttctcgtgtagtgtgcaaagcaggaacagggaactaacttatgcggctactacgtatgcgagtatgcccactgcctatcaaaccaaatatgcacaacacgagagctcgatgtacgtatacataaaccattcaaaagttcattgcgtatcgatttgttaagttgtttattaatttcatatattgatacgtcattatttttggaatgatagcgtattcacatgagggataatctcccacacaaggattttatcacggctgttcaagaacaactgatgagattcatcaacgaagaagtccttaatcccgacaatgaattctactacgacggatcaacaattcataacgtcggtccttcctcttctgacataacgccggcgtcgaagtcgaagtcgtagctatagctaccgagcaaatgaattgtactatatatgcatgtatatatatatttatatatgtacacatttgcttttgtgttaatatatattttggtaacatatatatatatagcacataaaatgttaagtagctttaattaaacatatgtgtgtgtatatataatatatgtatgtatatatgtattgtaacatatgtatgtatgtatgtatgtatgtatatatatatatatatatatatatatatatatatatatatatatatatatatatatatatatatatataatcaaccatgcagcaaacagggccatgcaaaaaaaaaggtcagctcgatctttagtcccggttggcgttaccaaccaaaactaaagatcgatctttagtcctggttatttcacccgggactaaagatagctatctttagtcccggattcgtagtcccagttggacaactgggactaaatggggcttaccaaccgggactacaaacggtttctccatcagtgttacctagcagaattcctaattcgcgcatgcgtgccgtgggcgcgcacttccgacccacacggcccatgtgtacgctcggcaccgcagacgctgcgctagtttctttcttttttttctcctttttttggggaactcgggtgctagttttcgttttttttttcagaaatcgccccctttttctctccacacacacgcgtgattttttttttgtgatattttataaattgaatctttcaccttcaatattagttgagagttttgaatttaaattgaaagtttcgtaaattaaaattgaatgttttgaattttgagatgaaagttttcaaatttgaatcgaatattttgaatttcgaggtgagagtttttaaatttgagttaaaagttttcaaacgtaagataagttttaatatcttgacttgaatttttttaattttgggttgaaagttttcgaatccaagttaaaagttttcaggtctgaattgaaagttttcaaatccaaattgaatgtttgtaaatatgaattgaaagttttcaaatcctagttgaaagttttcgtgtttgatatgaatgtttttaaatctgagttgaaagtaccgagttgaatgttttcaaatctaagttaaaaatttcaaaaaatctttatttgaatgatccaaatcttgacttaaatgttttcaaaccttcgttgaaagtttgttgtagttaattctccatacttatcccaattttctgcgtactaaaaaatacaaataaaggtaattaacgttaatatgggtaattagcgtgatccgatccgctaatcacgcgggggcgtgggggtgggggtgggggcgtgtgcggctgcgcgagttaagcagccgccacgcacacggccattaggaacccccgttacctagtgatatataggggttacaagaaccagatcgatcgatgcacatttccggtattttactacccccaccattttattttataaaaacgttttggactctctttctctcgtctagattcactaacatctatataaacttggccacatatatgaaacatatgcatcaactaatgtatgaatatattcaaaatcaaaacccaaaatgtcttataatgtaaaagccaaagaaaaatcatcttaacatatttttctggaaaaataatctgttaatatacaactatctttctagttaacaccactgcatagatcaattaactatatgtggtggcctggcattaactttcttatttaaggtacaaattaatgaacgtgctggaaatttgtgtcacttttgctcatgttacagcatattatatagtcaattgaacagcgatacctgagaatttattttgtatcttccaattcgctatcttacatgaagtggtgatcaatggagtaaagttaattttcagtagtcatggttagttgaaggttgggtcagtaacaatattgtctgaaatagcgttttttagcattgtgttgccgctcacgtcatccgtttctggaatctgaaatctttacttgattaatggtttttcatcacaaatccatgaaagttgtaatctgaagtcttgaggcagaaaggtagagctttgtattgttctattctcgaacaccgctagtttgctttactaccgacaactacatagagttaatacatttatgtagttgtgttaactaaatgagtatatgttttcgttgatctcggctaaaagaatcacatagcttaattaactggttagattattgaaacctgctcacccatgtttacgactaagtactattttttcaatggtaggtgatgtacccgtcgattgcgaagcgtccgtactgatttcatatataagaagggaaggggcaccatgcaagaatgacgagctctcttgcacggtaagccaccttccatgtttatcatcaggacccattcatgatcaaccatgtgatttcataaggttgtgtgttaccgctacatcaacctatggatcgatcaccggcgacgctttagacatcaaacctagtgatgaccagtccacaactacaccgacaactctaccctacggggaggattcatctactacagggctattggcttcacaaaattagatgatcatgcgtgtttaggctaacatttcagattataagttttgaaacatacactatgtacataaatataaagttacatcgtaagtttgtaactatctagttgcagtttaagtatgatatatttacatttcaatgttttttacctcaaagaatttgtaacaattttttagttactcccatctgttttggttgatgaggtcttagaaatttttggtgatctctaatcttgttgtagctctcgtgatctagtaggagacacatgcacctactcggagtcttgattaatcttcatattaggtatatgtagggtaactagcaaaatgcctgtgcgttgcaccgtgtaatggtgggtgactgaagtttgatttcaattatttattgaagcaccccaagcatgatcataagcatcgatgatgtgtataatgaccaaaaagtcaagtttgttctcgaacaattaatttgctttacattttacaggatatggatgatgctcatgacacgaggtcgatggttgtagcatatggaggaacaaatgggtgcacaatgcaattgcttttgtactggagacgattgatggaaatctgtgtgatgaacgaaaaaatcgatattttcttaaagtaggtaagtgtaaaaaaaataagaggaattgagcggacgacacatccgaatcgcagcatataaaaattgtattttctatactcatgcattgctacatgatgaaagtgcctgagattgaactgatcgacacatctaaatcgtggcacatcgaaattatattttcttatattctatgcatggtggtcgtcattgattggtcaaatctaattataagccatgacgactcattagcaaccaaaatatatttcacggataaaacttttatatacatgtaaaagccaatgctgaacaacaaactacattaagaaaacttcaaaattatgttttagaaataaattaaaattcaaaattataaacgggcaaatacgattttttttcatttatattcctagcaatatatatgtgtagtagctagcttcattaattcaatattattttattttgatggtgccaaggcatgataaaacaatagcaattctggtaaaagagattgaacagtaaaaaatattctattatgtagctttcaagatttccatgcatccagccatccagtaacactaatatctatttagtcatagcaccatatgtcacagacggacatatccaactttatctctttctcttctcccttatctattcttcgctctcctagagccatgcaacacttctcccctcatctctttctcctctctcccacagcctctctctcctacatccacacacgagcagcacagtgtgagcaacagcaatggcgctggtggccccgactagcgagcagagacatcggcctcgtcgagcagcgggagaagcgacagcctccgcaccggcgacaagcagtggcctctgcctcgtcaagcggcgggagaggcaacggcgtcggcataggtggcgacgatcccgctgtgcagctgccttggcctcgggcaagcaacggcggcatgtcttcaacatgccgtggattttgttgacttaggcatcaatctggcatgttctgggtattgatttagacatcaatatatgatttggacagagtatgctcgaattgagcttcttccgattttgtgaaacagatcgaggcataggagaagttggcggtgcagttatgtcgacgtttggctgggttttggatgtgagtcatttttttttcactcaaacgccccgtggctgaaaaaaccggcacctatagcagtatataagtgccggtttataaaaaaaggcttatattatataatagatgatgtcggcgaatgatcaatcgtgtgcccagtggttaatgatgtgatctaacagatgtagcatgtgccggttttgttaataagaaaaggtgataaagtgttgaaaaaaatacagcaggaaatttttcacaaaaaaaaggttaggaaagggaagggaaaagaacagtctctaaccatagagattgtgggaaacgaaccaacgacctatcggtcaaatgtttcataggctaaccaattgagaatcatgaacattgtgctatgcggtgtagctacattttaaaaatatgaatattcagctgagcgttgctatgtccacccctgtatccgatgcatgttggagtgcacggcaaagaaaaatatcagtgtggacccggactcagtccccgtgtgcgggcggccgcctcctgctgcgcgccgcccgccgcagtccgcccgccggccgcgcgccactcgcgccgtccccgatgtcgcccgccgcctgccgccgtccgtccgccaaccgcgcgccgtccccgatgccgcccgccgtcaacctcgccgccaaccgcgcgccgaccgcgcaccaacccgccgcacgccgcccaccacgtgctgctcgccgtgcgccggccgccgtcgaccccaccgcccgacgtgcgccggccgccgtcgacctcgccaccaaccgcgcgccggccgccgtcgagctcgtcggagtggagagtgagggtgacggcctgatgggagggagagaggggtgagagatgagttaggggtagttgagtggcatttttgtgtaaatatgtaaaaaatttaaagggtagtgggtcttttggtttggagtggagttgtggagcagcaaaaacccagctccacccccgtagtacaaatttgtggagtagctctgccaactccgctcccaaaaatagaggatctggactgtttgacatagctcctgctccaggtaagttggagttaggagctggagctgtgccaaacggggccttagtataggcaagtcacaacgtgacataccatgcatcaaagccgtccaaaatggatcgaacgggagatggcgtttgggcccgcctgcaggtcgaaatatcgccgctcgccacccatccagccgtcccgcgtctggccgtcgccgggagcgcgagccaactgagaggctcgccgccgccgcgcctgcgccaggccgctgtggtcgccgcgagtgaggaggggaccggctgccgccgcgcgaggccaactccctgccctgccctgccgtgacctgtggagaggcgccaggccaggccggcgcgaccggggacacgtggaggcggccggccgccgggcctcacggcgcggtggtgcaggcggacggtcgcccaacccgagcccgtcgcgtggaggagaggacgtcatggaggaggccgtgctgctccatgcttgctgctccatccatgctgctccatctagctatattgttccacgcttgctgatgctagatgagcaattgtttttagttatgttttcaacttgtcccaattgtttctgaaaagcattgttcagattcagcatgttaccaagttttcctgtagttctacatttccattgttctacactaatctccagacattgctctgcttacagtatctgtttgttctgcatgtcagttttttagaagattatctttatttggtcagatatgtagccggagtgcccaatgttatgatatcatcaataaacacctgttttgtgcagtcataaaaaacatcataaatctctgttcagcatatcagaactgctgaatcatgtttcaccattttttttatgacaaaaatcaagattacataatcaatttgcccaaactcacaatgccaaacaataacaattcacttccaattaggagtctgcatcatcccaggcagcagggcaggactagggcattttccacaatacagaaccacagagcaggggcagggcatttcacaatacagaaccacacaacctcgggggcatttccacaaacacctcgcgggcacaggaaacagtgcagcgttctccattgtacgaagccatgcggcggtgtcccccctcgctggcgacgaagtgggcggccaaccggtgcgggctctgacgctgaactccatcaacgagtcgaggccaccgaaattggaggtgcggcgtgggcggagtgtattcccgacggccggcaagagcaccgcggcctcctccacgcgccgggtgcctccccactcgcggtggcgcgcctcccagccggacgaggccgaccggcgaggcgaagcgcggctgcgcgggcgggtcgcggcggcaacgctggttcctccccattcgcggcggcgcgcctcccagccggacgagggcgaccggcgaggcgaagcgcagctgcgcgggcggacgcggttctggagcgaggccgtctcaggctgcggggcctcctattaaatggcaattgttttgcctgcgtgcgggcccaactagagcagccgttcgattcgttttggacggctttgatgcatggtatgtcacgttgtgacttgcctacactaaagctgagtccgtgtggaccccacctcctctcgaactttatctccttctgtagaatcctccgcctccgcttctctctctcgtcgctctctccgtctttaccgtctctccttcgccactccccagcggcggcgcgccttctccctctcccagcgacggcagcgcgccatccactcccttcctcccagatccgactggatgaggggagggcagcggcgtggaggcggcgctcccctccccttactttctccccgctcctggatcaggctgtaggaggggagcgatggtgggggcagccaccgcatgcgacggaggtggcgctcctccctccctagctcccagatccggctggaggagggagcgatagtggcaaaggcggcgctccctcccctccctcccagatctggccgaagggggagggcagcatcggctctagcgacggtggcgcgccttctccactctccgactcctcggcgagcagcaggtgcgacgatcttaccatggatgagcagcgggagcggcggtggcctcggcctcaactagcaacaggagtgacaccgtccagtggcattggggcagcgggagcgacgtcctctaccttgacaagcagcgggagcggcagcatccacgtccttagctagcaacaggagtgacgctgtccagtggcgtcggagcagcgggaacagtatcgtcttcgtcctcgacgagcaaggaggagcgggagcggcgatagactcggcctcaggcccagcggcagtggcggtgtccccgacgagcagtggcctcgacatctggcgagctcagcattctgttagtatttaatttgttgtgatttcattgatgtagacattgttctttgattagtcttttttgctcgtcaacttttttttctggaaccgagttggacccaatgaactatatggactaacaaaaatttgtttggaagcatacctagggcgatttttgatttttgatttttggatttgtttttgtctgttctttttctgatattttctgatctgattgtcatggagacggataacgcgtacgcgggctcacatattacggacgaaaatcgtgtgtgaatgatgtgacgaaaggaaaaatacgaatagttatataagattaaaataagataagatataccgaaagaaaacaaactaattaattaatctctccaaaaataactcctacaggggtacgattaaactgagtaggagtagctaattaagctgtgttggcgttatggcaaagtaacgcagaagcaatcgaaaactaattagaatcagattggatttggagtacgaatcggagttgctcggcctggttctcgcaataaatacaaagagcaccaaacagctcgccaagcaccaataaacgtcgtttcaacagttgagctcaccgcgcaactagcgagcgagttcgtcccgtccgtccgtgttcaagctcaacagcaatcccccggccccgcgtgttcgacgagaaacaaaccaacatcaatggcggcagcaaacgacggagccgacgccggcgacagcaagatccttctgatcagctcggacgggcagcacttccaggtgacggaggcggaggcgagcatgtcgaagctagtgagcaacatgatcgaggacgactgcacggagaacggcgtccctctccccaacgtcgcctccaacgtcctcgccaaggtgctcgactactgcaagaaacacgccgccgccgccgccgccgctgccgaggacgtcgccgtgaaggatcaggagctgaagagcttcgatgccagcttcatcgatgtcgacaacacgatgctgttcggcctgatcttggccgccaactacttgaacgtaccgtctctacttgatcttgcgtgtcaacacacggctgacttgatcaagggcaagacggtacaggagatcagggacacgttcgggatcgtcaacgacttcacaccagaggaggaggaggagatccgcaaggagaacgaatgggccttcgagaactgaaccatttccttttatcttagaagaatttccaggctagtagggaagaagtttgatcggaataaatataaaatctttttcttaatactatttaatgattgacaagatatttagtcatttgttatgtgttgtttactattccctctgttttatattatactatcttcgtttttaaaatacatatcacctctgtcccctaatataacggatattcactattttcttgtaacgtttgaccactcgtcttattcaaaaaatttgtgcaaatataaaaaaagaaaagttatacttaaagtactttggataataaagtaagcgaaaattcttaggatcggtcgaccaggggagggggaaaatcggtcgcttccccttgccccacgcgcgcacccccactaggcccactgtcacatccttattttcgtcttaggatttataaattatttaataaattattattataatttatattaaatgttcattaatttacaagtgaagttaaatgtgggaaataaaatttcctaaatacaaagcatggctggatttaagttttattaaattctccatggttaattatactctctggaattttctcggatttttcggaactcaattcctaattttaataatacaaagaacatttcagtaattaatcacatattaaattaatcattaagtggtcttattatatttttttaaatatttatagtgttaaagtactttcaggatttttcttgaaattattagagcattggaagtatttttaacaattcaaagatcattttagtgattaatttaattggaaaagtaaattaaatccccttttccttttcgggctgaaactggaaaaagtctatctgtcatcctcggcctattcttcctctttgcctgcttcccgtccccaggacctcctctttcgtttccaacccctagctcgatctctgtaacgccccgattttcgttcgggattaaaaatcatttaatgatgcatttcctagaaattgaataaaaagttaagcaatttaatcaagtgaaataataggagaattaaaattttcccttaaaaatcattggccgggaatattttgtaatattctttgtgccctaatgtactctccggaattttccgtgaattttcggagctcgagaaatagttttaaagtcacg

SEQ ID NO: 77945 - DNA, 1374 bp, Oryza sativa
agcttgatgattcataggggccatggtgtcaaaaccgggttacctaactagggaaaaactgttcctaagctcttccaaagcgtggcaagctggacagcttttatcgaagcggaccccccgcccatagcaaatgtttgttgtcatatttcaatctagggggctgcggcataacctgggtgtggagacatgaatgagtcgaaccctattcatcatgacgtaatgtcaaagaagtggctcagcgaggggctttatgctgattcaaggccgaaggacaaagctcttcctcttcgtgcttgtcctaaataatgatattcactgaggtgtgctggctctgcttcaatctgttttcttgctccatgccaatcgaagatgaaccattcaccgagccgagtatgtgcaagacaagacacgactagataagtcaaatagaagatattgcttttacacgagcaactcttaccttcatgtaggtacagcccacttttcctttgatgaaatgcgaacacaaacttcaggcatcgaagaaagaagtcaagatcgaaatcaaagcattgtcattgggttgaagatcaattcatatcgacaagactttccattcatctttttgttgatatttggattccgttttcaaataaagtcatcttctagttttaaatcacctttagaatcatcagcctctgtccctacactgactcacttatccgggatcgatcctcactacggtcctttatttcgaaacgaggatagggcttgtgaagattatggataccccatatctacacggcgattatatttagactggatataggataccgaatatagatagaatatctttatttgtatctcgggtttgtttcttaacttgtacgtcaaggaaataccctgagacttagtcggttacgattgtattttatctgtactctcatattctgataaggatatgagttataccttgtaatacggactccttcccctatataaggaggggtccgagtccttcctgggacatcaactttcttggagattatacatccaataatacactcggcggattcatccccagacaggagtagggtattacttcttgaataagaaggcctgaacctgtataaatcctttgtctccaaacccatacacttttccagcttgatagccacccccttttagtattgccgaaatcttgtttcgacagttggcgcgccaggtaggggttgcgtcaagcttttcaccgatcagtgcaatgggttccgtctccggcatcgaccacctcatcttcccacccgggcaggcgtttcggttcggcagcctctacttcgtcaccaataacttcagcaagatctctctcctcgactcggaatcggaccactcgagaga

SEQ ID NO: 77946 - DNA, 5926 bp, Oryza sativa
tgtccgtccgatcggctttgggccgatccgggccgtcggatcccgtggaccggcggtggaccgcctcggtggtcccggtccacggtggaccggcgcctttgtgccgctgaccggtggggcccgcttgccggcgccgcccctcccctttgctgacgtcagcgaggaccttttcctttgtaaaaataaatagtaattgcgcaataaatcgagtttaattctagaaattcattcaaatggctcaaaacttctaaaattcatatctaattcattcgaactccgaattgagccattcaacttgcaaaattcatctaaaattgagctctacatgtttgtttactttttatgtactgtttgcttggtctttattagagtttttcctcgttttgcgtgccagcgtgtagtttctgtcgtttcggaagtccacggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatctgggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataactgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcatgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttctggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacctaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaaagtggtatcagagccaggttgactgtaggttgagccaaatggtcaaaccctaaggacaagttttctgaaaaccctacttgcaaattgtctcctctcgcccttcggcatttctttgtgaaacggtttttcaaaattctcctcccaatctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtggagttttctcggagatggcctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacaacatatcagtaggcaagtggtttagtaccttatctttagcaacccctctcttccacctctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagtgtagcggaaagaactccagcagtagtgtgttgcagtcaagagttagtgtgtccatgagctaaatgagagtcacttttatgtggaatttcctatcatcaactaaggcttaagttccaaatcttgtcgggatgaaagtgcatcgccattgcttcaatttgatggaccgatgaagtttcagtcttcaaagtcagggcatctgtaaatccgagaaatgttggtcatttttttcaaggacaacagttcaaaggttctcagtcaggtaaaagtaagactacccactgtaaggggggtaggtctcagagatgagttttggtttacctcgtcggcatttcacttgaatgttcaacccagtgcagcaatttgggtagtaattaaaggagtccgttgcgagccactagcagagtctcccaatctcaagtcaacaggttcaattctaatgtacacccttgaggccaggtcaacagttcagcttagagaagtagcatcgaggatggttgcagttcagacgaaagacaggtcaagcaggttttcctggaattacttgttatttgaattgggaccagtcgaagcggacatagggtaaatgatttataaatgccagattccattttcatcctcttatagccagcgtggtgaattctcaggttaccaaaattgctaacctcaacagttcagtccaaactaagtaagtttcaggagcatccgcagtcctagactgggtcagttcaagcagaaccagtcggtccagttttggcaaagcaaaggaacagaaaggtcgaatccagccagttcaatcgtgcaggtttgatcaaccagtcaatcaatcagttcgaagcagaatgtggcagttcaaggtgtagatcagtcagaccgcccatcagcaccggctttctttctagccatcccagaatctcgggacgagattcctgtaaggggggtagatttgtaacgccccgattttcgttcgggattaaaaatcatttaatgatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcattgcatcaattaaaataaaaagaaaacaaataaaatttcccccttcctctctttgggccattttcggcccaagtcttctttcctctcccgcggcccgcgcgcctcctccctctctcgggccggctcccttcttccttggcccgctcgcaaaagtctgttttgcgtccctccttctctcccttcgccgacaggtgggaccggcggtcccacccgtcagctcctcctcctacctctcgccggccgaccccaaccgccatagccgtccacgtcgccgcaaaatccggcgccctcccgcacccgagctcgcatccaacgacgtgggcacgatcccctccacgtcctccaccatttcccccactctccccgcgaaaatcggcaccggttaacccctccaccaccccacgtcggcgccccacttcgccggccgattccgccacgtccggcctcgatcccgccttcccgagcccataaagagcatccccgtgctcccctcgtccgtttccccatttttcccgagcccggcatactctccctcgctctccccacgccgcacccacgcgctgccacactccggcgagctccggtcgccgtttcccgccgccacagccgtcgccgcgccgagccaccgccaccgccagcttcgccaccgcaaggggaagtccggccgcctcttatttccccctctccacccctcgagcaccactcccaccgcacacccgaggccgccgcccctttcaccgcctccagccgcgtcgcgccgccgcttcggtcgacgtcgactcgcgccgttgcctccctcagctccgcaaggacgaggaggacctcggccgccgcccctcttcgccggaaatccgccggagctcctccttcctcggtcgccggtgagctctacctcttgtcatcgccatcggtcttcgtttccagtcaccccgcatcggtcctcccctccctaactccctcttctccttctgaaggtcaagggcgaccccgtccgccctccgtcctcgcaagccgccattgggcaatcgtcgtcgccgtcctcttcctccgcgtcggccgccgcttccggtgaggatctctcctcccttccttttttcccgtcccctttcttgccgaccgccgcctcttggggtgcgtcgccgtccccgtgcgcgccgctgtcctccggccacccgccgccgttccacgtcgccggctgctgcagccggttgccgcctcccccttgccgcctcccccttgccgccgccgcgccatgtctcggccgagccggcttcatgccgtgcccgtgccccagccgcgccgcctcgtggccgtccgatcggctttgggccgatccgggccgtcggatcccgtggaccggcggtggaccgcctcggtggtcccggtccacggtggaccggcgcctttgtgccgctgaccggtggggcccgcttgccggcgccgcccctcccctttgctgacgtcagcgaggaccttttcctttgtaaaaataaatagtaattgcgcaataaatcgagtttaattctagaaattcattcaaatggctcaaaacttctaaaattcatatctaattcattcgaactccgaattgagccattcaacttgcaaaattcatctaaaattgagctctacatgttcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatctgggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataactgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtaacttttc

SEQ ID NO: 77947 - DNA, 2085 bp, Oryza sativa
cctctgatcagagtataatctattcgaatagccgcgccctcggttatgggcaagccaagcaatgtacccaggttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcctgagggttcacggccttgattaataattttgtgtagctctagggtcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctctatctttctcccccccttcagtaagagaagctttggagaagaagtcttaggtggagtcttggcttataccccagttgagcgcctgtgaagatggagccgtaggcccgctagtccgctgctgtttatttttgattgtcaggcctgaagcgcctttgtaataatgtaaatattatcgatgtaataaagatgtgtcttttatatcatgtttgtttggtgtacccctgcttttcctgggacggggattaatacattagcgttcgggaaaatgcaattttctcggtcgcgacagccggcgatgataggtggatttggtaattggtttgttccgattctgataggtgcacctgacatggcatttccacgattaaataatatatcattctggttgttgccaccaagtctcttgctcctattaagctcagccatagtagaagtgggcagcggcaatgggtggacggtctatccgcccttaagtggtattaccagccattctggaggagcagttgatttagcaatttttagtcttcatctatcaggtgtttcatcaattttaggttctatcaattttataacaactattttcaacatgcgtggacctggaatgactatgcatagattacccctttttgtgtggtccgttgtagtgacagcattcctacttttattatcacttccggtaatggcaggggcaattacaatgttattaaccgatcgaaactttaatacaaccttttttgatcctgcaggagggggagacccaatattataccagcatctcttttggttcttcggtcatccagaggtgtatattctcattctgcctggattcggtattattagtcatatcgtatcgaccttttcaagaaaaccggtcttcgggtatctaggcatggtttatgccatgataagtataggtgttcttggatttctagtttgggctcatcatatgtttactgtgggcttagacgttgatacgcgtgcgtacttcaccgcagctaccatgatcatagctgtgcccactggaataaaaatctttagttggattgctaccatgtggggaggttcgatacaatacaaaacacccatgttatttgttgtagggttcatctttttgttcaccataggagggctcactggaattgttctagcaaactctgggctagacatggctctacatgaaacttattatgtgggtgcacatttccattatgtactttctatgggagccgtttttgctttatttgctggattttactattgggtgggtaaaatctttggtcggacatatcctgaaactttaggccaaatccatttttggattacttttttcggggttaatctgaccttctttcccatgcatttcttagggctttcgggcatgccacgtcgcattccagattatccagatgcttacgccggatggaatgctctgagcagtttcggtcttatatatccgtagttgggattcgtcgtttcttcgtagttgtcgcaatcacttcaagcagtggaaagaacaaaagatgtgcggaaagtccttgggctgttgaacagaatccaaccacactagaatggttggtacaaaaccctccagccttcatacttttgaagaacttcccactatcaaaaaaacaaaaagctaggcccacctctcctaactattgcccataaaaa

SEQ ID NO: 77948 - DNA, 810 bp, Oryza sativa
caaggcctggatccgcctacagttgatttatatataatttgatgatatttgctccaatcaattaaaaagtatctcgaggtaccagtacctgatcacgataccaaatcgttttcgatcgttggattatcctgccgagctagatcaacgatcgaaaacgttttggtactgtgagaaaccagtacatcgagatactttttgttggaccggagcaaaatctcatataattttgcagctgttggacaccacatgcgcaggtttactatctgtcagaggaaagaaccactctttacacgatattattcgtcgcttccttttacattctgttagtcgatcatgatctctgacaaaatttcaagtgtagcaaagtaaacacccattcttcatttaattcttaatcttatgtccaccgtattaataactagtagttctactaaacaaactttcaaagaaagcaagcaatcatctcagaaggcattggacttgtgactggatttgcagcttatgtatacaagtgcttttgaagacgacacgcatatcgaaaaggaatgcactttcaaaacacattgtatatatagaatcaagtttgaaattggctgggttaatataaccaaatcccccaagaacacacggcctcaagcatagcggaatggtgggaatctcttaattatgctccctctcaccaaatgccgcaagaacaaggatcctaggatccttactgacgagtggaatgtttagctagaaagcaatctacgaattttccagcaatctagcttctttgtaaaacaagagttaagtatctttcatagttaa

SEQ ID NO: 77949 - DNA, 581 bp, Oryza sativa
gcatctattaatgtatacaaaaaatttgtctatattttttattcatatctactcggcttcaaatattttcccagtatattgagatcgtgttcctttgctggaggagttgggaacacatctggcagatgatggcgtactgtacaaaacaagaagacaatggtgagtaacattctgattactaatttactatcttgtggattatgttttcaaattaattttgatcttgcgaacctacctttgctcaccagtcaagaacgtctttatagatgatattcttggtgctcttccctgcagggtcaacttctttctcaggcttagccaaaatccttgttgtttgtcacgacacactgttgacaaccaaatttggtaaattataaaccaggttcgacattgggatcgaagcggattcgataacgagattgattcgaagaacagagtatgcatcggctgcgaaggcatcggctggagtctgcgtcagctgagatggatcggacagaggacagctgatacagccggtagaggtggtgcagccgattccgatgatgatgatttcgaagatgcttctagaatcgatcaaggtg

SEQ ID NO: 77950 - DNA, 5665 bp, Oryza sativa
ccacgtaggataaaaaatctttggattgggtcgaggggggtaatttttgtctggtattgaatgttcagggtgagtcatgtccggttttcgggttcgggggaggggggggattcggaaaatatattgtgattgtgaaaaacatattattttgtaattgtttggtttgcattaacaaatattgtcatagcgttagcacgggcaaattactagtatttctagctatcattcataatattagatctgttttgtctttccttgtagtgtcaaaagccaagatgtaaaaggctaattagtagtattatgttttattcatggattcatctaagtttagaagtccatgttgcaagtcgacaatgaactgttcaaaagtagggttgtagtgttaaaaggagggttgatgaccaaagtaatcaatagaggtgtagcaaaaaaaaaaagagaaagataagataatatgccacttggagttgtccatttcaatccatatattcaactcaccagtcagcttcaatgccgagtcaaacctttccaatataagagtgtcatgacccgagagggaaatacccgacaatccttgatgatgaagaattatggtgttgaagttcctccacatgctccacttgaacgcttagcacttgcagcacaagtatggtcttgtagtttgcggtatcgatgactcctaaaatctccccatcatcaatttccatctcaggaacattggtttcacatagaaggttagcagcaagagaatattcttgctcaacatcactagaacttgcatatccaccatcatccgtagcgatgtatgcatgctgacttgtacaatccttcatgacatgtcacatacccttgcattggtgtcgtatgatccgattgtttgccccgtagaagctactgacgaggtacttttcgtgggtacctacactttagtagacttgtaaaatcaaagatgtttttgattattattctgtgatgaacaattgggcattggatattattggttttattatttggaatttattcacgaagtggttttggagatgattggatttcataggtgaatatacaggtagtgctggatttgggtccggtcagaccgggcacgggttgccggtcggaccggcgtgtattgcgcggtcagaccggcgcagcccactgtctgaccggccgacgctgtgtcggtttcagtttcgggttgtttatttggatatccatgattatttcataattatgacttctagatggatactatacgtatgtaatactattgtttgctgctaatgagtcaagttggagatagcttggtctcggaatatggtttctttgtttgttccatgtgtaggtgattcgatgtctctggagagtatttgcggtgatggaccgggagtcggcttggggataagacgacgtccgtggtggtcagagatcatgcgggatactaaggctagagttgatgtacgtggttgatggagattccatatggcatacgatggagttattgtgtgcgtatgggatgcggagtcgaatttggaagcagtccaaatttggtacgattggttatctaaagtttctttcttgtactagagggtttcctaaggtgtttaggactcctagtatgagtttggttcgtggctttaggctgcctaccttgggtataaatagagggggagcgtgaggcttcccgatatcgtttttgagagcaattgagttgagttttgagttagggtttcgagtttagtcgaaatttttgtaaggagtgctgttggtgcactttgtaaatacaaagagaagtaataaagtcgtcatccactttaagagttcttcgatttgtgcttcaccgggtttcggcggtttaactggcaactaaccggcggttagaccggtggcatcgtggcggtccgaccggcgggagcaaggcgctcaaaccggcggcggcaacagcaagcggcagatgatctcggtggtcagaccgaagatctaatctcggtcagaccgacggcaaccaggcggtcagaccggcagggcaatttcggtcagaccgcaatccgtcgaattcgagggtaacttttatttccgctaaaagtttttggtttttgggtataccaaccattcacccccctctggttggcttagttcttgtcattcgatcctacaagtggtatcagagtcttgttttcttctttggatttttatcgatctagagtttttgccatggctactcccgctcgtttttcaactaagcctcatgttttcgatggaacggatttttctcattggtgtagtaggatgcaatcttacattatggctgaagattatgatatttggagaaaagtttcccatgcttatgtgattcctgaagctattaatactgctgctgaaaaaactgcttttgaacaaaattgcaaagctcgcaacattcttttgagtggtatttctcgttctgattatgatcgtgttgcgcatcttcaaactgctcatgagatttgggttgctttaagtaattttcatcaaggaacaaataacattaaagagcttcgtcgagatcttttcaaaaaggagtacattaaatttgagatgaaacctggagaagctttggatgactatctctctaggtttaataaaattttgagtgatcttaaatatgttgattcttcttatgatactaattatcctcaatctgagatctctcgccactttttgaatggtcttgacatgtctatttgggagatgaaagttatatctatttaggagtctgttaatatgtctactttgactttggattcactttacaccaaattgaaaacacatgagatgaatgttctttctcgaaaagctgattctaagtctagtgctttggtttcttctacttcttcttcggttgttgatgcttcttcatctatgccttcttttcttgccacttttaatgccctatccgatgatcaactcgaacaaatcgaggaggaggatttggctttggttgctaaccgtattgctcgagctgtgaataatgccaggaacaggaaaagaggtggtccaaataggagctttgaatgtggttctattgatcatcttcgttcgcattgtcctaagcttgggagaggcaaaagagaagacaaagatggtgagaagacgaacaacaacatgcccaacaacaacaggtcgaagggctcatctcaagggaggaagatggagaatcttagaaaggcttttcaataagtttgcgccgctttcgagccactaagtgatgtagatggtgaaagtggagatgatgataaagggaagaacatctccgatgtttgcttcatggcgcgtggtgaatctgacatagagtatgaagataatgagttaagtgcgtttgaggaagctattaatattttgagtgaaaaaaaagaagtgtgagaagatgtgtagaaaacatgaatttatcattgaatctcttaaatctgaagttgctagattaaaatctcttattcctaatgatgatgattgctcaaattgtgaggttttaatgaatgagatttcaaaaattagagatattaatgctgcacatgatttgaaaaatagatcttcttttgcttgtagtttggccttgcatacacgcactttggatgagttgtttttaactaaaaagttgttgcaaaaaaaatatcaaattgcttttcatgctagtttgatgtttaacatgatttctgctaaaaagttaaaacaaccttatggtgttttggattgctcaacatgtgatttgaataagatgaaactaaaagatgctttaggtcgtgttaagtacatggaagatgttgtgaaaaacaatgaagtgctttcttgccccaaatgtcgtaaaagcaaaggtgtcatggtagattgtgaaaattgtgctaatttggaaaaagaggtttcttatttgaaaaattcttttcaaagattttctgatggtaaaaagaacctcaacatgattttggatcaatctaaggttagcacacataaccgtggtttaggttttgacccttatgctcataattctagacatcctcctattgtgttagctgttggtgctagaagtggtgagattttgattaaacatgatactaataaaactgtgtttaaatctgctggtatcatgtctaccatgaatgcatcttcttcaaaatccaatgttgagcatgcagaacctcctgtttctgcttgtgttgctaaatcttcttgtcctaacaatgtgtctaaacaacgtgaaaaatatacttgttctttttgtggaaaagatggacatattgttgatttttgtttcagattagctcataaacagaaaaaggagagagagattgcttttgcaaaatcaaagtggcaaaaatctggttttccctcgaggaaaccggtcaaaccacagtgggtcccgcggtcagaccggctacagatcctcggtcagaccgaacatcggtcagaccggcggtacagtggcggtcacaccggcccctggtcagaccggctactataccttggtcagaccgacctcggaggaatttttctgaaaattctaaaattgattttgcacgtggatatatgcctattggatcttttggtcgtgtgtctcagtactggattcctaagtttttattattatctaaccctagtactgaggcttcgacttctgcttgtgtgtaggctttggtggcaaggaaggagaacgtatggatcgtggattccggttgttcgcggcacatgaccggtgataaaaattggttctcttccctcaaaaaggcatctaagactgaatctattatctttggtgatgcttctacaagtaccgttgtcgctacaggtttggtaaagataaatgaaaattttgaattgaagaatgtagctttggttgaggatttaaagtacaatttgctttcggttttacaaattgttgatgaagagtttgaagttcactttaagaaaactggaagtaaagtttttgattctcgtggtgattctgtgctgaatatttctcgttatggaagagtgtttaaagctgattttgaaaatcctgtttcacctgtgataacatgtttggttgctaagtttgataaagatgtgatgttttggcatcgtagacttggacatgttggttttgatcatctcactaggttaagtggtttggatcttgttcgtggtttgcctaaacttaagaaagatcttgaattggtttgtacaccgtgtcgtcatgctaaggtagtttctacttcacatgctcctattgtttctgtgatgacggatgcactgggacagctattacacatggacactgttggtccagctagagtgcaccgttggaggaaagtggtatgtgttggttattgctgacgatttttctagatattcttgggttttctttatggcaactaaggatgaagcttttcaacactttcgtggtttgttttttcgattaaatcttgaattttctggttctttgaaaagaattcgaggtgataatggtggagattttaaaaatgcttcttttgaacaattttgcaatgaaagaggtcttgaacatgaattttcttttcctcgtgttcctaaacaaaacggtgttgttgaaaggaaaattcctgttttggttgagatggctagaactatgttggatgaatacaaaactctataaaattttgggctaaggctattaaca

SEQ ID NO: 77951 - DNA, 18744 bp, Oryza sativa
  unsure (1)..(18744): unsure at all n locations
ccgcccactgaagacatttgaataaaacannnnnnnnnnnnnnnnnnnnnnntgctcctttgcacattcaacgacgacatccgccggaacaaatcattggtaatataggtgagcggactacaaggtctaaggtaacggctcatgatgtttgtgcaaattctgcatttgttgcttcttttgaacccaaagatgtttcacatgcattaactgatgaatcgtggattaacgccatgcatgaagaacttgaaaattttgagagaaacaaagtttggactttagttgaaccaccttctggacataatattattggaatcaagtgggttttcaaaaataaacaaaatgaggatggtttaattgtgagaaataaagctaggcttgttgctcaaggttttactcaagttgagggtttggattttgatgaaacttttgctcctgttgctagaattgaggcaattagacttttgttggcttttgctgcttcaaaaggttttaaattgtatcaaatggatgttaaaagtgcttttctaaatggttttatacaggaggaagtttatgtcaaacaaccaccaggttttgaaaatcctgattttcccaaccatgtttttaaattgtctaaagctttgtatggtttgaaacaagctcctagggcatggtatgataggcttaagaacttttttcttgcgaaaggttttacaatgggaaaggttgacaaaacgctttttgttcttaagcatggtgataatcaactgttcgttcagatttatgtggatgatatcatctttggttgttcaactcacgctttggttgtagattttgctgagactatgcgcagggaatttgagatgagcatgatgggtgagttatcgtactttttgggattgcaaattaagcaaacacctcaaggtacttttgtgcatcaaacgaagtatacgaaggatcttttgagacggttcaagatggagaattgcaagccaatttcaacaccaattggttctacagctgtgttggatcctgatgaagatggtgaaactgttgatcaaaaggaatatagaagtagattggatctttgttatatctaactgcttctaggccagacatacaatttgctgtgtgtttgtgtgcacgcttccaagcttctcctcgtgcttcatatcgtcaagcagtcaagcgaataatgaggtacttgaatcatacacttgagtttggaatttggtattctacttcatcttctatatgcttaagtagatattccgatgctgattttggtggttgtagaattgataggaaaagtactagtggaacatgtcattttcttggtacatcattaattgcatggtcttcaaggaaacaatctagtgttgctcaatcaactactgaatctgaatatgttgctgctgctagttcttgttcacagattttttggcttttatctactttgaaagattatggtcttacttttgaaaaagtacctctcttttgtgataatacaagtgctattaatattgctaagaatcatgttcaacactcacgcacaaagcacattgatattcgctttcactttctgcgggatcatgttgagaagggagatgttgaattgcagtttttggacacaaagttgcaaattgctgatatttttactaagcctttggattctaatcactttgcttttcttcgtggtgaattgggcataattcatccttttggcatggtttgagggggagtttgtacctcatggttttatcaagcaataatatgataatgagaaaaatttataaacgagagctttgtttatgcatatggtattttcttgtgcatgctagcaatactttgaaggtttatttgtctctagcatagcttgtatgtattctagtcttttcatgagatttagattttgcttttcagggagatgatgcatgacacttaaattctatacttgaattaagaaaatatgcaatgttaatgctagcatatggtttgatttataaatgctctatatatatgctttattgccttgttattcctcaaatagttttaattgcttattgtgaaaaagaaaataaaaaatataaaaaaatgaataccgaatccttggaaacagtcttgacgacaaggacgtattcgatgtgagcaaaataatgggtgccgaatccctggaaacagtcttgacgacagggacgtacccggaataaaaaagagaaaaatatgagcaaaaaggctcaagaaaagaaaaagttaaaaattctctttgttgttttgtgctaaaggcttatttgagaaagagtgataattgcaataggtatatgtgtttagtgtttattcttcaacctatgtgcttgttaagatgttgcattataaatcgtatgaaatcatgaattatgattgttaattcaagcttaactgtaaaatctttggttcatggttatactttaattcatgtttgttatgttatagatgggttcattttctttttattgcaacacatgacgtaatatgctatatgtatgctaagctcttgaatattaatgaacataattcctatacttgatgaaatcattgtcaaaagggggagaagtaatgtgaaaatttttggagaagcaagattaatttttgagagttgttgagaagagcaaagagcatgttttttgttcaattgggaatttctttcttttaaaaagggggagaagttttcttttggatttttgagcacgatgtgtacatttgtacgaagtgtgctttttaccacttttgttttttttttccaaacaccaaaacatttttatgaatttgccaatgtgttcatcaagggggagattgtaaaatcaaaggtgtttttgattattattctgtgatgaacaattgggcattggagattattggttttgttatttggaatttattcacgaagtggttttggagatgattggatttcacaggtgaatatacaggtactgctggatttgggtccggtcagaccgggcacgggttgccggtcggaccggcgtgtattgcgcggtctgaccggccgacgctgtgtcggtttcggtttcgagttgtttatttggatatccgtgattatttcatgattatgacttctagatggatactatacgtatgtaatactattgtttgctgctaatgagtcaagttggagatagattggtctcggaatatggtttctttgtttgttccatgtgtaggtgactcaatgtctcgggagagtatttgcggtgatgaatcgggagtcggcttggggataagacgacgtccgtggtggtcagagatcatgcaggatactaaggctagagttgatgcacgtggttgatggagattccatatggcatacgatggagttattgtgtgcgtatgggatgcggagtcgaatttggaaggagtccaaatttggtacgattggttatctaaagtttctatcttgtactagagggtttcctaaggtgtttaggactcctagtatgagtttggttcatggctttaggctgcctacctcgggtataaatagagggggagcgtgaggcttcccggtatcgcttttgagagcaattgagttgagttttgagttagggtttcgagtttagtcgaaatttttgtaaggagtgctgttggtgcactttgtaaacacaaagagaagtaataaagtcgtcatccactttaagagttctttgatttgtgtttcaccgggtttcggcggtttaactggcgactaaccggcggttagaccggcggcatcgcggcggtccgaccggcgggagcgaggcgctcagaccggcggcggcaacagcaagcggcagatgatctcggtggtcagaccgaagatctaatctcggttagaccgacggcaaccaggcggtcagaccggcagggcaatttcggtcagaccgcaatccgtcgaattcgagggtaacttttatttccgctaaaagttttcggtttttgggtataccaaccattcacccccctggttggattagtttttgtgatttgatcctacaagacttactcacctcggtagctcgtggtggaatgaagacgggtgtcgatggagcttggttggtggaagacacaccagagcatgtaagaggagataccgtccttgttgaaatagcatttccaaaacggtactttgttgattgttgtcgtccctgcaattcttattctgccaaacatgcaagtagaaacaatcttcatattctttatagttaacaatatcttgaatctcacggttcaaccctccatagaaacttacaatactagcctcttcatcctctattacatcacaatgcaaacaacattttttaactcctgataatattcttttatagatttatccccctagtctaagcatgcaatttctttaaaagatcacgtctaaaagaaggagcacaaatctagtgcacaagttgtctttaacacttctcatgttgtaggtgctagtccatctgtacttatttgagtccatcatactgttgcaaaattattaaattcactagtagcttgcttaaccctatgctcaccaggaataaatgtgcactaaattttttatctacagttatttcccaatcaaaataagcttcagcatcataggcacaatgaaaagagggaatcgtaaccttaaatttagcatatggatcattacgcacattatgaaaattacctccaatacctcaacgattgaagttaagccagttgctatcaatctcttataccgatttcagggatcggaccctggcgctgattgggccacgtggcaaaacctgaacgcaagtttgcgtatggtaaaatcacgccacgtgtccagtataccattccagtgcactgccaatctggtgcgctgttccagcgtcgcacgggcgcacggccgctgcctcccctccgcctactgccaccggccaccgctgcatccttctcctaatctcgtggtcatggttgacagcagctccaaccatgctgacaggtgcacacgtcttctagaacatctttgctcaaagccagggcgcaaggcatttctggcatctgattttctccttaaaaatttgattaaacctggttagccacagaggcaagaaagctcaccggagatgcacacaagttaccaatatgggtgcccgtttcttgaggtgaatactgactcatctgtgtgtacttaattaaactgaaaaacgcatcttgatgtgttttttttaattcaaattaatttaacaaggtttccatgtatataatgagcagattaatttcctgttgaatgcatcggcgtaaccttcagaatattctaatcttgagcgaagaaaaaaaaaactcagcatttggtgtttgctaatggattgcaacaagcttatccaactccatgtacgttgaggacttgaccaattttaccgtgacctaaacacaacctatgtgtcaatggttctggacgttaatcaatcagatatcaatcgaatgactttgatagcagtgatgctttacacctttggtcagaaagctgctgcactaatcagcaacaggaaaaatgaaagaaagaaaaagaaagcatagcaaggcatttgaaacttaaattcagttagcattatgtgaataaaatttagcagttatataagctatttacatgattgttcgttaagatccaaaaccttttgcttatctgatacttcctccgtttcacaatgtaagttattttagtatttcccacattcatattgatgctaatgaatctagatagatatatatatgtctagattcattagcaacaatatgaatgtgaaaaatgctagaatgtcttacattgtgaaacggagggagtattaatgttatgggcatttgtcaagttgttcagaaaaaatattctttatcctttttatggcacagagtagtccaacaaaactaatccaagaaatcgtttctattatactcacatcagtaggacaattttgaccaataagagcagcagaaagaaattgccctttctattttgcttttaaaactagctttctttgatttttcattcttcacctctgcatggatgagtatcacaaccaggacatctgcttgagttaccctgtagtcacaaagacctttgtcttgataacaagctacatttcttttagatcgcatatacttgtatcatgctctcccaaaactatttgtttcatgttatattctaataactgagtcactaccttctcctatagagattaaaatttgaattgaagtctaccaattcttaaattcaagggttacattcttatgttccgtttcttcagaacacattcatgaccttatgtacttcattatgccatttacgttttcataagttaacatagagcgctgggtctgggaaatgcagatgcagaactgggacttaagagtactatacgattcggtaagagagcaatgctcatgccaaacaaggctgtggtaaattaatgatgtatcaccagacgatggattcggtgatactattatcgtcaatgaaaacattatcttattttctattcattacaaatagttaaatctccttatctcagcattaatgctaatctcaaagtattgatcgtgtaatatctttgaaacggaaacatttgatatgaacctcattggttttgtaaggggaaatacggtcgacctctcattgacaggaataaaagcaattaagtttgatgttatgtaaaactagattataagttctttaatgtaaaattttgtgattatgcacccccaatttttggttttggatgtatagatttagttatgatcaattcttatttacgtgagcattaggctttaatagtgtataaactgggtccatccagtctatgtatacttccgcgcggcaaagccgcggttattttctagtataatcctattgtagattcaccaacccgtcaagacaattattgttcgttgtaagactggcattcaacatgcgttggaacctctcggtaaaggtttgaaccatcctctcgatcgcaacagtcatatctctgttcatagctccacatttgtcttcgagtactttgacaagttcctccctaagcacacagtccttaaattcatcgttggtgcatgtcatggttagtagaaaatagaagataacacaaagatattatccctatcaactactaggtgatgagagaaagacacttgcactcaagcatcttaccacaggcatacacgtagcaagagatgcaaccagtggacagaagaatcacggtaggaagtatagtgctactatgcctttttggtggttatcagttgagttattttatcttggacctccttgcatcattgtacaggaagtacagccattagtaggcatgaaaattcgagctgcattatgtggagattatgggtaccatatacccacagggctacgttaattacctgactggatatcgggggtaactcatagtaacaaaatatgtaaagataaggactcgggtatcatgttaacttgtatatcaagaaagtatctcgtagtcttagtcagttacaattgtaaaatatttatagaacttagaccataagggataaggtcttttatcttgtaatcccgactccttcgcctatataaggaagggtcgggggccccctaagggcagaatcacatccaagatcgttagatcaataccacaatcggcggaattacttctcatcgagaaggcctaaacctgtattacttctcatcgagaaggcctaaacctgtataaatcctttgtctcataacccattcactttcatagcttcttcgccacccccttttgtaatgccgaaatctagtttcgatagttggcgcgccaggtaggggttgcgtcaagtttttcgccgactagtgcgatgggatctacatctacatcaagcattgacgatttcgtcttccctctcgggcagacattccgcttcggtagcctcgacttcatcactaatagcttcggcaagatctctcttctcaactcggattcgaaccagtcgggaggagatggcatctcggccccgttcggtctcctgaactcggctgagatctactccaagaacctatccctcgagttggtttcaaaccactcgagagactccgcagaagattcctccatggcatccagcaactataagaaatatgaccttctgtgacgaattcctcgtgatatcggagctatttatcattagcacattccattttatgatgattagtatgagatggggtggcttagtgacgaaaaaaatgtattcgtctttaataccaactagaaatcgtcacaaagtatttcaatgggatatcgtgatgaatattaatgtaataaggggcacaaagcaaacatcatagatttatataatgcatttctagaaaaatatattaaatgttaaagcaattccccactccaccgccgacctctgggaggcgaagtacgaggtgctcgtcgcatcgtcccgcaccacgggcgggaagccgctcacctgcatcccacaggcggcggctgacttgtgacgcttacggcagtgagctgtagcctcccgtggcttggcatccagcggttagagtgggggctgacagaccactatggtggcgagatctagctgctacgatcccctgtgaggcgaatgagctgcggccttcacaagtgacctcggctgctgtcccagccaggcctgacgatggtgagtttatttcctgtagcgaagctcttttccaacaaggccagggagtgaatgataatagtgatgcctaacttcaatgctattagtttactcaaatgtctaacgcattgtaacactgaaatgcatataagtttctggatgtaagttactgaaacaaaattgtcttacaaaaaacggccgatctcattgttggtttgcatgtactttttcattcaaaagctattgcctgattgcctaattctcccatgagttgttcatgagacattgcatatgctacatgatttattcagtagctaaagacagtttatttccttctcaattcagtaagtaaacacagggctaagttacactcagtttgtatttaatggtttagggtgatcatgccaaataatttgttaaattaattctaatagaatcttctgtcggaaagacatgcaaacctacttaaaagataaagtggagtatttatgattgtgatgaagtgatgcatattttattatgctaatttaattttccctgtgtgatttgtcgaattactagcatggcaaataaaagattaggttcattccatcctaacaaccatcacagtgttttttttttaatattctgtacatgtgtgtgcttctaaccgtggatatatataaccattgtaccatgtttactgcacaggttattactaaactatgcagctgcgatctttaattgtcaagatgtttatgcaaactaactagattcgtataattagattaacgatgtttggaaaagtttctggatttgcatagtcagattaacatctagcggaccccattgatattgggtggtgactggtgacgaggtgcagccttattaacagatgacctccgctaagcctaatggtaagttctacttcctgtatcctccattcctttgaaaacaggccatgagggagtgatatcattgaggcatagttctactgctgtcagtttactctaatatatttagcattttttcggatgaatttactctaatattcattctaaccccaaagtatagataatttttttgatgtagtaataacagtatagacatgagtcttatgtgtgtgtcaactaataaactactctctttgtttcccccttgcatgctctaatattagcgcttttaatatttcctgttctatactttgcttcccaacaatgtaaaacacttctttttgtataaaatgtcagtcatcgcttcattgaatattttgtttttgtccaactaatgcaatatgtttccaatcttaactggcctgtttttcctagctaccagaaacaaagaaaattcgtgttattaacacttgagttcactgcagtacttggtttgtttcctaccagaaactgagaaaatatacccattttaattgagttcatgcagccaacagtatactactactccctccgtcccaaaaaaggcaaaccctgggtttgcgtgtccaactttgactgtccgtcttatatgaaatttttttataatttgtatttttattattgttagatgataaaacatgattaatactttatgcgtgacttgtctttttaatttttttcataatttttacaaataagacgaacggttaaatattgggcatggaaattagggtttgtcttttttttgggacagagggagtaagtcttagcatgcgcacggaaaacgaaagtgagtttgcgcacggaaaacgaaagtgagttttcctctccttgtgctgctgctgaccgcaacatatgcttcgtcgcagataaaagatgtttgttaacttggatagaactaacaaaaaataaaatcatattggtattactgtcctttggtcctttacaagagtgaacgaatcttgatcctttagtcctttacaagagtgttttatcattctttctagctcctgcatcagaaacttctaagtttgttcatgggatattgtaatgatatggttatcctcatggaactaattaaaattagattactatgtgtgcatgtatattgccaggtcaacatgaaagtatgcttttcatgattggttgcgtacataagttaattaatgttgttcctttttacttgcagcaaaaaaaggtgctccatgtaagggactttgggggtactctcatggcatttggtttagagatttgaaaggatttgtgcttgcctaggtgtgagcaattggttggatttggctgttaactgggttataaattttgtgttgtattggatgtttgtcgggttgtgttggatgctaattgggctgtaacctttgtgctatatgggttgttattgtgtttgattgttgggcctatatgggcttagcccacttgttatttgatactaatgtaaatgaatataataagattggctgaaaatggtgtggtataatgtttgggcctatatgggcttttgcaatggacttggtacatttattatttgatattaaagcaaatgaatataatagaattaggctgaaaatatgccacatcatagatgggctaggctaaaatctagtcgggcttgccattgggctaagcccataaacagggtgttcaatacatggattttaatgggccatcagatattttatgacgttttttatgttagatatgagcgtcacaaagttatgatgacataaggattgccactagattaatgatgaaaaaaataagatttcgtcatagaacgccattagatatgcatgataggtgacgaatgaattttcgtcacacgagcgtcgcatattacaaaacatgacggaattttatgtttttgtgacgtaaatgaagcgtcatctatgataagatttcttgtagtgagctttgcttaaatgccacgatatccgcctatcactatgcgcctccctgacgatctcgcggccattttcggctcaaggaaatcgtccccctaggtctcgatctaatctgactttgagctagatcagatctagctccagggaggtcggagtcatcctccaaccactcagctcttgctcgacggacgaaattgccagctatcttagctcccctaacatcggatctcaagcgaaaccagaaatcgtcaactacaacaatgacttcgacttcgataacttcgcttgctacaatgactactacgacgactactacggtgacctcaacgatgactacacttcgctgtacttcggcgtctttatgaccaacaatgagacagacgagcagagggcagcacgactggcagacgaagaacggacaaggttagaacaagaacgctaggagcaggagtggcagatattggaacgtgagcgtctggatcaggagcgccgtacaagagaggaagaagaacaaagacggagagaagaaaagggaaggcggagagatttggctcaatgtggacgtcgcactcgacaactcattggtcagactgttgtagatgacaccaacgtgtttctcacacctcagcagaatgcagtcggggcaatcaccctcatcgacaccatcctgcctgaggccccagactacgtgacgccaactctcaacaggatgaaggccatgatcgcggcaacacttccggacgattatagtggcagtcggtaacccaccacctcggcgcatcatcagttaggaagccgagctagttggtctaattctcgcgcttcgcactcaagttgggggcttcgagagcagttggttcactctccagctgttggcaatagagggccccgagtagatcacgagcagcagaagtcttctcatggcctggttgatctcagagaagccttgaatgcaagacggagagcgagacacggacgagggcaccaccactccacggagtgcattgatggcaatgatgaaggagtcactgcattcacacgtgacctgcgtcgagtgaattggccggccagcttcaaaccgactggcatcgagaagtacgatggcaagaccaaccctgagtcctggcttatcgtgtacactctcgcaattcgcgtagcaggaggagacaacaaggcatggcgaactacctgcccgtcgcattggctaactaggccagaaactggctcgctgggttactgcgaggcacaatcggttcccggggcgagcttcgcgaccacttcatcgccaactttgaagggaccttcgaacggccaagcactcacttcgagctctacaatgtgatacagaagcctaatgagcccataagggattacatccggcgcttttcagagaagcgcaacaaaatctctaacatgaccgacggcaatatcatcaccgccttcaccaagggagttcgcaacgagctactcattggcaaattcggacgcaaaccacccaggacggtcaaggaaatgtttgagaaggctaacgagtacgccaaggcggacgacgcagtcttagcttcgaagcagtccggcagtggctggaagcccaagaaggacagtggcaacaacggtgcaagtagcagcaacactcaccacaaggatcgcaagtgtaagcccgaggatctggttgccgccacgtccacttttcagcatcaacgaattcgtgtcaacacctaagacaagatcatgaatgcgccatgttcacttcacccgaactccaagcacgctgccaaagattgtttcgtctacaagcagtttgccaagcagtacgtcgctcaattcaagaagccgacttaaggggaaactgacacgtcaacatagaagaaggacgacaccgagccagctcaaggcactttgcaggattcaaggaaggagctcaaccacatcttcggagggccacttgcctacgagtccaagaggaagcagaagctgaccgaccgggagatcaacgcagtccagccagaagtaccacaattcctacaatggtctgaggttgcaatcgattcgatcgctcggatcatcccaaccgagtggtccacccggggcggtacccccagtactagacccagtagttcgcaacgtgaagctcaagagaacccttattgatggcggaagagcgctcaatatcctcttcgccaagactctcgacgaaatgcagatctcgaggatcgagttacggctgaggaatgcaccctttcacggagtcttccttgtgttttcatctacaccactcggccaaatcactatgccggttacctttggcactggggaaaactttcatacagataatgtctgctttgaagtcgccgactttgagacagcttatcatgcaatgcttggacgaccggcgttagccaagttcatggccatcccacattacacctacatgatgatgaagatgccaagaccacgaggagtcatatccctgcgcagcgatgtcaagcaggctatcacctgcgacaaggaaagctgcgagatggcccaatcttgcgagcaagcactcggccgagaagaagtctgtctagctacatctacttcaccagagggagacgtgcccgctaaaaatttgtccaagtcaagagaaaacgacgccaagaccaagaagattccactcgatcctttagatccttccaaaactactgtgataggcgttgagttagattgtaaataggaaagcacactcatcacctttcttcaagctaataaagatatatttgcgtgaaaaccatctgatatgcctggtattcctagaaagaagacgcgaaacctattaggcaacgactccgctgatttgcgcaagacagaagagatgtgatcaagaaagagttagccaagctgtttgtcgacagtcattagcgatcagtttcgcccgtcaatattacctaaatagaggagaacaagttatgcttgcaatgcatttttgtgttaaaataatatatattccactagcactaggattactaatctcttacacagaataagcataagatggaggagaatcgacaacaaaatggacgattaatcaaccggacgctgtcgataatcagacttaaaggaagatagaccaagaactcagaattgacacgatcgaattgggccaaaattcacaagtctgaagatagaagaggtcaaggaggccaccagtcgaattgtgggctggatgggcctgcccatggttcggcagaacccgtcgtgcagccgctggatccagggttggcgatggacgatgtggatggcttccctatggcggttggagggtattaccgacctttccaatcaccataaccgtcattaccagcttatttaaggccatcactctctccatttcaagacacacctcaagcaaaaagcttcatacatctctcaagtttagtatatagtctctagagtatagtggaatagaaatagaatagaatctttagttctccgagtcttcagaagaattcgggtatggctctagtagcttttccttcttttgtaagacttgcacttaatttaaaatactcttctttatactactttggtattgtattactttccgagtatatgatcgaaatgatcaaataccaactttattatatatccaagttatatttattatgatgctagcttatcagggagatgcaatggtgtgggtataatgatcgtatttacgatgactctatgtcatgacgatgatattagactagtattttgtaacttaagcgtggtgtttagattactggatatcattatttggggttatattctacggaagcgaggtgggccgctgatggtgacagctcagtacgggtattcctccgcgcgtgtacatagtcctccgcgtgtgtatatagtcctaagttaatttcctggggagggtactcctccgtatttagccccggttgggtagtcatgacagattgtcgtaaggaactcggcaatcaggggtggcttcttgaagcaccaggagggcattggaaagagggtattagctaagtaatcatataactaggatgtatgtgtaatatgtttgtatactagaagtataggaatatgatctttcgattttctttccacttagcttagataattatgaatgagagtattaatgcttctgcttagtgtcactatactctttgaattatattagcccctgcttagactttgattattgcaagtaatatataaattattagtatggttctctctattataatcttcccacgggattaaacaattacgatacccttggaatactctcgggtgaaatactacaatggtatatccgtgcgcttgcggataaattctgtaaccgtaatataccagaagtatttctgcgccattgctggcaattatgtttctagtaatgcgccatttcatcaaggaggtctttcatcccgactggttggctaacccagtcctggttcggaagaaaactaggcaatggcgcatgtgtgttgactacaccgacctcaacaagtcttgtccaaaggaccccttcggcttgcctcgcattgaccaagttgttgattcgacagccggctgcgagttgctaaactttttgaattgttactcggttaccatcatatcagcccgaagaagtccgactgcttgaagacttcattcatcacgccattcgggtcttattgctactttatcatgccttttgggttggagaatgcatgagctacatatctacgcatgatgcagaggcgtttcacaacccaagtcggctgcaatgtagaagcatatgtcgacgatgtcgtcatcaagaccaagcacaaggataatctcatcgctgatttggaggaaatgtttgccaacatccgagccttcaggatgaagctaaatcccgagaagtgcaccttcgaagtaccgttagggaagttgattggctttatggtgtctcacagaggcatccaagccaacccggagaagatcaatgccatcctcaacatgaaaccgccgagctcccagaaagacgttcaaaagctggctggatgcatggcagcgctcagctgattcgttccaagactaggcgagcagtggatgccttttttgaagctgctcaagaagacagaaaactttcagtggacccctgaagcctagaaagcttttgaagacttcaagaatttcctcacaactccacccgtattggcttcaccacacccacaggaaccgttgttgttatatgtctcagtgacatcccgggtggtgagtatggtgttagtcgtcgagcatgaagaggagggctacgtccaaaaagtataggggccgatttacttcattagcgaggtgatggccgacaccaaaacacgctatccacaggtacatatgttattatatggtgtcttaattactgtcaggaagttggcccattactttcagagtcactcggttacggtggtcacaaccgcggagctactgggcgtatcactaagtgggcattagagttgatggcattagacctaactttcaaagcccacacctcgatcaagtctcgagccttggtggattttgtggccgagtcccagacagatgtacctgcggagaagctggagtactgcactatgcatttcgatgggtctaagagaatttcaggcacaggggaggagttgtgctgatctcctataaattatgattattttcgaggatttaagccgcatatgctttgtaattgattcagtcattttggtgactataattttttttaaaccattcggttgtttattttttccttgactatatgtttaatttgttcaactaatcatatagtcgggggctacatctaattaggtttatctagtcgatgcacctagatttttcttttttagcccttcacagcatgagatgattgaggtactcaggatttatggtgaggatgattcaagtacttggattcttcatgaaatcactcgggagaatatcattaccactcaggagaaggttgtctcatcatctgtgaaggtcttaggggttactgtggagattatgggtaccatataccctagggctacgttacctgactggatatcgggggtaattcatagtaacagaatatgcaaagataaggactcgggtattgtattaacttgtatataaaggaagtatcccgtagtcttagtcggttacaattgtaaattatttatagaacttagaccgtaagggataaggtcttttatcttgttttcctgactccttcgcctatataaggaggggtcggggccccttgagggcagaatcacatccaagatcgtcagatcaataccacaatcggcggaatatatccccggacaggagtatggtattacttctcatcgagaaggcctaaacctgtaaaaatcctatgtctcataacccatccattttcatagcttgttcgccaccccttttagtattgccgaaatctagtttcgacgcatttgcaaatgaggtacactattatggtttcctttcagccgtgttccaaagtgaatgcctattgatatagttttggagctaaatgcaagtatgttcttaaacaggaaacaccagagatgttaaatcatctgaaatgcaagaagtggtacattgcagcatgcaagaactgctaccaagtactactatacaagaagaggtttctctttgcaaggaatactcattatctgtttacagttctgtattaaatacgtagtgcccctgttactttgttcaggactatggcctggtttagttccccaattttttttcctgactggccgataggaattcatgtattgacatgggatcactgttatagcatcactcttattatttgttgccaagttcattacgtgaatgcaaagtatgatcacattattacctgactggcattcccagataaccttgttgagaagactcctgccagcagtaccctatcctccccaaagttgagtgaccgactgagagagatttcaaactcattgaagcttcttagcactcggccagtgagcgtgagggcagaaaagtggaacatagaatgtgtccggagaatcaacacgattgcaccagagccaaaaactcctgaagtgcatttgtaatttgagcaagcggaagatcccaaggataaacttatggcccacagcactgggattaaggttaacctgtttttttttaattcactgactcattttattcgcttaatgtgtttaattgtaccttcttataatcatcttgcctgatgaattctctcttgttttttatgtcccacagaaatctctagctcaaga

SEQ ID NO: 77952 - DNA, 10092 bp, Oryza sativa
gtaaacattctctaattatatattaattaggcttaacaaatttgtctcgcaaaatagctttcatttatataactagcatgatggcccgcgcagattacgcggctagcatcattatattttctctcaaataatagcatatatattttctcattatattattcaaatatattaaaatgacaatataattttaaattttgcaataactttacaaaactactaatgtgtaatatttatattgtattttatatacgtgttagttattaattatttttaatatcaaattttagttatttgtaaattatatatattcctatatggactctagactcgtcttttaatatttctattttttaattccgaattttttgtaaattgtatttttatatagactctatgctcttctttcaatattatttatatttatttctgaatttttattatttctaattgtatttctatgtggactctaaactcatctttcaatattctttaattttaaattttgaatttcagttacttctaaattgtattcctatattgactttaaactcttcttcccacgtttttcttaatttctaattttatttatttataaattgtatttttatacggactctaaactctacttttaattttattatgtttattccaaattttagttagttttaaattcctatatggactctatactctacttctaatattccttattttttaattccaaatttctattttattttcttaattgtatttctatatagactctatcctctacttctaatattccttatttttaattacgaatttaagttatttcataattgtatttctacgactctatactctacttctaatattccttatttttaatttcgaatttcagttatttcctaattgtatttctacgtggactctattctctaattctaatattccttatttttaattccgaatttcagttatttcctaattgtatttctatatggactctagtctcctcttcaaatatttcttattttttaattccgaatttcagttatttcttaattgtatttctatatggactctagtctcctcttcaaatattccttattttttaattccgaatttcaactatttctaaattgtatttctatatggactctagtctcctcttctaatatttcttattttctaattccgaatttcagctatttctaaattgtatttctatatggactctgctttttctttttcttcgattaatgtgagaatttctaggccatgagagcgaacgtggagactccttttttctattcctttaataatataatagattagttttgtaagtagtctatatttaatactctaaattagtgtttaaacacagagactaaagttaagtccctggatccaaacactaccttagtcgaggaacagcttgccactggataaagaaaaagacccaaactcgtcaacttcaacaaacactgtaccatcagacatgtgacaggtcagcaataatcatctcaaaacaagggacaagcagtaaacaagtgtgacaacatgtgacacacggacacacggtatacaatgcattgcttcttttctttatagcaattgtggtcatcaagcatgtgtttcaccatacttcgttaagagtaattaatggtgttaaaatttagggacaattgcttatttatcctattttaaagtccaactatcaatttaaccttgtttttcagatttacttatttaacacgttaaaacttttcacctattagatctaaacacagcctgaataaaattttcggtctctgcccttgttaggtgaactcattttaaccccgacaaatctagcaaatgtcaaaaatgccccctcgtcttcttcccccgacccgaattctctcctcactgattatctcctccttctccactggccagccagcatctgctagcttcggctctgctccagttctgccctaatctgcttaacgccactcctctactcctcgaccctgctcgccatcacagcatcactgcaggttgcataggaaagccaaacgcggatctgcactgcaagctaagctaggagctcacacccatctaaattaaagatggagcaagctagctagctcgtcattactaatcgtttcatattttctttcaaaaaaaactaatcgtttcatattgcacatctggtctggagaagacgattgagctagctagctgttgagtattactaatcgttgcatattttacttcagcggatgttacttaagcgagagtaaatcaatagctagctagctcaatcatttcttcaaaccagatgtgtaatatgaaacgactagttttttttggaagaaaatatgaaacgattagtaagattggcctcgtacctgatcgttagtcgataaatggctagctctgtttttagctccaaccgaggtcaaactttcagacttggagtgtcaatttgtcgattgacgtttcatgcatgcgaagatcaaaaagaacagaaaatgcaactaattaaccaaccagttgtttgagcatcgggaacgcacctgcttacttgttattcgccgctgttgcaggcatcaaccggcacgagccaaggaggaatggcgtttctccctagcttctactggagtacatagccttcgtaatggagtagtcctaccttattagatagagctatgtatcttctgtacgtagcatcaaagttaacacggacgtctccccacaccctccacggcagttgacttcgaataaagagtaggcacatgcatgttgccgatccatagtttgtactactacatctgatttcaaataattaattaattaattatatgattgagtaaattttacaaaaccacacatatttaaatatgtatatcacaaaactacatggttagtatcaaatttatcatacaactacatatttaaagtatcgtaccacaaaactataaatttagtgatgaatatatcaaagaaccgtatattttagagtttatatccataacatattaagattacaaaagttatagttttgtgataaaaccgatgttaaatctgtaattttttatacgataccttgaatctcttaagaggtccgtttgcaaaaataaattttcgcaggccgttgccaacaatctcaccccacagttgtcattttcacaggcggccatttagctccaagagacctacccgcttgaaaaaaagaatgacagtgtttggaaaaaaaaatatttttctagtagtgcatcctctctctatgcttgggcactcccacgagcccttgtcttatattgttgtctagtaagttatttgccataacaccactagttattaacaatatattatgtgagagatgaaagtactgtaatactgaggataataataagtgaaatttccggaagatttcggtcctatcagaccccccccccctcccccgggcatgatattattttgaccaaaattttaaattttgttgtgaattttgctcagatataatcaatttttgttcaaaatttcactatatctacaccctctaatacaaacgccgaaaacaaaagattgaacagtggtgctatgtgtgctccttgggtaccaaacgcaaatcattttagcattctcaagtcttaaataaatgtcaatttattttataacttccaggcacttgtctctcttttctttcatgtatgttcttgtcaaagtgcattgataacccttgtcacgaatacatgagtcatcctttttcaacactcatttatttaaaaggaaacatcaacgttgttttttgctctaatttatttttcatacataagcccaaattatttaaagtcatatatactctagtatcccaaaatataagaactgtcggcgtgtttaaaatttatctcaaaatataaaatatacctcatttatttttgggacgaagagaccacattaattttagacaaatcatatgacatacatacttcttctaaaagactctagtggcggttctagtggcgatggtgagtctgtctctgtcacaaccaccctgttatgtggggggtcattacatcagtacggacatacataagtggcctacttactctatatgtaatatgtgtaagactccacttttttttaccctgattaaagtgaaaaactcagaaacattttggttttacttttgattttaaattggttatattgcataatttattgttagaaagtatttcacggtcacatgaaaaatgcatttaaggaattaagggttaatgtcttactttgggaactacaattctaacttcctcagtgtgtttcttttctttttataagatggaaaatttttgtttcaatcaagtagaagcaaacatttttttttcaaaaagcggcctcttgaaaaaaaattaactcatgtatttggctcctttttaagaagttgcaaactatagttggtcgtccaaacaaatgttggtggggtgaagtactactactctccattagagcaggttcaaagttcaatagtgtcgtcggccgtcggctgcctccatctatctttgcagctagcactggaaccaacctatacaatagactagctgttatgttgatcacatatcactaatcaaataattaattctatacacacttgtatcaatataccggatccaaactgaactcaattcttgtggccacttgaaccagtcgaatgagaaagcggaagaggaaaaccacaaactaacataagatccaacgggcttttcatgggacccacaaagtgtgtttttaattgctaacaacggcagcatgcatcgtaagacgtgctaccgcccgacgatagatcaatcgcctgcttgcttctctttccttacttctctctaagggcaagtacaataacttgaaattatcggctaatagtaagcttacgttggattttatacctatgtggcggagagagagtaccaagagagaaaaacatcgtcgattaatctgtcgacgatcatgcacgggcaccaatgcacctagcgctggcttggagccttcctatcgacagcaccatcgacggaacaagaaattagcatgaataatcttccctgattggcttggagggaagagaaaagctgggaaggagtgagagagaagtaattaaataattattgatatgtgtgctgcaataaatgtgaggagacaactattatatttattataataaagattagagtaagctgtacatgctcttagtcaagggacagcttgtcattggataaagaaaaagacccaaactcgggtatttgttgaagtcatgagacatgtgacagctcaccaataatcatctcaaaacaagggacaagcaataaaacaagtgtgacaaactgacaatatgcatgtgacacacggacacacggtatacaatgcattgcttcttttctttaatgtcctcaagcatgtgcatcaccatatttcgttaagagtagttaatggtgttaaaatttaaatatgtcgttacatatttaccctcaatcttttttaaggctttcgattctacctatatatgttttgacatgaattttgcccctgttaaaacatcaattttactcattccatttagtaaataaggacaagcataagcttgacatgaattttaacactaataaatactccttccgtttctaaatattcgataacgttaactttttaccatatatttgattgttcgtcttattcaaaaacttttgtgaaatatataaaactatatgtatacatataattatatttaacaatgaatcaaataatagaaaaattaataattacttaaattttttgaataagatgaaccgtcaaacatatttaaaaaagtcaacggcatcaaatatttagaaacggagggagtactcttaacaaaaatgagaataattataagcttcagttaaagaattaaggggaaaattataattgagtttgaaaacagggtaagaacgcagatgcacccttttatagagatagtagcaacgatccctaatttgtacccttctgaatctccaaatattaaccacagcataaactatcaacccacatcaatgcaactgggactgcagcacaaataggcccatcacccagccaccctcctcacgccgtgcaaccacacgatagaatcgctcgccttagacacatcgcgcgcaagtgcaccactaacacgcgagagcccatcacgcacggcgacaccaccctgcacgcacaaaccccatacccatacggcgaagaacgaacttgctactccaaggatatgaatacgagccggctatgttctttaccacatcacagagtgcattcttctatctgattgtgctaatttatgtgccaccttatttgtatcctctgctgaattgacatagtcttacctccggtcacaaacatattaagtgaattgatactactcccttcgtaccaaaatatactagcaacgtgtcctcattcaaattcttagtactagctggtatctaatttactactccctccatccaaaaaaaaaaacaatcctgggtttaaatctgaacacggtttgaatctggacacacattatatccagattcaaacctaggattgggttttttttggacgaagggagtacagagtaatactactagggctgtgtttagttggatccaaagtttgtattttggttgagattagagatgatgtgactgaaaaattatgtgtgtatgacagattgatgtgatggaaaaggactgaagtttggatccaaactttagatcaaaacacagcctagtactagtacaacagaatgagtatatcacatgaattagttggagtgagtatgtcacatgaattaattgcattgatagcaccgcacaattagattcttaaccaattcattcatatgggcacgttgatccacccattccacagcaagccctggtccctctctgcatcccatcaaccaattctgggtgttccatccagttggaatttgttcacggtgatcactgagaaggtgaaattaaacaggggacatattctaatactatgaatctggacatatatctatccagattaattgtatagaacgtgtcacatctaatcctagattcgtttttttcgggacgaagggagtacaaaacaagccattagtgttggttccccaaccgacacacatgtgttctccccgagaaaaaggacgggttgataaattgacaaggttcatcgagctgatgctttgagttatcctcaatatttatatccatggcaccgaatccccacccacatttacacaccagggaataaaaacacaataatttccatatccacaaatcaaagataagaacaaccacatcacagataagaacatactatttacattcactaggtgaaaccccgcgcattgccgctggaatttagtataataacaataaaaaataacgtgtaagatagctagataatatcagattaagtaaattaatgtggtttatgataatttaaatttaaatagtatgtagaatgatgattcaaacgtaaaaagtaaggtggtatgactttatagaagaagaaaagtaggcagatagtttggaccgtagattaatcatctaaatgctaaaaacaattgatgtgatatgacttaattagaggaaaaaaagagaaagataatttggaccatagattaatcatttaagcactaactaagtgaggatgaactatataagtatataggatatcataaaacataataggatatacattgaaatattatgtgaattatgttggatgataatttaacatgttgtatttgaaaagctcttaaattataaaaactataaagatatatcatgtttgcatgatgtttaaatgtgatgattgttagtggataatgatgtggcatcttgttaattagtggatgatgatgtggcatctttgcatgttaagcttaaggagttagtgggggataactttatagtaagataggattcaattattcaacaaacaccatcgataacaccaaaaccacatcatgcatcaaaaaaacctttgctatattacacattcaacagaaaaaaaatataacaaaaccggactcacattacactatgggattacttttctctgcttaagggtgataaacagtaattagcatggtgttagaaacttttatcggcgtcattagaacctggtaaatatatagtagctccgcccctgatatcgagataccatttataatacctacttcctctcgtcccaaaatactccctccatttcacaatataagtcattctagcatatcctatattcatattaatattaatgaatctagatatatatatttatataaattcattaacatcaaatgaatgtgagaaatgttagaatgacttacattgtgaaatggaggaagtataagaacttaggactggatgagacgtttactagtataatgtatctagacagacttcctatcaagatatattgtactagaaaatatctcatctaatcttagattcttatattttaggatggaggtagtagcatgatataagatataccagcttagatgatactcccaccgtccttgaatattcgacgccgttgacttttttaaacatgtttgaccgttcgtcttaattaaaaaattttgggaatattattcaaaaacttgagtagtagtagtatatttaaccatgaatcaaatggtaggaaaagaattaataattacttaaattttttgaataaaacgaacagtcaaacatgtttaaaaaaatcaacggcatcaaatgtccctaaatataagggattttagttgaatgtgatgtattctagtacaacgaatcgtgggcatgaagtctatctagattatttgtactaggatatgtcacattcaaccaaaatccattataattagggacggatggagtatacaatagcggccccattcgtttttcccggctgtgttgagttcctgaaaaaagttgaaagtttgaagaaagttgggagtttgaaaaaaaaattgaaagtttatgtgtgtaggaaagtttttgatgtgatatgatgtgatggaaagttgagaataggggggaaactaaacacggcctcaagccctcaaccaaatgccttcctggcttcccgtgagcatccgcggtagctgctctgcttcttctccatgcccatggtcgactttcactgagagtggtgtgctacaaacagtaaacagttggtggcacacggccagccagtgtgagactgagagaaggagctgatcgagatctagtacgtacgtagcaatatggtaggaggaggtgggtacaggcagaagctgatccaggtatggaacgattggcaggtgagcgtgctggtgctgctcagcctcaccctgcaactcctcttcctgagcacggcgggcgcccggagacgggcgcagccgagctgggggaagaaaacctacttctgggctctctacatcggctccaggttcatcaccacctactccctcggcatcctctcccgcgcctccacgggcgacgccaacgccgacatccaggcgttctgggcgtccctcctcctgttccacctgggaggccccgacgacttcaccgccctgtccctcgaggacaacaagctctgggatcgccgctgcctggagctcttcatccaggtagggatgcaagcggggttttttttagactcacttatttacttctagtttatttttttaaaaaaatttacactatcatgtaggaaataggaaatgaactagtaagcgggtttttatatccctaagtgcaggtctcgaccacactctatgtcttctcccgctacgtgctcgaccccggattccgccgcttcatcgtgccgttcgccctcatcttctccgccggggtggtcaagtacgtggagcaggtcgtcgcgctgcaccacgcgacgatggaggcgctcatcaagtccgtcctgggaaagcccgacgctggcccggactacgctgacaccattaaccgattggacgggattatgagatccggcgcattgccgtccctcgacatcaagaacgaacgagttgaccgcccaaactctggtgagtacgtagtaactaatcaacctaattaatttgtttgcggc

SEQ ID NO: 77953 - DNA, 9986 bp, Oryza sativa
  unsure (1)..(9986): unsure at all n locations
tttattccctctcctctcctatctcctccacgtgtttatagctgacttagagtaagtttaatagtatagctaactactagctccaaatcatctataattgatttaatagccaattcatacaatagttatctataaacatatactacactatgttattatacctgctcttatactctgctattgtatttgctcttaagaaaaagtaatagcaatatataattctcatacagagaaccatatagagtggagagacacccaaaaaagaaaaataaaataacaagaggcaggctaggaggaatccttgtttgagacggcccacggcccatcgaggcccacagtcggagaaaccctaccgcgtcctctccctcccttaaaaggcgcctctcgccgccgtcgccgaaaccctcttgtttctctctcctgctccccccccaacgccgccgccaccgccgccgccgccgccgccgaatccgagacccccatctcggattcacctctcccgcctccggcctccgtcaccgtctccccacgcgcgtcaggtcgagatcccccacccctcccaccccccgatgattctgttgctcttttccgctccggctcgtcccgatctgtgcgctttttttttttttgggttgctcgtgagatgtcgcgtggatctggctctcgcgcttgggctggatctgtggtagtgataaacaggtctagccgtagcttgtgcgcggtggaggcgaactctaggtttaggtttaggtttttgtttcctggaggaaaagttgggtggatttttttttctattattattatgtttgatgctgtagtggtcttagtttggtagattcttgggtttgtaggatgctcagtgtttgtatttttgtctgagatgattgtgggggattcgtcatgctcagttctgtgcttagtgatgctatactagatgttttttttgtcactgtttatgtttattaaaatattattgtgaaggtagcaagctcgcagagtcgagttctatctattggtgctgtggctcgtgccggtttttggtgttgaagctataagggttagtgtggggtgtattgtatattgtcaccttgctgcgattatgcatttgttacgtggcagaatcttaggacgccatgtccagcttattaatgatgttatgctacttgcaatgaatgcttgagtagacgtatttgttctaggtagcaatctaaaagcatgggattgaatgctttaattgaatgtgttgttgcctgcggataacctcttgcttctgtttttacgttaagtgtcaaatagtaattattgttaatatagtcggttgtatggctagggaactgatgttatgctcctagtttcatgtagtggcataatctaagtctttagaatgtgcatggttatagttgatgttcagctgtaatgtatttttcaagcaagtgatgttatttaatatgtagaacaaatgtgtaatatgtagctctgtgaaacatcacccataccgtttgcgatgtatcttcttcatatattgctttgttttcccagttcatgtgcctagttaatttacttttctgttatgcgcttatcttgttgctaactggaactagcagatatctccatcacgcatgttctcctctgtcctactttctgttcttttggctaacatattatcttattaccacagtcatggcgggaatggcaccagagggatcccagtttgatgctaagcactatgattctaaaatgcaggagcttctgtaaggaatcttatactgatacgttttatctcagccatcattgtgtacggcaatgtctgtctatttcctgtacaggatctaccgcttactgggtagtcttttaatgcaggaaccaaggtgaaaccgaggagttcttcacatcttatgatgaagttcatgagagttttgatgacatgggtctccaagagaaccttctcagaggcatctatgcctatggtaggtttataatctttcgtgctttttttttgtgtgtttgccatttgaactgttattcatcagacctttttttttgttttataggtttcgagaagccttcagccattcagcaaaggggtattgtccctttctgcaagggtcttgatgtgattcannnnnnnnnnnnnnnnnnnnnaaagactgccaccttctgttctggaattttgcagcaacttgactatgctgtggttgagtgccaggccttggtccttgctcctactcgtgagcttgcacagcaaattgagaaagtcatgcgcgcacttggtgactatctgggtgtgaaggttcatgcttgtgttggaggtacttctgttcgtgaggaccaaaggattcttgcaagtggagtgcatgttgttgttggaacacctggtcgtgtgtttgacatgctgcgtaggcagtccctccgtcctgattacatcaagatgtttgtccttgatgaagctgatgaaatgctttctcgtggtttcaaggatcaggttagcattatcttagttgtttgtattttgcatttggtttgcggtttaacactatttagactttctgagagcatgattcattaatgattgtacaattcttaatatgattagagttagatttcctgggagcatgtttcattgatgttatacaaagtctactaaggttgatgtgtcaccaaagatctcaatttgatctcaacttagctatcctttttgtgttatttaagtaactaattcttttagaatactaagcagcaggaaattgaaagtagttaagccagctgtatacgtttcatctctttatgttatgttattggactattctgaaaatctgtttgacatgtttctgttattccttctattacgtgcttcatatctatagtaatattaatttcccttttgttatttgcagatttatgatatcttccagctcctcccgtcaaagatccaagttggtgtgttctctgctacaatgccccctgaggcccttgagatcacccgtaaattcatgaacaagcctgtgcggatccttgtgaagagggatgagctcactcttgagggtatcaaacagttttatgtcaatgtggagaaggaagaatggaagcttgacacactctgtgacctgtatgagacactggccatcacgcagagtgtcatctttgtgaacacccgccgcaaggtggactggctcactgataagatgaggggcagggatcacacagtttctgctacccatggtgacatggaccagaacactagggacatcatcatgagggagttccgatctggttcttcccgtgtgctcattaccacggaccttcttgcccgtggtattgatgtccagcaggtgtcccttgtcatcaactatgatctgccgacccaacctgagaactacctgcatcgcattggtcgtagtggtcgttttggtaggaaaggtgttgccattaactttgtgacccgtgacgatgagaggatgctgtttgacatccagaggttctacaatgtggtgattgaggagctgccggccaacgtcgctgaccttctgtgatcaagttcagaagagttatgttaaggggcctgataaggattgtttttgtctgaagtatcactgtcttatctggggggggggggagtgataaaggtgggggttctgttttaaaagtcactgtggtcgtagacaatttccaaatttttatgccatgttatgggaatttttgtagttgctaggctgtgctatgtgctggtgaggagggaggagtcttttacttttattatatctattgttaaaactatgtatgaccgaatgatgttatttatttgtgtcatggttgactatttgccatatgtattctgccaccggtcctgctactgccactggtatctcgagtgaaaactgtttgctcctcggtgcaataagccagataacatgtcacctaccggaatgccgttgatgtctagtgatgttttatctgttgatatgcatgtttggttggatacttgcctggacgattataataattttttgagatgttggcttcattttggtgagtgaaaacattggccagttctcttcacaagggaaacaggttttctgtccatatttcgactgaaatggtacaccgtcaatcgcttgctgtaatctgaagcattgtaaattattggaagcatagatgtcaaggtacaggtaatctgtatcctgttagatcagcgccatctctacattctactctgtaaataaatggttgcatgagttgaggtcccagtaatagctgagaaacggaaataatagtaactgactcttttttactcatcatcgctgccaaatgaactgacgaaagtatccggaattttagttagttttctgaacatttctcaatcttagctagatgggaaaattgacctttagtttttctgcacctacctatcatcactgctaaatggagagacgctaaccatgaaaacatccaaacatttagcttgttggaaaattcaccttaacttttctgcactcgtagaacattcagcataccctgccaaatggagcaagctaaccatgaaaggcatccagaatttcagcagtttttctccctgaatttctgaatcttagctagtttggattcaccttagcttttctacaccaccagaatttttcccctccaacttaacaacatttggatgacctccttcggtcatcccgacaaaaaaacaccaccagaatttccaatgtattatcctagagtcccgctccggtgctttctacttggaatagaaagcaatctgagccgttcatcatatttaattgtagggttgtgatctatttctactcccaccagagttagtggtagtagaaatgtgcaagggtatattcgttcagggataataattcgtgcaggggtattatcataatttatcagtatctaactcatcttcggcgacgccaccgccgtcttccagcactgcgacatcgtcgcacgcctccccctccgcggccagcagaacaccatcaccgcccagtcccgcgccacaggcttctcgttccaggactgcagcatctacgctgacaccgacctcctccgcggtgcccccgccggcaacagcgtggagacctacctcggccggccgtggcatccgatcctgagcagctcgccattctccgacacagtggaaaactaatggctgattcctccgacactatggcaagaacttgccatggagctcaagaacaccctctcgacctcttcagaggcatctctgctaatcaagcacatgacgtactccatcactgatgcatcgcacatcaacgtgatcctgccatcatcgccggcgaagccaaattcctcttgagacatggcgaggagctcgccgaaaaccaccgtgcgaaggtacaccaatggcaccctcgaaccgtgccccgtcaatggtgtacaccgcgctgtggcccttgtcggcgagagacgacgacaccatgctgcagcaatcgcctgtggtgcctgccgtgcccatccaccgaacctgatgcgatgcgaaccgaacaaaacatctcatgccaaaattacccctaaactatattaggagattacttacctgcccttttaaataaacggtcgagattaattctacttgtagtagaatactgcaagtagagtgcaccggagcatcacccattatcctaatgttgggttctgatcacatatgagagcctgtgagtcagtgagccactgctttgcagcagttgatgctactacaatgtctcattcctcaaaaccatgctaacatgtgggctggttcataatgttaatgcaccactatatgtacacatgatccacaagtgcatgtgtagtgtgtctgcatgatctgactgactgaactgattgattgatttccagatgtttcatgctctagatcatggcagattgatccatatgttgactattaccttccttgtcgatgccgacgatgatccgtaacctcctcttcctcagcatcctcgtcgttttcgcttttttaacttctttatcctagttcatcttttgattttctcctttgcccaactagctttccttaattcattcatccatccacgttctttgtacagtagatatagagctctctttttttctttcttctttttctttgggatgcataaagctctctctactccaccaattaatccacatatgcagtcaccatcacacgtaatcttgtgcaaacgtctggtacaaaccatttgaacattctcttgctatattttgcgtgtgattaactttttagcttgttatatattctcttgatgaacagactagatcactagccgatagctgccttggatgtgtagacaaataacatgtcacccattttcttttattttttgctgaagaatgtagtaataatgtatgcatcgatgttgatgtgtaacttccatgacaacaaaaacccggcaatgctggaaatttgtcaaacactcaaaactttttatatatatgctcttcacatcgaataggtcagattcccaaccgaccacaagctgcaaaaaggcaaataatatcatcttctaagattttctgctgaaagttaatgaaaaatgtgagcatcaatagatgaaaatgaccaatcacatgtatgctcttcagaaggagagaaaagctgaatttattggtaccagaattagtttcagagttagccccactgcagatggggatcaaggaggctatagcttagagatgacccaccctaaatcacatccaaatctcaacactgctttcataatgaacagtcccaacagtagagctgtttcattcttgtccctctactacaaattgatgatcaaagtctcaactttagtttcaacatctcttttgaaaagaaaaaaaaaagaactttaatcccaacatctcttggttggttggactgatgcatggagtggatcatctttctatatatatcttcataaatttgattgttcaattcatcagctggaaaatggtaataaataattgatttaccatagttttcctgtgattaatctaattgtccttctatatgagttggctctatttagggaagctggagattgagaagctgctggtgagtatccagctagagaagctaggaaacccaatgttatgctaccagttcattttttgctacccgttttaaatgttattcttttttcagaacttttgaaattacatgcttgtaggcacctacgtatacgcaaggcagttagctagtgcgatgtgttatttgattttgatatgctgcatgattcatcgtcctcttttcctagcttttattttactttcttatatatatatatgtacacctaattgattctcaactatgttatatatttcgataagacaatatacctttcacatcacagtcaacaatctgaattaattactatatatattagcttttttttggtttgcctgatctcacaaagtagcaggctaccgagcatatgaaagcaacttgaaccaatgtgtatcctccttttgggaagatgggaaaaatgaggaagaaatatggtggtggaagcatgaacttttaaggcagttgatagaaagattcattttagtaatatattgcatattgttgctagtgggctaattatcagatcacttttgatcttgcagctagcactactctgaaagtgcttacccttagctgataatctttttggcttgttagcattagctcattagagtagatatatcatatatataaggcatatagctagtactaataatgtactagcaccaatccaatgatatcatctttaagttgatttcaatgagatcaactcatctctgatgtcacatcatagggattaatcggtcaatgcaatatttcccaaaatgcattatgcatgattcatgccttcaatgcttagacctaattagtccattacctgaacatatatataggatattaggctcccatcatgtcacataacatttagtaagacaaaaggaaaaaagttcataaggatccacttaactcttccaaaagtttgatcatttcaaccaagcatcgattctgggcaagaatcaattaaccctcaaaacatcaatgccgttagctttacatcattgacaccaaaatcacagtgatcccagagtcaaaaaccattctttctgaagcttgcagggatggacaatggaatttctctgaaaacaaaatatttccttggaattgaaacatgtactgtatatattcgtgcatgcacattgtcatgtctggttaaacatagtactgcaaattaatctcgttccatgcttttagcaacaacacaagttgtattattggcagctttaatttctaacgcatttacagatgataattaggccccaaccatgtgcatggtttggtcccttcaggctacctgacagtggatttgccggccggccggttgcaaattaactgcatatccacgaatatattagatggagatggtgctccaatcaaattaaatccagcttaataaaaagctagctagtactagtccaacacacactccacttaatttgtacgtgcagatcgattatccttgtcatttagatattcttgtcactctgtcagacttccaccatgcatgatatccatgtctgaatattggagtccctttttacagctcaagctgtaacactgattggccattaattctgctatgtggtaacctttgatcatcccctttacttcattatatctcatctggctatgattaattgttatatttttaattgaccgaaaggcgttttgatcgatcgagtccatgtctgcatgatcgaatgcagctcaaatcattctgcactgactcgtttttctttctgtttatgtcgaggccaactaagtgtagtggaatggttaattgataggtaacctaatcaattaataattgggccggtggatctctgatcaacgaaccttgaacgaaaaaataatgtcaattaatctatatatacgacatactccttccgtttcagaatataacatgtatgttttggtttttgtctgaagttaaactttttaaagtttaataagcatacagaaagatataacaacatatacaatatttttataatgtatttgtttggtgttgaaaatgttacgttgttgtgtttatttaaacctgattaaactctaatacgtttgacttacaaaaccaacatcttacatcctgaaatagaggagtaattagtcaggagtgcattcattttgcctatttccttccggacttggatttccttaatttggtcttatttaggaaaaagttatatgaattaaaaatgtgatgcatatatgaacagatcatggagagtatatatcttccaactactctctgaacatgcttgcctggaacaaagtcacaaactatagtgtctcagcttgcagatgattgtccacgtgcacacgattatttatgatgcacttttagttgattattattggagctacctagagccttggagattaattaattattgtccagcccgcagtttaattaattaattaattagcacagtatatatactactctaggtgatgtacgatcaagtcgctttgattagttgtttctggtcctggcagaatcatctacagctcgacgctttattcctaggacagatcaagggacaaggagaaaattgcatatctaccatcccatatgaatggcttcgctagaataccattatgaaaacgggcttcgctggaataccatcctcaatcagagtgtcttcgccaaaatgccatcccggacggaaatgcccctggctcttcttcttcctccatcccgcgcgtgaagagctcgccgacggccatggccatctccaccgccgcgccgatgccgccttgctgatggcgattggggcgctgccctccctgccatccccgccagcgcctgtgcagatgaggtcgtcgcggaaggactccggcgacgacgtgtcggatccagccagcgcgcgtgcgcgtggggccggtggcgcagctcctggccaccacc

SEQ ID NO: 77954 - DNA, 3853 bp, Oryza sativa
tgtcaacagccctgtaagctttaggatgccattttccttcagaccaatcaacatgtgtcactgaccaatttgcaattccagttggatcaaccatctgcaggtacaataacggcctgaaatcactgggaagtaaacacaactgaaaaacatcatttaagagtttttgagagttcttacattaaagagggttggcaaatagtgttcatcagaatagcagttatgccattcgtttcccggctgcaaaagtgcaatcacaagatcagtaaagagctaaaattcaggaaacaacagcaattcagtggtcataaagatgtagagaaatgaaccaaagcatttcattggtcatcggaattgattaaaaacaatagtagtacaagtcaaaactcaaaactactgtgtaacaaatgcagtaaggggatttgcactcgttatggtttaccagtgctagaccatataatgctgcatggtgtgcagaaaatacaaagtggggctttctatgtgcattcactgaggaaaaatcacaaggacagagcaagtagcctagtacaagttacaactgcaatgaaatagcatggagatttccataatgcattcactgtgctagtactaaaccaatacgatgctgtctgtaataatattatctaatggcttacacttctaccaatacaccttttaaattcactttacccatttgaatgcaattttaccttacagtaccgcttgaactttgcatagtaaaggaaatcggaaagaataagaactgcatgctgacgtttcactgtgaaccactgcaagaggaaaacatatcagaatgtgtgaggttagactgtatgacaatatagcaattctttagagtataatacccaggattattgaagttccacagcacccgctctaaacatttgtaaaagggaagaaaatgaaaaggcaaagcaacagtttgcaatactttctagaaaaattatgcatattaaagtatacctgtgcaccttttctccaatctctcttaacaatttcaggtagcatatgatcagaatatctgcctgctccatgtggaccaggatcgtcaaaactgaagaaaaagcagttggcgtgtcagtggagaaactataatgtctgttagcaatcatgaatgaaaggggcactggagatcctgaatcaaacatctgttcaactttaagtgtgtctacacatgtaataacattcagggtttaaaggcgtccacttaccagtcaacaaagctgatatttgtttccataagatagctatatacataatcaaagttatgaagtggtacacagctgtaatgagaacaaagtattagggtatggatctaagatatgattaaggataagaacaaaagaaaatgattaacctctcagagagcaagacaaaatgctggttatcaggatcttgcagtgcattagccaaaagcctcctctctgcatcaatcattgaaattgtgccccagactacctacaagaaaagtttctgttgttattgttgggaaccagtttttccagtggataacgggagcttagtgctccttagggcatacgctcttttggtactgtttaaaacctacttgctattatatgttgttttatgaagatttttgtagaatctaaatggaagttacaattaaatttggtttcaaactagaacagaaatcactgccgttgtctaggaaaaatattcaaaaggaatgtttaaccaaggatctgactatgattctgtacctatcagcgattaggcaagacaccaactattttggggggcaaaatgtactagagaaagtgagaaaacgtattgttgcaaaaatgaggtcacctctaaatcaaatctagcaaattaccttttcacttcgaatatctctgccattaaatatcggactagcgtgaacaggcctttctcttgatgcatgtacatatatggtatatctgtcttcatgcccctgaaagtacacccaagtatctggattcagtaccatccacgtgcacctcagcaagtgagcatatcttataactttcatgagattggcatgaagctcttccagaaaataaaacgtgaacaaaaatcaataacatgcattcctgataagaagaaattagtgctacttataattattacataatgcaagattaatcatcaatgagtaaaaagtgcaattaagatctttattacaatagcgtaaatatcataccatgaagaacttttcccaaagcttctcgaatggcaatgaactgggtgtcaagaacatgaaagcaatttttggattctttgactgaactggctgtgccaaaatgatatctcttatgacaatacgagcagcaatctcatcatcagtgtaaaccctagcaggttctggaggaggccgagaactacaggaatttgatgacaccaagtaacaaggtgtgtaatgctggggtgtataaagataggctccaatgcctactgcacagacaaaagcaatcaagatgacaatccagagaggccttctagctgaagacctgttgcgcggtgccatgataaaagtgtatatggccgtacgcaggaaaggagaacttcacaatctacattcagcaagcttcatttatgcaatcatccagtgtcactctcctggcagaactgcccaagaacccccaaaacctgaaaaacatggggaatgagaattgcagcttaatgatttcaatcagcatttttcatattctggttaacaatatggaccgaatgataagggaaatgtatagattatgaaacagctttaatcctaaaaatgatgtcaactcagcatttgtctataattctcgtgtttctttctatgaaagttatgggcatatgctcgataatggaacaaggttcttttacagaagttgtggtgactcagatgaataagatgcaactcctttgttttcgagagcagaccttattccttaggtgaaaaggaagaaaatgtatgcctaaaactgtcattgaccattgactaatgttctagcagacaaagcaaaggattaatctagggtttgatcattgcacagaaaactctgcaagaagagttgcagatcttcagcccacagattaagccacagtaagacgaaatcttgagcctatagcttacactatgtagcacatataacaaacaactttgcttttgtttcttgctggtttataaaacatgtgtaacttgcattttaaggtatgcacgctgcctgcgtgtttcagatgattatcccacattcccctttgcacatgagaaagcaacccccttaaacccctaaaacctcaccaattaccaccaaccgaactagttcgagctatccaatctgaacaaaaagcaaacctaacatctcacatttttcctgttcacatgtattttatagcaagaaacctctcaaaaccacttaaagattccaagcattcactgaaaaatcagtaaattcccgtgcttccgcgcaagcaaagggctaaaactacttgaaagaaacactaaccgaagaaaaagatagaaaataatttcaagaacagaacaaaaaactgttccttcccccttcttgcctcaccaaaaaacccccaactccacaatattagcaacactcccaaatcacaaatcctcgcaagaacacaaacacacaacacccataatcacaccaacgcaggcaagaatcacaggagagaggccctaaaaatccctcctttcccatctccgcatcaagcagaaaccacccaaaaacccaaaaaaaaggggcctttaactgacaagcgtagcaagagcagaatcactcttatcaccttcttgcgaagctggatctcactcacccagggcttgggattaccgagttcttggcgagatcta

SEQ ID NO: 77955 - DNA, 3577 bp, Oryza sativa
tttcagaagtgtagtgcttctgagctgaagacgaagttagaggaccaaggctcagaccccaattgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaatctcccgtgccttagccgtctctccccgcagccgccttctctctccgccgctggtagccgctccagccgtccctagcatccgctgtagtcgtcgcctccagtcgccatcgtcaccaccgggttcgcaaggaggagaagaagcccggccactggttcattttctccgtaacccactggaagtccctcgtcgacgtgaatccgatctactccaccttcgaccgagcctcgccgtcgacttcgtggttgctggacattgtcgtcgccttcttcggcatcgcagcgccaaagtaaagcccgtccgctggttttcctccgctaaagatcgccgaaataccgctgtcatcgtcgaccagtacctcgccgcccttcggagctcgtcgccggtcgtctcccgtcgtcgttcgtcgtcgtgccgcccctcagtgagttcccctcgtcgtgctctttcttctggtgccttcggtttgcgccgtcgtgccctaggtcaccggcaatcgttggaacccaagcctcccgccggtgatgacgtcatcgatgatgtcataaagcccttttcttttctaaaataaatcgtgaatccttttctgtataaggctaaaatcagtttaatcttgtaaaattcataactaattcatatgaactcggaatgaggccgttcaaatctctaaattcatctaaaatcatgatctacatgtttgtttacttttatgtactcttttatttggtttttattagtctttttctttgttttgcgtgttagcttgtcgtttctgtcgttgcgaaggttcgtgagtgcgtcggaagtgttcaagaagactaattgaataccgattattgcaaggcaagtcacacagatcccaaacactatccgttgagcatgttgatcatatatttaaattctctatttatttcaactgtgcatttatattcgaatgtcaccgggtggtgtgaacctattcctttgttatagccaatttgcattgaataccctattccttgatacctcggctaataattgattagcttgaaccttgtatattggtttggttcacctaaatgctatatatatataattgcttagccatacttagaaacattagctcattaatgggatgaatcatactatgttattatttatggttatatttaacggtagctcatgatggttaatcgtgttatgataattaattcataattaaaacttgacaatggtgggttgtgagcacatggttttgaaggttgtgctcatgacaattaaggactagttcacgagctactgttgtgagacattaaccgtaccaaccacaagccaacgtgggcaacggctttaccttttctatagcatggttcattacggggtgccaaactgagaagcggcgagaagtccgtggggtcgctagggagtccatgcctctggttattgagggggtgattatgatctaggaacggtgcagtgtggtgagttgtgttgtgtagagggtgttgtcatagcctctattcgggtactttgcagtatcgcgacacatggtagacatgatgttgaggctatcttgtgggtacagtgatacaactctggccagagtaaaactattcgaatagacgtccccgcggtcatgggtgagttgagcaatgtttttcgtgattagtctcatacctctcacaataattattgattctataactggtaataatttgcttagctcctggtttggagttagatctgtatagccggctatggttgttcaggatggttgggcctaagcagcatgggtgtgctgttcagtgattgattaatattgatgattaattactttattgttttactactcccaaatgttagctaaatgctgcttttgcaaataaacttatattatgccatcctttggtatctttgtgcacttgcatatttgctgtgtggcttgcggagtatttcatgtactcaccttgcaataattaatcaacctcagttgaagaaaaatgatccagaaggagaagacatttggtttataccctaattgatctgcctgtggaagtggagctgaagccatcgctagaccgttaattccgctgttgtttttcttttcttttgtaagttgtaacgatgttattatgatggatttgtatatttaattgtcagtttgtgtacctcggctgattcctggacgaggattttatgcacaaataagttcggaggcgtgacacccacacacctgtccctccccttgttccgtaaaaaatgtttcacctagttacttacaatgtttcactatgtatagatctaatattgcagtggattaaaatattcttttacaacagatcacccacatatttttgaaaccctctattaagggaattcgtttcattttttgttgcacaaaaaatgtttcacctaatgtactcacaatgtttcactatgtatagatctaatgttacagtgaacgggacattcttttgcaacaaatcacccatatattttggaaaccctctattaagggaattcggggaattcgtttcattttttgttccaccataaatgtttcacctagtctactcagaatgtttcactatatatagatttaatgttgcagcgaaatgaaattttttttcgctatttgctgaaacattgtttcattgtttttatataaggtgaaacaacacccgatttaaacgattgaaatattttcgatctacttagtgaaaattccgatatacttggtgaaacatcgtgcaacatttaaaaataatacaataataagctaattttttttcatcggaatatatgtatgtgtgatcttgttttgaagatttaattgcaagaaagttaatggtgcaatcggatcatgatttggataagtaatttaagagaaaaaatagtttaaagtggttttgcacgtatgagtgacgccgatttgactccctctcgatcgggcgcccgaccaggagtcgtgtcctaaagtaagtcacaaataaaattaataataattctaaaaattttttaataagacgaaaggtcaaacagtgtaaacaaaatatcaaaatctcttatattatgggacggagggagtaacttattagttaccttttcacataaaatttaaccatttattttattcagagtttttttgcaaattaaaagaaattaagtcatgtttaaaaatatttgatgataaatcaagtcacaataaaataaatgataactatgtatatatatgttaaatgataactatctttagtcccggttcaaataaccgggattaaaaatcgatctttagtcccggttgtta

SEQ ID NO: 77956 - DNA, 1149 bp, Oryza sativa
tactaaccgggactaaatatcatagggccctgacacagcctgacatggaatcaaccgggactaaagatgaactttagtcccggttggaaactccaaccgggactaaagatgatttttagtcccggttggtaacaacaaccggggactaaagatcttcctcttattaaccgggactaaaaatcatttttagtcccggtttttaatggaaccgggactattgtggatatgggtcaaccgaccaaagatggtttctctaccagtggaatcataataggaaacggaaggagcggagtacctacttagcacttttatgattcagccatttaggtgcacttaggtggtttatgcattcttaatcactcggtgcattagttgcttgctttgtaatagtgttcgagtcacggttattttatttttattttgctaagtctgggtttagaataaatcaagtctcggtttaagcttcgtcgatcgatttgattgtttgctcttcctggattaggctggtcctttggcatacatcatggagtatcattctgacatgcaagagaaagcaattggattgccaattcataaaagttatctcaccaacaattcgtaaactttatctcagatgggttctcaaataattaatcatttctcaagtaactagctaacggagtctaagtggacttatttcttcaggggatcgatctcctgggcttggcgggaagaaggaagagggaggcgttgacgcgtcgtggactttagaagatatttttcgtgctgggcggtacgatgggtggggcccacggagagggttattggagtgggtcccactgcaggtcccagtcccacacgtaggggtggacgttcggtctgaccgaaaaattcggtctcggttttcggtctttgaaaactcaagaccgaatttcatccaaataaactcaggaccggcaaattcggtctcggttttttttgtctcggtctcggtctaaccgaattcgctggagacttagatggcgcaggtgggcagcgagagctggtggcgactagcgaggccgcggctatggctgcagcaacggcgaaggccacgctgccgctcgccaggcgtaccgcggacggcggcgctcgtcggggccgcggcggaggctggaggcggacggcggc

SEQ ID NO: 77957 - DNA, 677 bp, Oryza sativa
tcagcatcaaatgcattgtcttgaaatggcctggaccataagtcttgttctgttggaatagtccattgttaggaccaaggcgcaattgaccttcactttaagctcatgtggagggaggccatttggagtgatcgtgttcagaaagtccaaagagtagctattttggggatcatcatcgactgaatcaaagctgaggtaaatcttttcctttccaggaaactaatcaatcatcttcgtgttcagcttatccacgaaatcattttttgttgagaggatggcccgtgtgctcatatattccacggaggtcgtatttctctcgtcatcaagcgaggggaacacatattcaatcaatgtgttcactgaatcttcattgtccgaataaccaatgacaatttcatcaggcagacggacgtcatcatctgcgatcgtgttttcagtcccgtttccaatcctaagtagataatcgaaaaccaagggtcagattgtgccctcatattacgcgaaaggcatatcttccttatattttccataaataagatctctacaattcagcatcaattatctgtgcccttgtcccacatgtcaccacgggaagaacttatctgaaatcaccccgcaatccatgacgtttcctccaaatggcaataaatgtccataataagggtctcaactgccaa

SEQ ID NO: 77958 - DNA, 1131 bp, Oryza sativa
ccttagaaaaccctctagtacaagaaagaaactttacataatcaatcgtaccatatttggactccttccaaattcgactccgcatcccatacgcacacaataactccatcgtatgccatatggaatctccatcaaccacgtgcatcaactctagcctaagtatcccgcatgatctctgatcaccacggacgtcgtcttatccccaagccgactcccggtccatcaccgcaaatactctcccgagacatcgagtcacctacacatggaacaaacaaaaaaaccatattccgagaccaagctatctccaacttgactcattagtagcaaacaatagtattacatacgtatagtatccatctagaactcataatcatggaataaactcggatatccaaataaacaacccgaaaccgaaaccgacacagtgtcggccggtcagaccgcgggctgcgccggtctgaccgggcattacacgccggtctgaccggctaccaaagcccggtctgaccggtccacattaaatcctgcagattcacctgtgaaatccaatcatcttcaaaaccacttcgtgaataaattccaaataacaaaaccaataatctccaatgcccaattgttcatcacagagtaataatcaaaaacacctttggttttacaatctcccccttgatgaacacattggcaaactcacaaaaatgttttggtatttggtggtaaaaagcacacttcgtacaaatgttcacatcgtgctcaaaaatccaaaaaaaaacttctcccccttttgaaaagaaagaaatacccaattgaacaaaaaaacatgctcttcaactctccaaaaaatcaccttgcttctcaaaaaaaaatccaaaaattttcacattacttctcccccttttgacaatgatttcatcaagcataggaattatattcattaatgttcaagagcttagcatacatatagcatatcaagtcatgtgttgcaataaaaagaagattaatccatctataacagaacaagcatgcattaaagtataaccatgaatcaaagattttacaattaagcttgaatcaacaatcaaaattcatgatttcatacgatttataatgcaacatcttaacaagcacataggt

SEQ ID NO: 77959 - DNA, 755 bp, Oryza sativa
ataagaatgtttcaatgtaagcaaacgctgtggatgccacattgaggaacatgtcagaacagacagccaactaagcctatcttcttacttgcttttgctgtattcgaactcaatatgtaagcaatcctcaattccaacttccatctgaaaggaacatgcaagatcaagagttacataaccaaatatgtcttcatgtctttcacacacactaaataaagcatcactgtgaccatggcgaatagcatgttagtcaagaaatagaagtgccgaacagtgtatgttagtcaagaaaaaaaatactgttggccacaacggaataaaatattatgcagctacaatctacaggaatatcagaaaaaacaatagcagctgataagcacaattaaaaggtacgatcttaacgaagcgatctaatcagcatatttcaggggaatcaactataagaattagtcaattaaccatcaaatgcagacaccatttgcaaagtggtgcctattgttgaatacttgactgatgaaaaatcaaaagtaggaagaaccaccatttgtgagatgcacaaatcacaaatttccagggtccatcctggagggttgtagtgttttaaattttccgctactttaggaaatattatcaaaactcataatatcatgccagacaactttgtttctgagaataaatacaattgtcacttgcccaaaaagaccaaaacaaaaataaacttaaggcatacattaggactgtacaatcctggtaaa

SEQ ID NO: 77960 - DNA, 510 bp, Oryza sativa
aactggatgcacacagcccacacgcacactaccatatgcacacgcacgtgtgcgcttcctctacacgctcctgaaatattaccaaatgtatttgcatggatgcgtgaattgtgatctccaggtaaactactagcattacacaatacaaatactaggagctgtattgttttgtgaagacgtgccatagacagacacatctgaaaggtatgaaatgaaaagcatcttacatcatcaatgacaactcaccttgatactgttgttgattgtgggggcaggagagtaatttcttacctgtaaataatataaaaaaattaaaactcctatagaaaaatattatgcagatgatactacaacaccagaaatgcaatgtgttgaatttatttttgaaatatgaaaatactactgaagtttcaggaaaagaatatcaggaatcatgtgacaattcacaacacaataataaataataagcctacataaaatccaatgaaatccatgaaattaccaaattta

SEQ ID NO: 77961 - DNA, 907 bp, Oryza sativa
tggattgcactctagccgaaccaacagtgtccatgtgtaacagctgtctcggtgcatccgtcatcacagaaacaataggagcatgtgaagtagaaaccatcttagcatgacgacacggtgtacaaaccaaatcaagatctttcttaagtttaggcaaaccacgaacaagatccaaaccacttaacctagtgagatgatcaaaaccaacatgtccaagtctacgatgccaaaacatcacatctttatcaaacttagcaaccaaacatgttatcacaggtgaaacaggattttcaaaatcagctttaaacactcttgcataacgagaaatattcggcatagaatcaccacgagaatcaaaaactttacttccagttttcttaaaatgaacctcaaacttttcatcaacaatttgtgaaaccgaaagcaaattgtactttaaatcctcaaccaaagcaaatttgtgaatcctcaacaatttgggatggagtcgtctgcgccgtttattttattttccgttgcttagatctttattggttgagaggaactatctacctctgtaatgacattatattcgctttattaattagagtaataattttactctattatcaatttgttattgtgtgcctcggctgattcctggacgagggtttacacacatataagcatttggaattttggatagaaattccgggcgtgacaagttggtatgagagcctccttgaccctaggttatgccaaatggttacccatagaagccctctaaaaatattgaaaaagtagaactgttctcctctctctcttttaattaaaccaagctaatggcacatgcagttatagtccctttaattgttctcattcaaaatttatttattattcctgtcttattagtactatacatctatta

SEQ ID NO: 77962 - DNA, 7456 bp, Oryza sativa
  unsure (1)..(7456): unsure at all n locations
aatctatatacaatgatttaatccgatttaatctttaaaaattcataactaattcatcttagctcgggtttagttgggtcaagctttctaattttttctaaaattgaggatctacatgttaaaaatatccacatggtattgttcatggcttggtttatgtggctgttttgggggattttggctcttttctggcttaggattccggacgttcccgggggaggtccgattttgcaaggagaagactttggaaggagttataagcggctagcaaggncaaggtcatatcaggattctccataacaaccctttgaggcatggttggattcctcgtttaaaggctttattatttctattcaacctattgcgatttcattttctggaatgtctactggggtggggaataacccctattggctttgtatagcccttttgatattgattatctattctttgtcacttggttaataattggattagctagaacattatatggttttagctaaagtgaataggatgcttagccatgcttagagacactagctcatataaaggggatacttatgattcactattatttaatgatggcttaattatagttcacgatggtcaatcgtgattggttaattaattcatgtgccaactaaaacatgataatggtgggttgtgagcgcatggttttgatggtcgtgctcatgacaattaaggaccggttcacgattttcggttgtaaaacattaaccgtgccaaccacaagccagcatgggcaacgactttactttctgtatagtatggttgatagtagagcacgagactgtgaagtggctgagataagcccacgagggtcgttggggagttcatgccttgtttacaagggggtgattatgatccaggagcggtgcactactttgaattgtgttatgtagagggtattgtcacaatctctattcgggtacttgttaagtatcacgacgcatggttgacatgatgttgaggttgtgtcttgtgggtacagtggtacacctctggccagagtaaaactattcgaatagccgtgcccgcggttatgggtgggtctaacaatgtctatcgtgattagtttcacacttctcatcataaaaaaaatgatgctgtacttgttaataacttgtttagctcctggtttggaatggtatattcctggtttggagatagaactttacagccgagattggttgttcagaatggttgggcctatgcaacacgggtgtgttgtatagtgtggatttaatattgcttaattactcaactgttttactattctctcaaatgtttattaaatgttgtttatgcaaatgagcctatgttatgccatcctttgttatccattgcacttgcatatttgctgcgtggcttgctgagtatgtcatatactcaccttgcaatcattcatcggaggaggagttctacagtgatgctgaaggtgtggatgattaggcgtagccctggtcaagctgcttgtgggatggagtcgtctgcgccgtttattttattttccattgcttagatctttattggttgagaggaactatctacctctgtaatgacattatattcgctttattaattagagtaataattttactctattatcaatttgttattgtgtgcctcggctgattcctagacgagggtttacacacatataagcatttggaattttggatagaaattccgggcgtgacaagttggtatgagagcctccttgaccctaggttatgccaaatggttacccatagaagccctctaaaaatattgaaaaagtagaactgttctcctctctctcttttaattaaaccaagctaatggcacatgcagttatagtccctttaattgttctcattcaaaatttatttattattcctgtcttattagtactatacatctattactgtactgatggcccaattacgagcaaaggttttaaaacattgttttaattaatcttgttgcaataaacttagcatgttgatattataactctcttttatttcatttcttttgaaacctgttattcaaaagtccaaaatttgtactcttgttttcaactgtttcatcttatcttgcaaagattggtttactttatttatttaccttttactttgattttctaactttattcaaattaatctaaaaacttgtgctattaattggataaatatcttaactccctcctttcacttgtctttagatgccacgcttcaagcctgagtacttgttcggtactgagggatttgtcctggagttgcgtacgatgtctttcctcataggattcgggactgcccctttgtatgcccagattcctcatgatcgtgatgaagagaagtgtcgggtcaaggtcaccttgaacagtaatcgtgaagatatcccatcagtgatgttcgaggctggagggggaaactgtattcatgcttgtcaggaggtggcaaggattaccataggagagctccgcgaacgctacaatgatcagttggccgacaccgagtatcgctaccatcctcgtcaaccccagggaagtggtcgtggcagctaccttgaacttgcaggaattgagaatgatgctaccacaaggcatttggttgagatgctgtgggccatggatgagacccgcgctgagattgtgttagcagcccaagatcgcgaagaccggaatcgtggtaagatttgcaagctggaggacaaggtggatcgtttggagaaggaattagccgcattgaagggagaagcaccaccgcagaaggccagggttcgtcttaccgcaaggaagagagctctttttgtccctcgctaccagttggcatctaaggttcgtgtggtggaagaagaagaagctgccccagccccagtgaatcttcccgtcattaatgtaagtgatgatgaaggagaagagtcaaagcgcacccattcgaaggttgagtggggagctacccaagatgatgagatcgagccttcaatcaactccgatgcccggaagacctagaacgccttgttaagtctttgccttagatcgttgtgttagtttgcttgtttaagtttggttgtgtgcgtgggtctcgcttgtagtttacatcattggtgggatataaatgcatgcgtttgtttgctttcgagtgttaggaagcttgtgagttagtggtgtaagagctttcagttataatgtaataatgaaactcagttaagagtttttgagggaggagaaccaatttttatcgccggtcatgtgccgcgaacaaccggaatccacgatccacacgttctccttcctttccaccaaggcctacacacaatcagaagtcgaagcctcagtaccggggttagacaataataaaaatttaggaatccagtactgagacacatgaccagaagatccaataggcatatatccacgtgcaaaatcaattttagaattttcagaaaaattcctccgaggccggtctgaccgaggtacagtggccggtctgaccgccactgcaccgcccgtctgaccggtgtcctcgagggaaaaccaaatttttgccactttgattttgcaaaagcaatctctctcttctttttctgtttatgagctaatctgaaacaaaaaccaacaatatgccatctttgccacaaaaagaacaaatatatttttcacgatgattagacacattggtaacattagaagatttagcaacaatagtactaataggaggttttgcatgcacaacattggattttgaagaagattcattcatagtagacatgataccagcagatttaaacacagttttattagcatcaggtttaaccaaaacctcaccacttctagcaccaacacctaacacaacaggaggatatctagaattatgagcataaggattaaaacctaaaccacagttatgtgtactaacctttgattgatccaaaatcgtgttgaggttctttttactatcagaaaatctttgcaaagaatttttcaaataagaaacctctttttccaaactagcacaattttcacaatctaccatgacacatttgctttcacgacatatggggcaagaaagcactttgttgtttttcacaacatcttccatgtactcaacatgacctgaagcatcttttagtttcatcttattcaaattacatgttgagcaatccaaaacatcatgaggttgttttcactttttagcagaaatcatgttaaacatcaaactagcatgaaaagtaatttgatatttttgcaacaactttttagttaaaaacaactcatccaaagtgcgtgtacgcaaggcaaaactacgagcaagagaagatctatttttcaaatcatgtgcagcattaatatctctaatttttgaaatctcattcattaaaacctcacaatttgagcaatcatcatcattaggaataagagattttaatcttgcaacttcagatttaagagattcaatgataaattcctgttttctatacatcttctcacacttctttttttttcactcaaaatattaatagcttcctcaaacgcacttacctcattatgttcaaactctatgtcagattcaccacgtgccatgaagcaaacatcggagatgttcttccccttatcatcatctccactttcaccatctacatcacttagtggctcgaaggcagcccaaacttgttgaaaagccttcctaagattctccatcttcctcccttgggatgtacccttcgacttgttgttgttgggcttgttgttgttcgtcttctcaccatctttgtcttctcttttgcctctcccaagcttaggacaatgcgaacgaagatgatcaattgaaccacattcaaagcaccgatttggaccacatcttttcctgttcctggcattattcatagctcgagcaatacggttagcgaccaaagccaaatcctcctcctcgatttgttcgagttgatcatcggatatggcattaaaagcagcaagaaaagaaggcatagatgaagaagcatcaacatccaaagaagaagtagaagaaaccaaagcagtcgacttagaatcaacttttcgagaaagaacattcatctcatgtgttttcaattttgtgtaaagtgaatccaaagtcaaagtagacatgtcaacagactcctgaatagatgtaactttcatctcccaaatagacatattaagaccattcaaaaagtgacgagaaatctctgattgcggataattagtatcataagaagaatcaataagatcactcaaaattttattaaacctagaaagatagtcatcgaaagcttctccaggtttcatctcaaatttaatgtactcctttttgaaaatatcacgacgaagttgttttatgttatttgttccttcatgaaagttactcaaagcattccaaatctcatgagcagttcgaagatgcgcaacacgatcataatcagaacgagaaataccactcaaaagaatgttgcgagctttgcaattttgttcaaaagcagttttttcagcagcagtattaatagcttcaggaatcacataaggatgagaaacttttctccaaagatcataattctcagccataattgtcacaccctaaaaatcccaaaaatataaattattgtttaattggaattattagaaataattttaaaagcctagaagcaaagatctaattttaaataataaattccaatataaaagtggcccagataaaattttattaaatacttctcttgattctatagttcctagatttttctaggatttatttgagccaaggaagtatttttaataaatggaattgcatttcatgaataatttaaattgaaaaaggtttttaaattcctccttttgactttgggccgaaagtcggcccaaaaccgccctttctctctccccggcccaagtcagcccgtagccgagccgccgctcgcgcgcgctccctcccgctgacaggtggggcccaccagtcggggtcgtcgtcttcctcccaccgcacggccgcgccctagccgccgccgccgcccttccaattcagccgcgcctttccatctccggtcgaattgattgaggggaaacgatcttctcgatctcctctatcttttctcttttggaagcatcgtctattctcctttggaaatcgccgaattcgatctcgaatcggattcgtttttcccctccgaaccctaatctttccttcccgtcgccggccgccgtgggccttcgtcgccgccctctagcccctatttaaggacacccgagacctcctctctccgccgccaccctcgccttagcccgccgccgtctgtagcgccgcctccgcgtgagctcttgcgccgccgtcgccgccgtttgtccagccgtgcaccgccatcgctccggtcgtcgtcatcgctcgggaaggccgccatcgagatcgccaagccatcgccgtcctcgtccacctctccgtttctgccgaggattgccggagcaccgccgtcgtcgtcgtccggttgccgtccgccgccgttcgtgcctcggtaagattcgccgcgtcgcccgcaacccgtaggtgccctccgtttgcgccgccgcgccgtcgttcaccggcgagcgtgcgaggttgagccgccgccagtggtgacgtcaccgctgacgtcatcgacgccgtttcccgtggaccgcgatggattagatcgatctcggccgttcgttttgaatcgattagatctcggccgttcgtttttgtagaccgtcgccgtgcacccggtccaccgtgaacccgcgccgctgacgcaataccttttttcttttcaaaaataattcattattgcgtcataattcaattaaaatctatataaatgatttaatccgatttaatctttaaaaattcataactaattcatcttagctcggttttagttggtttaagtttctaaatttttctaaaattgagatctacatgttaaaaatatccacatgtactgttcatgcttgtttatgtgctgttttggtgattttgctcttttctgcttagattccgacgttctcggagagtccgattttgcaggagaagactttgaagagttccaaggccagcaaggcaagtcacatagatcccaaacaaccctttgagcatgttgatcccgtttaaagctattgtttctattcaactattgcatttatttttgattgtcactgggtgggaataacctattgcctttgtatagcccttttgatattgattatctattctttgtcacttggttaataattggattagctagaacattatatggttttagctaaagtgaataggatgcttagccatgcttagagacactagctcatataaaggggatacttatgattcactattatttaatgatggcttaattatagttcacgatggtcaatcgtgattggttaattaattcatgtgccaactaaaacatgataatggtgggttgt

SEQ ID NO: 77963 - DNA, 2287 bp, Oryza sativa
tttaaattttaaaaatgtattaatatgattttttaaagcaactttcctatagaaaatttttgcaaaaaacgcaccgtttagtagtttgggaagcgtgcgtacgaaaaacgaggtgctttctccctcagtatcctccaaacgaacgctacctaaatatttaacagtaactagaggaaccaattaatgactgactacatcttgttcaggtacatatatgtacagaaagaaatagctgaagttatccaacaagtgcacagctagaaatagtactgtaagtaatacctactctttgtacatatacatttgtatctgttagctaaaatacaagtgcaattcgtacaaatttgcattggctctaatcaattcatacacagtatagtatactatcttcttttcttatagataacgccattaacttttaacataacattcaaccattcatattattaaaacatttagtgtaaatatttaaaagtataagtcacactgaaagtttctttaatgataacaaagtcatgacaaaataaatgatacctatataatttttaaataagacgaatgataaaatatcatgccaaaaatcaacgatgttatctattaaaaacggaggactacctcctaaaggactgtaaaaaatcacttttgaggaaaacgtgaactgccattgtcagtatttctctgtgaaatgccaactgagagaaagtgtaaaagaaagatttttcccttcatggtcccaaactttttaccttaagacccagtgaacttccatgaaaaattgcatttcggaagctggtgtttttttgtgaagaaaatggtgtagttgttgccgctattgtgtatccgtccagtccaaaatcctgaaatcaattataaacaaaattatgtagccacagcacatgaagcctagtggtgctagcaactttaatactaattcgtctcttgaattctttggatagtgagtgtcatggttgggagtgttaaggatagacgatagagtacttgtgaatattccaaataaaacataaaaaaagaagatgatttggttgagaaagtgcaggcctttcataagaacaaatcccaaggagcacatgagtacattttaaacaacttcaatacaacgattcatggaacatgctaattggacagcttgggtgctaaagctgcatcatgtttgggattggaataaatacatggctaccagtagttaagcatattgcagtggcacatctgattgttctgtgaaaggtggtgccatcatgaatcctagccttttctctgaaattcggaaacatggaacattcaagaagctgtagtaaagcgatttttatagagataatctaactcttactagtaaacaagaaaaattaactaaagcaaaaaaaaaaaatcagctcatgattgcacatctgagagctgtgttggcttgtcggtgatgcaacacaaacatcaccgattcataagcatagaattgtcctttttaaaaaatggtggtgtggatgcttatcaccagctggttcaggatcaagcgagacatttttcaaactatgcctgcattttgtctacaaaatcatgcgcattcccggctttatggccacaatagcagatgggtagatctaggttaagcagagagcagcttctccatgatgattggcactttgacagcagtgcatgccctcatgtcctttggctttgcttgcatatgctcctctttcttggatcactctggtgttcatcagcaaaagtgtaatgatttgtgtgatcttgggattactaccctctccatgacctatatctgtccatataaaagaatagaaaattgaggacaggtagctagcaggtacatgtttgaattttaaacttgaattgtgttatatatactgtcatatactccctccctccgtgtattttaatgtatgacgccgttgactatacgaccaacgtttgatcattcgttttattcaaaattttcgtgcaaatatgaaagtatttatatcatgcttaaagaacatttgatgatgaatcgagtcacaataaaataaatgataattgtataaattttttgaataagacgaatagtcaaacgtcggataaaaagtcaacggcatcatacattaaaatatagaggtagtactattttatttgcttttcatctgccagaaaacactgttgccttcagactaattgagagaattttttttatttataatttttttattaaaagttttacaaaaataattttccattttgaaaattgacggaaatagtcgcctaccgccctctgggaggg

SEQ ID NO: 77964 - DNA, 2488 bp, Oryza sativa
aaaaaaaattaataattatttaaattttttatataagacgaacggtcaaacatatttaaaaaaattaacggcgtcaaatatttaggaacggagggagtatattttaaaacggtgggagtactgttttgtttgcgtgacatgcctcagaaggtgctgggccacactgctgcagaaatgcaggagacaacagctaacagttcatagggagaaaaagtgcagtgtggtagcagaggttgtttcaggcaaccactgatattcctagaaactaattgtgtctatttatctgtatgcactgttaacatcattcagtaatacatatcttgctagatgcatgaatgtgacggatgcaactctgaaataaagatggggcggagatgtttgataaagataatcgagcacaatacataccatatcatatttgtattgaaataggataaataatagaatgtaatcaataaattaagacacaaaaggacattcaacataaaaaaagtagagtacaatttcggagtcgcattgcaaccacagggtagaccggtagaggcatggccctacgcatatcacgacgtcacgcagatacagagttatagcggtgaagaggatgagcggcgagccacaagcaacaaagacaaacaatcaagggttggaatcatgcctagccctgagtgcttctttggtttgatggactacttatgggctaacgggtgatggctaatatgggtgagccaatattagaaggaggttcgggggatgtgggctatacctggacttgttgacgcattgtgtagtttggaggatgctgaaagttcctaaatgtgttaaggagctgatgctacaggattgtaattttcactcacaggtcaccaggacatgaaacaatattcagttccttgtctcgagattgtcccactattttgacattttgaccctttctaagaatttatttgaaaatatatcatgaaaaaaactaacaaaaatacacctcagtcccagcgtcattgttcttagcgctcaagtataaaatctcagcgccatattctttgcgctgataatgtttatatgcttcgtccctcatgacagaggtaatggaatggtggttaggtagccttcaatccaacacaatgttgtgggttcttgactctctctgcccacatgatatttttcttttactcaactatacagtccgagcatacttcaaacatataaatatactttcattctttctcccacattattattttgaaacatatactttacttcaacagtatattcaaagttatatatagtacttccgttgtttttttctcacagtattgtttccaacttttttgtattaaccgcttggggaaaacaaaccgaaatcaaatttgaatatatttcaccgcaagaattcgatttgcttctaaaactgtacttctacctcttgggaaaaaaaagtaaaatcatatatattcaaatgcaaggattcgagttgcttaactgtacttctacctcttgggaaaaaagtgccggaagaaaagaacgaaagatttccttgtaccgctaaaaagtgccaaaagaaaaaaaaaagaagcttaggctgcttgctacctcacgcatgcatgcacgaaggccacaacaccacaccctacaacaacattattactccctccatttctaaatatttaacatcgttggttttttagcacatgtttgatcgttcgtcttattcaaaaacttttgtgaaatatgtaaaactatatgtatacatgtaagtatatttaacaatgaatcaaatgataggaaaaaatttaataattacttcaattttttaaataagataaacggttaaacatattttaaaaagtcaacagcgtcaaaatataaatattttgaaacggagggagtagttaatacgatatatgctagctagccattagttgtgagatcagctaacgagcatcaaattaagatgtggcgctgagatataagtacttcaacgccaaggattatgacgctgagattgagttttatttttattttgtaaaagttttttgtagggtctattctttaaataagtgtttagaaagggtcaaaatgtcacattttgtcgtccctgtcccaagaatgcggggacaatatatcgtcgtctctgccttgttaaaacctttcgaaactagtgctacgcatttctttgatccccttacttgacctattgatccaggaacttctgtgactacttgcatcattttccctgccaaccatcacgacatttgatcaattataagaattaccaagcctatggaacctgatccagggagccataactctggattttactatgcgtacggtgatgaaattatcgatctggagatggtacaacaaaggatagtactcagccacatcggcatacaaagttcagttccaaattccaaggatgcatggttatactatccattgttctgtttgacgcgtatgtttctcaaactatataaacgattcatttttt

SEQ ID NO: 77965 - DNA, 7462 bp, Oryza sativa
cggatgggagggagaccggagcctcggccatggccagctccttcctcgccgccaccctggaggaaggcactgtactcgtggaggtgagggaactcctggcccgacgacgcctgggtgttgaggtccagcgtgtccacgccggtgcggggaacggatccgtgggaagggccggacgccgacggctgcgagggccaaatgttgccggcggcggacgaaatgggatcttgggagaagaaatcgaagccgttggggtccatctccgcgcggattcggtgcacagcgatgcgtcgacgacggatctgatggccggcaacgcgggtggggtgagttgccagtgtggatgcctctcggtggatctgaaggaaggggcagcgcgattcgagggagagggcggcgcgggtgaagggccgggcggcggcgtgggtggggggagggggaggagaagctagggccgggcggcggcgcgggtgtggggagggggaggcgaagctgggccgggcggcggcgagggttctagagagtgagcgggggcgacagcgagcgggggcgaaatgcgatgggttttgccgcaacgggatcggcacaagtgggggaaagtgggaatcggtggggcccacagcaaaatagccccaattagcacccggtgggggtgataattttttggggtgggctatttgcaaatagccctaaaatagccctcctgtttggatccccttgagctattttggggttaaaaggggtgggctaaaaaatatccctaggatccaaacaccgccatagaacgatattatgcatagagattctccttactatcttgtaccaccggtaagtacacggcaataatttgctgagccagctttatttcctcttatgggaactgttatacctgcccaggggtactatttttggtagatgcatgtcggccccattcttctcttgtcctagtatatgcagtattaccttagtcctattgcatatactacattcgtcctattttaagtgcatctatagtttttcgtgcctaacttcgattgttgtcttatttagaaaaaaaaattaaaaatataagtcacacataagatacttatcatgttttatcatcttataacaataaaaatactaattataaaaaaaatttaaataagacggacgattaaaattggacacgaaaactcatgggctacactaaaacgagacggatagagtagtattaatagagtagtattaggaacagccttttgacttgtctacggcaatgcacaaatagtaatcaatataatctaatcatatcttttattgataggaacaattgtttgcacagtactgatatatgtatattttttttcatgttatttcagatcatatacatgaaactcataatcaaccttctattctgttgatttatataattaataatttgaatctgtagacaatccagatcatgctatatggagtataacattattaattgcctctttgtaaataaccattatcagaactatatattcatcttcaaactttgatcactactcgttctttaaaagacaaatacttaaaaatgtattatcaaagtgtgccgcattaatcgtgaaatagttttcgtttatcatagtctaaccatttgcaagatattagatgcatcctcttgttttctctcaatccctccaactcaactcaaattgtactcagtgatgccattccttttacacaattaattgcatgatgttacacttacacaccattgtttacgccctaacgaaactaatgtgtagtgcacgtaaaacgaagcgattcattagcgcataattaattaagtatttagttttttttaaaagggattaatatgattttttttaaaacaactttggtgtagaaattttttttaaaaatgtactgtttaatagtttaggaagcgtgcgcgcggaaaacaagaagaaggaagttaggaaccgaagtaacaaacacaaccttagggcactcccaaccctccacctagtatgatgtctatggcattaactacattgccatgtaggacttttagcttatgtggcactatattaattaagagagagggagtgaagagaggaagaaactgggtctcatgcaagacacagcttcaacacgagaacctatgcactagacactatcaagttttgcattgggagagaatagtgtcttcataatagatgaaaaataaatatgattggtagagaagagatatgatgtatttattaatggtctattattttaagaaaccatggattatatagtgtagtgtgatttcttattgacatggcaccatagacactgcttatggacaatatggattgggactgtctttaatccaatcaaaccaaggccaccccgtgaatgttcactgcatacgcatagcactattcacatgagacagacccatggctgggcctaccaaccgtcacatattgatctggaaggacatgcactattcagcgcgtgtgagatgcccaatcaaagaaataactgaaattgatgtagataatttgtttacttaaacaccgtgggaacgctggaaagttaggggtgccacgtcagatgttacttttgtaaaaaagcccccgcagttctgttaattatgcattggtccccgctgataatttatagtataaattagctaggtttggctatcgttgagcattggccgaaattctattctattaactaaacaaattagctaggtgacttgaagtgaagtgagtgtactcaccatccaattatagttaattagggtctgtttattttgttgccactttcgattcattaatattcatgtgtgagggcgggaatattgtgaacattttaagttagttttttttattagaggaagtatatcctaataattgattctcatattttattgatagtatggagcgaatccttgagaagtatgacagacatgagttattatctgaaggaaataatgtgattgaagagttccctgagctggaggtgtgtacgtaggaaggggaaatgttcatcataacatttgtacattcatcctgtataaatatgcactacattatatatcactatatctgttcaatgtataggtagtaaacaatttttagtttacatcttctgtgttctgcgcagggaagcatgagctatgaccacatcaagctgaggggcaggattgaagctctaaaaaagagccaaaggtaacaaaaaatctagacaaaactaatagctcttcaatttttcccttttctgtatttaacaaatcaactggcctttccaatgtagtatgccgtgttagtttcaatatacagaaaataggaacagtatctgtggatacccaaaatatgctacatatttctgtaaacttttattggtttattaataagtattaattaatcaagaagagggatatttaaaaaaaattaaaccctgcaacatactcttctgggaaatgatcaatcttttttacctggtgggaaaggatgatcatattatttttagctcgattatttgtcgacacatatactttattgaacattgttgatcagctcagcatgctgaatatatatggccttgaatcaatgcattagtctgaaaaaaaataggtgcaaagcatctttctttaataaaaatgtaagtgcaaagtatcttcatcttcttgaatcttggtactagctagacagtggattctttattgatggctcaagtttgtcactgtcaatacaaccggtaaaatattacaatcaataaaaccttttttttaaattaaaaatgtcatatatgtccatctagtttgatcttatatatggatttggctcaaaagctgtctgggaatcagtggacaaatgctaaaacgcagacacctattcttgtcaaatgtatatctcctttgtacttgtgatgccctagttgttggcaggatagggacctcatgctctcatacttgtcatccatggctcaggaatcttatggggcaggaacttgactcgctgacactgcaagatatccagcagcttgagaaccagatagacacttctctgaataacataagatcaagaaaggtacaaacacacacacactgaacttatagaactacaaaaatatgtttacttgagatgatcatattgtgtggtgttgctaatggtttttaatttgtaactaggaaggtaacccgcgcgaggcatgtgttgtacactaagtttgagatatttataagagcaaaatattgaacggagaacatctagcacaatttctccataaattgttatcatcggcatcattgcttttataatgttataacctattagttttatattgtatcatatttaaataatatctattagaaattatttataatcttctttatcatttgaaattaagagacttattttttttaagaaaacatgttaacgaaagtaaaaatatggtgtttttgaaattacatatctatggaccatagttcattaaaggattaattaggtggaagatgaagctccactaaacttttgggtttatatagtctaatatggttgatgtagtttgagaggcaatccatatatgaacatttcatgtagggggggtgagaggctccatgcagcctaacatgaatacgataacgacgaaatataattgcgcagtaatattttaaaaatattatgtaccatgaataaattcttttttttaggtaagatagatttaacgattataactaatagtttaccggtttaaaaggcacatgagtattgcagaatgtagcttaaaattatggttgttttaatattcaatgttattgcgaagtgagcgcacctcaactggttaggtttcttgtggtggaacttgcccactcggattcaagtcctagatttgatatgggtgttggcatttacgactaattattctttcagtggtaggtgacgtatccatcgacagcgagacgacatggtaacttcttcaatcttaaaatatgtcggctcagtctttcggaggtactaaaggggtagggtgcgtagacgctgtgtttctaagagatttccaatattattaattgtttccgctaaaatctatttatttttttcttaaaaatgtatggattagtttttgtcaacaattagtgaacaatagctagtccgtagaatatatatctgatccaaagtaatgaatttttttaataatatagttaacttggttctttagttttaaattttatagtaaataatctaatttatctcctacttatgctacattcgatctcattggttgagcttatgtagggcacacaaaacgatataggccattaacgcatgattaattaagtattaaatattacaaacgtgaaaatagtttttttttttaaaaaaatgtatagaatgtatttgcacaacatgcgcagattagtagtttaaatgaggcataatttttagacaatacattatttatttctgtttttgacaatatgtcctgagtaatttattactcattatttcatcttgaacaatcaagatacgtttttttgatattttatattatattatagatctacttttggctgtgcaagtttgtaaagtaatatatttttcttatactaccaccttcactaaatatatgacgttggtcatcaatatataaaaaacaataaaaaaaatacaaaggaagtacaaagagcgttcttttctttcggtagtttcactaaatatggccgtcataagaaaatacagagaagtgcaaatccacctttaaaaaaagcgatgttttttttaatttccagtagtacgtacgtatacagttttttttttctgtatattatttcttcttttctaggccgtggttgttaatccgtatgtacgtatgccttctcagctttttctagtcaatttttttatggaaagtattgctcggtaaattaggaggggtagattactatttataacagatctaatccaatggtgtaaactaatgggtccaccaacttaaatgaaaatcgagggctagattttttttcttttttattagaatttctaagttttttctattttattattgcgccatgtggcagcttgagagcgtttttagagcaccatgtggcagtatgagagcgtttgtaggaagtttaatggacttttagtatataataatagaagatagatagatagatagatgttttagaacaatctcttgctcaagtcgatcgccgagctccgacagaaggcaaatgctaaaaaccttttgattcttaaacttgtaggtgaaatggttataaatcttcttaatgttagtcttttttgtctctctccaggaaaagttgctgatggagaaaaacactattctggagaaggtattctgttaattttactgatggaatgaaaagcatatcctaattattttcagttaccactgcatgattcatgtagctgtactcagctcaactgaactgaatcactaattttgtgttaatttgtccatgaaaaaaaaaaaagaaaattactgaactggagacactgcatacatgcatcagggcgtcacccactaaagctgctgctcctcctgcctgcaatactgctgatgcatttgttcccaacctcaacatctggtgagccacaccatccaactgccaccatgcaatgcttgccatgttgtttcttcagattcacctcaactgaaactctgatacctggccttcaaatcaaaccgcagctgcggcgattccggcgagccggaaaccgtgacggcgccacttggctggaccagcagcaacaatggcttgccatggtggatgctccagtcatcatcgaacggcaagagctagaagatgttcagatgaaatggtccctgcagccattgcatggttgctgaataatgtcgtcccagatggttaggcaagcaacctagctagaactttcagttagtgagcggtagtagtatctcccccttcttaatccctactatactccgtagattaattctaagcatccttttgtttccattatctacgctgctggtttgatgaaattcctgtgttgtattcagctgcattgggatcattgctcagcctttggtcatgtctctcactggaatcaatgtgtcatgtctgtcttgcaatcacttcgatctggtattctattggtcagtctaatgagtgtaccttctagtactcagttttgtctgaattgtttcacaggcaaacagaaaaggcatacttttctccgttcaaatatagtaatctagtactccctcagttttcgtttcataacgtaagactttctaatattgtccatattcatatgggtgttaataaatctagatacatatgtgtgtctagattcattaatatttatatgaatatgggtaatgctagaaattcttacgttatgaaacggaagaagtactagaaagtcttacgtactctatggtgtgtctaacctagtagtagattgctactccctccgtccctaaatatttgacgccggtgatt

SEQ ID NO: 77966 - DNA, 9471 bp, Oryza sativa
taatgtgtttaattgtaccttcttataatcatcttgcctgatgaattctctcttgttttttatgtcccacagaaatctctagctcaagagtgcttgacttttctcaacagtgctaataagtgagtttggcattatctttacaaccgacttcacaccacttctgcatttctaatgcatgtttgtttgtgtgtccattgcagggagcaattaaaaagcttaaaggtttgctctgaatcatatcgtggcagcccagattgcttctttcttaccattaacccactgatacatgtgtagggaatcggagaaaaaagggcaaactacatacttgagcttcgtgaggagtcaccagagcggcagagctatttaaagaggtgagcactctagatcaacaagggagtagccgttagacccaagcaactagaagttattatatgacaatgcaactcagagctgattcttttgctttcgcagataagtgatctgagagacatcatcggaatgaattcaaaagaggtactggagaatctgattgcaatgtgtacatttatctatgttctttgatcactggaagatggttttagttttcacaaacatttcactggattacactgtcactagagatattcctgaatagtattagactccagctgcttcattttgcaaactccatgggttttgggtgtactaaaattgccactgctttgttatcttcaccagatcaaaaagatgatgtccgggattatcgactcctaggaaagtaagcagcgcgagtgcgatggttctcctgtggagtgtgcatatgcttctttggtcaaaggtgtcatgtgtttgttttgtaatttttttatccagttgcttctctcaagagcgaatgctttggccaggagttggcgttctgtgagagaatcagtgctttgcagtggtttgctgctattatgtgtttcgtgtaatcatcatacagtgtggtaccaatattgataatggtgtggcgttgatgtgatttcctctcttttgatgtttgttgctataaatgccgatttattattttagaaaaaataatgagccgataaatattcctctctgttgatctgagaagctcagttctagttgttttttattccgacaaatatttgttctgatccgtatttgtttcgttttcgtattcgataatatttaactctgtttttgtatttggcgttgactattttgattttgatttaaaaaaaagtgaaaacggaaacggtagaaccggtttttgtcaagaaaacaataaaataaagttaatatgggtgttgggtttggtacggaaatgacatggacaagattagatgtaatataaaacttgctcttaagatactatgtggtgggagaaagtcctattaagcaaggcagatatatgttggatatgtagaacatgaattaatgggagggagaaacatagatgttaagtttaatgtgcttttattcaaaaatatagcaacctatactagaatatcacctattagtatgaatctgatggataggtctatattcacaatatgaaacatctacgttgaaacattttgcctcaaaaaatgaggttttacattccgccttccctaaaacctgagttttttttatttttaaaatactctatttctaaatgttgttatcatgtggttttacattatgcattccctaaaacctgagtttttttttaaaagatactctatttctaaatgttattatcatgtggtagtgtttcaacaggacttcatttaagacaataaagccctctagtctagtcctctctatactagaactctagaagtttacagtgcgtctcgcaccaacaccgaacctgggaagccacattggatgaaactcctacaaagccacccatcccacaatgcaaataactaccttctctcttatagtgggtcccaccatcagatgcttttcatcttccttctatctactctttacttttccccactcatcccctcccaaacgatcccctctctactcaactccggtgaccccgccggtgccacctctcccatcctcaccccaccggcggtgccacctcacctctccctcctcctaccggcggctccctccaccggagaggggcttggcgctccacggcggcagaggacacgacagcgacgagtctgggcgcggcgccacggtggcaagtcggggcgcagcgcagcggcggcgagtcgcgacgacggcgtggccgagctgcccagatccggtggcatcggctcgtcggggtgcggcggcggcggcgctgtggccttccaccgcggcggggcggagaggacgacttggagcggcacctcccccttcctcctccagcctccgtgccgtggcccgagcagctacggcgtcgttcggcggcaggcggctgcgcagcggtggcgacgacggtgtggggcggctgtgcttgtgcttctgtgtgtgcttttcccaatgcgctctctctcctcttcccagctgcgcttgcgcttttcacatgcttttcagcccaaaaacgggtgaccaagtttggctactcggtcttcacttggctacacatgtgaaggacgtggcaccgaatatgccattcctttctctcaggctgagcgtcacgtaggtgcattgtaaatgccctaatgtggccgcctgcatgccaccttttatcacgagagcttttagggatcgaagctttatatatgtccgatatagaactattctagggtcatgaggatatatggtccaaatagctgaaaaggagaaatctccacatcaacgcatggggtatcatccagtaaaatacacatttcccacgaggtaacacccacaaattcagttctcaagaatctcatctcctagccaatacccatggtctgattaggctgcactttcttttgactctctccaatatataataatacagtatattatcagatatatattctgaactgcaaacattatcttataagtgcatgatgcagagattgccgagatgattctccctgatccccaacataacttatgttggcatgtgctatgctgtttgcatctgaaatcatcttgaacgctcaacattataagaacatcctgcacatcgatggcaattaactatcaaatccaatgaatataaacagtacaattcgtacttcgtttcagctttcttttcctacagcataactaaatctaaacaactaactattctatagcatagtatcttaaaagtaaagtcttgaaaaagctagtatcggcttattgtggaattgacagcaagcagaaacagtccgtttaccacagttgatgaaaatacgactaactataatactccctctgtcccagaatttaagaagctgagattttttaccgtccatcatagtttttggtacctcccgatactataatcggagccatccatccagtgagatcaaacggttgacaatcactggtactgcgaggtacgggagtcccgtgtgggatacctcccacttcattcgcatgcgtggaactagaggtggccaaacgggcggcccggcccggcacggcacgggcacgggtccggcacggcccgtttcggcacggcccgttaggcacggctcatgaaacgggccgtgccgtcccgacccacgtgccgagccgccggcccaagcacggcccgtggatggccgggccgtgcccgtgccggcacggcatgcgtgtggcccgccgtgtcagtacgggcccgtgaatgaaaaatgggccgtggacggggcacggttggcccaggaaccgaaatggcgcggagggatgcgatgcggacttgcggaggtggctggcgggctgggccatcagctaggaggggtgctcaacggacttgcggaggcggctagcgggctgggccgtcagttgggagggatgagatacggacttgcggaaggatgagatgcggacttactacagtagccgtgccgtgccgtgccggcccgcgggctcggccggcggcccaagcacggcacggctactcgtgccgtgccggcacggcccgttactgtagtaggccgtgccgggccgtgccggctacaggttccgccgtgcctcgggccgcccgttttggcccggcccgtttggccacctctacgtggaacaagttgaagggcagaattggactttcgcataatagacagttttcgcagagacggtttgaatccccgacaccggcaatctcactcctcccgatccccttccttcctcgacggcggcggcgcagccaagctcgctggcctccgcctccctcgctacaaccagcaatcaccaccctgcccaatcccaacttgcccctcctgctcccggtccaaatccggccgcgccgactgcagggagccgatatagctcagggcgtcgacgacctcaatgcaccaacgaagagatgtccacagcgacgagctcagtgcccgcctgaacacaagcaaagacgagctcggtaccaatctgaagcaacatgaatcgtggactggaggacgaacaggatgctgctgtccatggcatgaccagtacatcatatcgatccttcactagtaggcaagcatcttcatctttccttcaccatcatctctcgcgtcagcctcgcagcttatgcttctccccgctggcgtcgtttgacctcctggccgctcaatccacggagcggtggaacatggaggtgtcaccacgccgatgcaccacgtcgcgaggcaggcgccgaggcgtcgggagcccagacccagctggccctggttgattgccacccgtccccttcgccctgttcgtgtcggtggccagcctatgcgcgtcgctgagtttctcttcgttcactacccatcgtacccctctagagatcaacggttggattgtaatcggtacctcacgttacatgtacctcgaggtacagaacgctggaccggagaagcctctaagaagttttagggttggacacggttattaaaaaagtaggtagaagtaactggtggaggattgtgattggatgagtagtggagataggcggaaaacatgaatggtggaaagttataattggttgggaagagaatgttggtggagaagttgctatattttagcaaatcctgatggctaaaagttgttatattttaggatggagggagtaccaattatgagatttggtcgagtctacaagtactccctccgtttcaaaatgtttgacactgttgactttttaagtacgtgtttgaccattcgtcttattcaaaaaatttaagtaattatttattcttttcatatcatttgattcattgttaaatatactttcatgtacacatatagttttacatattttataaatttttttaataagacaaacagtcaaatatgtgctaaaaagtcaacggcgtcaaatattttgaaacggagggagtacaacacaatttatgataaggaaggagagcacttctagcacggcaatttgctgtgagcttaataataagtcgtacaaaaaaatatcaaaaagttaatgagattactctatgatagatggagataaccagttttaacagaaaaaaaagagctatcaagtgtggttccgtagcacgtaccagtcgtgatatcttttgaaaggctgtattatctccatcagcttggggcaatcatttatataacctgactttatttcagagacagatatagcaccaacaatagagatgaggtctggacagctattaagtcgaaggatgagtcccttgagtgtcatagaactccccagatggctgttgtctatgcactctatgcttggacagtcgactaagcagagcttccgaagagaggatggtaatgtcattctcctctgcatattcaacttgggacagccctcaatacatagctcctccaagtgggaaaagctatggaggtcatcaaccggcagtaatgccatttttttgcaatattttacctaaatggtctttcaccacaggcatataagcgggcataagaaactcatcaagactcaacagtgcatcacatgaagaaatgatgacatttgaaagggatgaaaatactccgacagtgcgcctgctgcttgcctcaggctgtgtttagttggatccaaagtttagattttggttaaaattggagatgatgtgactgaaaaattgtgtgtgtataacaggttgatgtgatggaaaatgactgaagtttgaatccaaactttggatctaaacacagcctcagacacacctatggatgtgagggagctacacccacaaaaacgcaaatcctccaaggatctaaggttacttatccaaacttgcaggggaatagatgttaagaactcgcattgtattgtcagacttgtcaggagggcaaggccatgaaagcaactcacaaagtgatatgttgaatggccaaaatttctaagggtagcttttgtaagagaagagggtaaagctaccaaaccttttcaattgatgttaggacactgtcagatttccagcacctcaaggtgacaaacgttctttgattcttctgaatcaggaaactgtggttcaaagaatgatagactctgaatgttattgcagcaagaaagtataagtgaacttagaattttcagacagtctggccggagccagctggggcaagatttaccctagtagctatctattgccaagttttgaagattccaatgaggtaacaattcaatatgttcctctatcatctataagtcttcataacttgttcctggtagggtccatctcaggcattgtttatcacagttctccttattatacatgaagccttatgattcaattttctttaaggaaatcagatcactgaaaccttgaggatatcttttgaaaacacagcccttggcatttattgtctggaaatgatagaggcagctaacagatgaaggaagggtctcaaaagtagaacttccgaataagccaaggtaacgcaaatgttttgagttgcttatgctctcaggtaactttctcactgttccccgcaaaaaaaaactttctcactgttgaaagattaaaaatcaatacacggatattcaggagttccttgaacaaacagtcaatcacaggagcaaaatgtttaccacttcggtaagattcattgcatactagggaccgcagttttttattgtgtgtgcaaatattcactaattctgcacagctgatattttcagtagtgaatattgacagatggcgaacctttgaagggattttagctaggtcacttacatgttgtatgatgaagcactcatctttagagactagctgtgcagtatcatgcatcaagtcatgaattacatacgtaccatgctcaccagctgctttctgaaagaatgaccgatttaaaaggtcatcaaagcaagagggtgcattttcaagctccacataaccttgtgctaccgaaatatctgctagaaaatccttttcaaatttgtgatcctttggatacatggcacagattgagaagcatctttttatgtcctgtggcaggtaaacgtaacttagtcgaagggctggcaaaatgtcagtctcctcttgttctaatcgccatagctcacttttcaatatgtcctcccagtgctctatgcttaggttgcttttcaataagtgtccaagagttttggcggccaaaggtgaacccttcaacttgggaagtatagcttcaccaatgcgctccagctctggcctgttgcgacaactgttgctccaactctggacggatccgaatgcacatagtttgaagaaattccagaaaacaccatgttgcaatcccttcagttcatagtgattactgttgctgactaggttagcaaccttggaagatctagtggtgaccaaaatcatactgccctcaagaccattgcttaaagttctatgaaatgttctccatcctttctcatcttttaagacatcatcccacatgtcatcaaggacgagtaaaaacttctttgacttgacactatcacgtaaattaaccataagagtatcccttgtatcagaatcttgtaactttactccaagagacttcagaacatctcttgttaacctgtttacctcgaattcatccgagacacatatccaaattatgcagttgttgaagtgattccgcaccactccatccacacagatttgttgggccatggttgtcttcccgacacctcccatgccaactattggcaacacaagcaactctgtcctccttgcttcagctgtagtgttgcatgccacaggcctgcctctcttgtgtccacgtactcttagcttttgtttcaagtcctccagttctttttcacgaccaaaaatctcatctggctcgtcgaggacatgacatgtctctggtctgacaattttgtcaaacttcttgggtgttttgtgcaagcctaaactgttagattggtcaaaaacatgcttcagtctttcttggatttccatcactttcctgaatttgccactgaagttaacattgcccaagaactccaaaaagggttcatgcaagtgatcttgccctaaattcttgctcgccttcaccttcaccttgagagcataataattgtactcatcaaggaggtcctcggcatcgtacactacatcctttatctggcgaaggtgcccagcttctgtttctttgtggctatgccactcaaggcggtcgatgaggtcatgcattgtgggtgcaattaatggttgtttggatcacccaaaggttgtgctcaagcttctgaagatcatcctgaatctgatgcagtgtagctgttcttctttctccagctgatgctgatgctgatcctgtccctgctgaacccacttgctgttgctgctgctgttgagaacatacggcagctaagacgtgtggtgtgacccagttgaagaattcccggaacgcattggcgtcagcagcaagaccagctgctcccctcaatattccaacgaccttgtccatagccaattgagcactgctgtatgatcataaacgcaaacaaaatcaaactaaacgctaagattttggagcaggtggtcagggaatgttttaccagggacatgggtggcggtctagcctgaagattggtgctccctgatttttactgctttccttctcttgttacaaactcttttgtgggtttgtatgttttggctgtgtgcatcctagttatgcagaggccgggaattttcttagtatggttctatcaacttgatgtaatcgtctgagattaataaaagcttcctttataaaataaaaaagagttccatgtcgggagagatgcaccatgccaaagctacatttactgtatctagtggttcaaggcaaatctatcacctatgtatctactattttttttaaataaagtctagaaattagggcgggtctatattatagatccataactaaaaatggacaggaactttgttttgtgagagtatagcctataggaactaaagatatggttttattaaatacaattctatctcaaatagg

SEQ ID NO: 77967 - DNA, 12479 bp, Oryza sativa
  unsure (1)..(12479): unsure at all n locations
tctgcctgtacaactaaaagtattattggattaaatacaattctatctcaaagtaggcacataatttctcagaaagttctattagttgtggtgaaagcaacatgtaagacaacaggcacagtttgaaatttttctaagcttactactacattataaaattgacgaagaacacagaagactgaaatatgcagactttgggtacaattggaaaaacagtttctgttgataattgtagtactattatctgatactcaaaaaatatcaagctggcataaatggggaaaataattggatcacacacctgggtccttaatttgttcacaattctttctacccaatgatcagaccacctagctagctcctcttcttgatcttgctcttcttaatgtctgctacaagcaaagcgaccacctgcttattcaaatgttagaacaatatgactagagattagataggaaaaaagagtacagatacactagtttcagatagagtaccaatttcatctcccaaattcaaacgaagagaactagatgaaatttggaagagtacaacctccaatttcagttagttcttttcataggtagaacaagggactgaactcatttttgggggcataggttgcttccacgtacaattgctcggataaccctctgggaaattattaagaggaccccaggatgttttcagaacatggcagaaaaaaagagcctgccgctgccggcggtggcctccacgactcgaccgcgcacggttgcttggaatggaccctacattttaacaaaaaaattgagagcagaatttaaaatagattgtgttcaatttttatacatttttatctaaaagtattttagggctaggtaaataagattgtgaaatactcattaccacccttaacgtgccaatttgatattttgccatcctccaaacggggtttcgtttttgctgtctaaaagcatctccaatagcctctttaaattggactctccaaacacctgtatagctaactatctatctgatttggctaatcaaactagatggtcactccaacagactctctattaatcctctctaaaataacaacggacccacatgtcagcctctactcctcttcttcctctctttctcccccttcttccttctctttctttcttttcccttttctttccttcccgtcgtcaaccaggcggcgcatgcagcgcggggaggtggcaggtggcggcgcggcgcggggaggcggaaggcggcgcaccgcgggtaggcggcgcggggaggcggcaggtggcggcacggcacggggaggcggcaggcggcgcaccgcgggtaggcggcgcggggaggcggaaggcgacggcgtggcgtggcgcggcgcggcggcgtccttgctccctctccccacaggatctagaggccgccgctggccttgccaacctcggcccgctctgctcgatgaagcgacggcggcggacagcttcggggggcagcggcagagcttcgggcagggatggcgacggcgagcgcagaggctagcgacggtggcggcggctcgcgacgatgacctcgatgacgacccgacgacaacgactgcgcagaggaatagcatgtggggcccaccatttggcgaggagttttggctggccaaatctaaccagctagctagcgagtttggccatctgttggagctcttttttttttgtcttgaatagctaaaatttggcttggagagactaatagagaggctattggagatgctctgaagagccggcctggctcaacacgacattgacccacaaatggtgcagaccattaaagcatcaccggtacgactcatggaacaatccatgctatgctaaggtcgagttgtatgggcccaaatatgacacgtgggtcgacgaatgtgtattaatatgtttggcatatcaaaattaaaatataagggaaaaaaaggaaaaagaaaaagaaataaatgtgaaaaagatgataaaaaacaggtccccgacccagccttctcagtaaagcagcaacaacatcagtacgatacgagaggggaaaacatgagagagcttgttctctaacatgtgtgatctacaaggggcaaaatggacctattgggttggttgtccacgatggcggaataagtccactttgacttcctcaaatataagtccaatctaattcgtatccctcaatcgtaataccagatatcttaaaccctcgactattaaaaccaggttgacatttcgcggcggcaccgatggcagggcggcctcgctgttgtcgccgaagccaatggcgctgcttagggagtgggatggggacggggagagagaaggtgaggaagaagaagggaacaagaaagagaggatgacatgtaggcccacatatgctgacttagtggttggactaggtcagcgagccacgttagcgaaaatcaacctcaaagccaccgagaaagttgttttgcaccagttttagtagttgagggtttaagatatctactgcgattaaggaatacgaattaaattgtacgtatatttaaggaagtcaaagtgaacttactcccatgttggcacactcatctgtcataccacatagaccaaagtagcaacaaaaacgtaatggcaattaatagtagcatatggagaatggttgtttcttatagtggcaaatagttaaaatttttcggaatcacaaattctcatcttgatgcctcatgctcgcatgccacacagcatctaaatgttcttgtcatgtagtccatctattccataaaaaataacttctggagatgaatctggataagtgattgtcagattcatcccattcttcttataacggagggtgtatgtatcgctcgttgttatcatacactccatccgtcccataaaaattgagatgaatctagatatgtttgttagattcatcccattcttttttaacagagggtgtatgtatctgcgagacactatttcaaggatttcatccccaagaacagcagatgacgatcctattgatcgatgtaattgaagatagggtcgaagtgctcgcaccacaaagtttttcacagtatggaggcacacacgtgtacagtgtggcggagggcggaaaaaaatttaggtgtggccaataaactaccacacgcaagagctagcacagaacaagaattaagaaaaaaattcaatacacaatattgtacaacgcaacattatctcaaataagtcatagtaatgagcactaatcacaagttcacaattcattatccatttgcaaacaaatgtaaatataaaagtaggtataaaaaaatacctcaattcctcaagattcactgatacgctttgaaattgcaatgttctgaaattgtaaaaaaaaagtatatttgataaattttggtaaatttgcaaaaaagtactacggccgtgtttagttgttttggtaaatttttttttatgtacatggatatatatttgaactattaaacatagactaataacaaaacaaattaagattctgtctgtaaactacgagacgaatctattaagcctaattaattcgtcattagcaaatgtttactgtagcaccacattgttaaatcatagtgtaattaagcttaaatgattcgtctcgcaatttacatacaaactgtaccattattaatacttcatgcatgtgtctaaacatttgatgtgacagaaaagttaaaagtttgaaggaaactaaacacagcgtacctctctgtgatgccagtgccttcccttttctctttctgtccattttctgatgatgggagattgggagtgatgcctgatggctgctcctgcttatgcttgccttgcttggtgcttggtgctgcggcgccagccgccctgcttggcgcctgcgcggctgcgcccctggccggctggccactaactcgccgcctgccacgccgcgccgccgtccggcgtggatgccgcagctctgtggctgcgcccaggagcccggcagacggcgggacatttaactttatgtcacttttaagatgttgcaattaattatttgtcactcgttgtctatgacatatgggactatgtgtcaagtagcaaataatttaacaccccttataagagtggcaaatagttaattattccgcaaatggcagccatgcctctcctcgccttcgcctgcccttccacgcgcggcgtgtcgcttcaagactctagcagaaagtaccgcagtagctgctgtcggccgaaggggattgaggattggggagggggattgctggattgggtgttgggggaatcgatggaggtggatgagatggggaaattttggtctagggttacacaaaacaagcccaatggcccgcgggcactggagttcgccaacttcgcgaagccaatgggaggcaccgccatcaacacggggagctcgccacggttcgacgtgttcggcaaagacttcgggtgggggaggccggcgaccgtgcggagcggcggcacggacaagttcgacggtaaggtgacggtgtacgaggggccgaccggcgccgggagcatgtcgctggaggtttgcctgactccggtggcgctagcgaagctcgtcgctgatgaggagttcatggacgcggtgaccgcgccgtgaactgcaggggtgtttagattcaggagtgtaaagttttggcgtgtcacatcggatattatataggatgtcgcatggggtgttcggacactaataaaaaactaattatataatctatcagtaaaccgcgagacgaatttattaagcctaattaatccatcattagtaaatatttactgtagtaccacattgtcaaatcatggagcaattaggcttaaaagattcgtctcgtaaattagttgcaatttgtgcaattagttattttttaagtctatatttaatactttatgtaggtgttcaaatgttcgatgtaacatggtgtaaagttttaggatgagatctacttactacccattgatgtcagtatcatgcacttcctatccgtttgtttcaatttgtgagcagaaaaattgagaaatttcatcatcatgggtggcagagaaaatggtataacctaccatgtgaggtggtaggtggccagactctgacaatggaggatcagatcaggagatcatgggaaatgatttcttttaaactattgttgcttaaactatcacaaatttcatcaccatgcttcgctattgtttgtttgcacagtcgaaccaattagtatcgctgcttgcgtgtcttttaaatagttatgaacatatttaaaaaaattaacagatatgatactcgctatgttctataatattagaatttagtactggatgagacatattctagtaccacgaatttggataatggacttgtccagattcgtagtactagggtatttctcattattactaggtccttatattttacgatggcgtgagtatatcacttcataaatatacgacttggaatttaaattctataagatgcaacaaaattcaagtgtgaatatatatagcactgcacaatgccacggataagctacatcgcacatattctactagtctagcactgtacggtctcgcgcactcaccgcgtgaccctaagtagtctcgcatcctcatcacgcaaagtcgtacggtaacacgtgattttgcactttcattctacgacaacaacatagttttacaaatccctttttaaatgtgtatatttatgtaaaaccaagaaaaaaaaaagagaaggtttgcagccggtctccaccaattttttttgagagaatctattctgtgtaccactgagttcgttcgagttctcaatgatttgccatcaacattgcctctttgtttaatatactggcgactttataaattgttctacaatataccattaggttgagtcatcttttcaaaaatatccttatgaacatataaggttaataattgatttatctcattaggagtgtaaaaaaacttttatggggcctccttatgcacacaacatggaaatttaaatttgtataggagtttcaacttttttacaattctattttttctaaaaaagatactttataacttatctgttatacagtatataaaaatactttattattattatttttaatataaatcatctttcatacactacagaagatatttttatgctatcatctcatgtataagcaaattctctctcatataccacataataatatttgtttagaaaaaactaaatataccagaaaaaaatttaaaacctatgtacaaacttccatgttgtgtaaggaggccacataaaaattttcatattttttgaaacttataacgagataaatcaattgtttatcttgtatatctctaagggtattttgagtatttttaaaaggaggtccagtctaatgacatatcgtagaacaattgctaaagtcgccagtacatcatagaaagagacaatatcgatggcaaatagttgaactcgaacaaactcggtggtatataatagattctctcaattttttttcccacgcgagggcattcccgttagttattaagcaaatattaaaggtctatcacatctctcatccgcaaattctaaaaacatctttagaatgcatgattcaacactggaacataatcgaaatgtaccaataaaatgttatgcgtgttgaattacggagtgttacagaaaccaaaccatagaaaagtttccaaactaatgtttgaatgatacattagaaaaaacaggcaggaactaaggcataacctcattctttttaataaaactttttatggattggcttattataaactaccagtaacatgccatgtacggattagacaaatataaatatagatacctttttataataagtgtaatagggacaaaacattggatctgatgcatatgcatacttacgcttgtgagcgtgttgcacgcggtgggaggaagagaaacggaagatttccatccaaattaattaatccctatagtggaaatggaaggatttaatttatccctatacaggaggggacacggaaggcagtagagaaattgcgaaataatatatagggatcaatcctttatgccaaaggatttcataggattttttttcttactttacaaatcccaccagatattcttcccttttttctttgtttcaaaggagacctgggattataaatttaatttgttgttttgcacgatgtatgttttacaagcaaaaaggtagatttaatattcaacttttagttttggggcatctacaaatttgctactgacactggtggagaaaccctttgtagtcccggttcgtaacccccctttagtcccggtttccaaaccgggagtaccaatccggcactaaagatcgctatctttagtcccgggtgaaataaccgggagtaaagatcgatctttagtcccggttggtgttaccaaccgggactaaagatatagctgacctttttttttttgcatgcccctgttgctgcatggtttatatatatatatatatatatatatatatatatatatatatatatatatataaaccatgcatatatatgtttcaatacatatatatgcatacatatatatatatgtatttatacatatatatgttatgcaaatgcatatgtatatagatatatatatgaacaaaatatatttacattatagaaaatgtgtgcacatgcatatagaaacatatgtagtcatatattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaaaaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagtaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggtgtcaactttcgccttctttgttgcccttatgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagtttttcaaaggaatatgcagctcacatggtgtccgctgagtgatgtcatcaatgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgtgttcatcaaccttccttgccacctcctcttgcatgttgagttcgtagctcgatacccggaactctaggtctgcaatcttcgcctcgttatctctcttgctcctcatccgactcctgtacgtgtggatgtcctccttgaaaccaatcttccaaggaatcacccctttccctcgagttcgtcctggatgctctggagtctgtagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttatttctttccatcatcgccttcccttgttcacctgtcttatatgcaacgaactcgtcccagtgatcccttagctttgggaatgtgtcgaagttcagtgtctgcccctttagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccatgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacatgtcttttctgcaagataaaaaaaatgtattaggataaatgcgaagtaacatatatatatatatatatatatatatatatatatatatatatatatatatatacatgtatatatatatatatatacatgtatatatatatatatatacatgtatatatatatatatatacatgtatatatatatacatgtatatatatatatatacatgtatatatatatannnnnnnnnnnnnnnnnnnnnnnnnnnnnnnnnnnnnnnnngctacgtcatccaggcccct

SEQ ID NO: 77968 - DNA, 15299 bp, Oryza sativa
agggtacttgttacagttacacagaggccccatgtgtcgttggtttttcatggagtgttttcatgcttccccttctttgtatcaattactggtatttttcttctcgtagggctacgatgcacatggcaggaggatctggatctgatcttagaccaatcttcgatgaataccttgctaaatggagatatactgatgatcaagtttatgttttagatgaaggaaagaacagctcctcaaatgggttggttgttacatcggttatgtcacctgaacaatattttgaggtggcagagttgtacacggtaacattccttagtgttgtctcccatgagactgcaactgctatctcatggactgaaaaggctgagttgactgaacaagatcggcaggtaagtttttgttggcgccttgtagtaatagatacaacttaggagtttcagatttctatattgttttttttctgaacttctattgctgctctgccccttaagttttgctcctgaggtagagatgcactgtcaattcttttgcattattaagttgtttattatattttcctctacaggacctattgagaaaacttcatgcgttacaatctgcagctaataagaagtccaccaatcagggtgcaaaactatcagaatcagcagaaagaaacctttccacttctcagaatggctcaatatcaccagcacatgaggatgctactaaaagctcagcacctacgcacaatgggaatatacagggacttagaaaggctttgccgaaatccattcaaccttcttttcaacgcgtcacaaatcaatttgatccattgttctggtggtttcattcatttcgcataaaatttggaaaggtgcatgtggttctaccaagtggtaaagtgatgtttctattttcactgctgttctcgacattatacatccttaggaggaaaggtgctgcgttgaagaggtatggatgtctcacacttgcaatcgacattttcaatcgtaatgtttttgtgcctctatgacccaaaagactcattgggagtgaatgtgctttgagcaggactgcattccaacaaatttcatctctgcgacggggcttccttgatgccctgcaactcgccttctccacccagataaatccactcgcagctgttcaacaggtgccacaagccccgcgtgctagctggtgatgtagtgtaattattttacatatttatgccgacatcagacttgagatatgagtgtatgacaaatgtgatacctgattttgtgccattgaaaatgtaaggcaatggtaagagagctgcttaatacttccttgtaaggatccagattgagactaatatatatgtttttttatgacttctggtacctcctcttggcctcttctatgttgtcctagatgttaggctgacgggctcaatttggactaaaaaaccaagcaaaaacagttcaaacttgttgttcagtgattctgtttgcatttatagagtgagaagcggtttgcaataagtgacatattcatggctgcaagcgatatgtttatgtgtaagcctggagcatatggtggatgatttgccatggtaataatatgaagtgtgtcaagccacaaactatactgccttcctaacataggtgtagtaaaccaacagatatattttaaatattatactattttgtaacacattttgtaacacgaagtggctgtagtttagtggtgagaattccacgttgtggccgtggagacctgggctcgaatcccagcagccacactatttttttaattttttcttaacactttttattttttatttttacctttcagtcattaacactttttaatttttttcttcagtcattagccaactaataaagccttgatttgattcattagccaccctttgattcataaactttttgaaaaatatattttgccttgattggattcaatcattaacactttttaattttttttcagtcgttagccaactaataaagccttgatttgattcattagccaccctttgattcataaactttttgaaaaatatattttgccttgattggattcataaactatttgtcattaaccacgctaataaatccttgatttattttcagtcattagcattctttcttgatctttttcttcaggcatcagccacactaataagttttcagtcattagtcatgattatggtaaatatcgatcgaatgatttttacgtgttcgcttgacagatctagctttgtatgctatcgcctcctggttgagctgccccgtgacagtttacttgagcatcttcgtgctggcttctattgaaagaatggctgaaagaatgctaatgaaagaaggtggccatcttctagggcttgcttacctgagcatcttcatgccggcttcgactcacttgtcctttggtctcttggcaactgtggaagaaacgcaactgtaggggcttcgactcacttgtcctttggtctcttggcaactgtggaagaaacgcaactgcagggtttacgactccgcgctctcttcggtcttagtggttctaaagtccatcatcttagagagtcatatgtgatcgttagctggcattgctacttttggggattcctcgggagtgtagtgtggctttgctctctcccgccgatcggatttgtgtttagccatcctagtagtttctttcttcttccttggtttttgtctttttttctctcttcgcctggcataagccggtctgactgattgcgttgtgtaacaaaaactcttttcttttaggtaatatattgacgtgcaatttttttcgcgtttgtgactcttttcttctaatatattaacgtgcaattttttttgcgtgtttggaaaaaaagttcgaatgattttgttgacgcagtggcctcattaaaattcgttctttgctatgcctaaaccgtgcgtcatgcatagatagatcatatataaagaccctataataatattacgtaatcaatgatgaaattaattaattcccaaacatgtacatctatacatataaccggccggcggtggcggtggcggcggcggcggcggctgccggccgtgcagcggcggcagcagcaccggcgtggtggtggtggtcggcgaggacggcctcgaggacgtgcacgaccctgcccatggtgggcctgaccttggggttctggctgaggcagtcgtaggcgaggcgcgccacccgctcgacggcggcgtcgacgccgccgccgtagtccgccgccggcgccggcagcgccatccggcggtcgacgatcctctccagcttcttgggccggatgaggatggggcgggcccagtcgacgaggttgcacttgctgcagccggcggccggcggctcgagcgcgcggcggccgacgagcatctcgagcaggacgacgccgaagccgtagacgtcgctcatcgcggtgaggtggcccgtggcgacgtactccggcgccgcgtagccgtacgtccccatcaccctcgtcgacacgtgcgtcttccctccccgcggcccctccttcgccagcccgaaatccgacagcttcgccttcatatcctattacacccccaaattattaagctaaattaacatttgaaaattcagattgttctctcaatttatagaaatactaaaaaaaggtattaccgttttaacggaatagttgacatcaacctagtaactatatctataaggtattcatatacggtaccgatatcaaatctggtacttacgaagatacctatacctacaaactacaataccctactgatgtcagcatgcataaaactattccatccatttcagattatacatcattttgacttttcaaactattttaaattgatcaagtttgtagaaaaaaaatattttcaacccaaaataaatatattatgaaaatatatttaattatagatttaatgaaactaatttggtgttataaatattattaaatttgtctataaatttagccaaacttaaagtactttgactttaactaaaatcaaaataacttataatttcaaacggatgaaatattttgttgcaatggtatagcgttatgtagtaaccctcatgaatttgtatttgagtaagataactactaactgtgtcaagcaaaatgttggaggtcttgaagtcgcggtagatgatcggccggtcgccgccgtggaggaaggcgaggcccctcgccacgtccaaggcgatcttcatccgggtcgtccatgagaggttgcatgaacctggccgggatcgttaaccagtttcaacctttgcattgcatgcatatgctcttgatcatagtgatcattagcaacatccttagcaaaataaattaatggcgagaaattaatttaagctcacgtcggaagaggtggttctcgaggctgccattggccatgtactcgtagaccagcagccggtgatcgtcctcgcagcagtagccgatgagctccaccagattcggatggttgtactgccccaggtagctcacttccgtcttcatttgattaatttcaattttatttgattaaattagtgcaacattatagcaagtacaataaacacatatcaagaaaaaaaggaagaaaacgggctacagattgtagccagttccaacacagactccattatattttatgtgtatgagagatatgaccgattaataatggtgtagtatatttataattattgcatgaatggactattaaaatagctataaatgattagcagcttgcatgagcacaagaatggcgagatgatgatgtgtgcacactgaccagccattccctgtcgccctggtggcctaaggggttgagctgcttgacggcgacgacggcgccatggatgaggcccttgtagacgacgccgaagccgccctcgccgacgatctgttcggggctgaagtcggcggtggcggccctgagctggtcgtaggtgaacagctcgaggttggtcccgtacgccggcatggtccggaactcctccacgtccttgggcacggccagcatcaccgccgccgtctccgacaccgtcttcctcagcctcggcggcggcgacggcgacggcggcgccgacttgggcgcaatcgcatcgcctgcattcacatacacacatggcaataatcaaacaaacgacccgaggcacctataaatcgggcgctcgatctttttttaaaaaaacggacggtgtttcactaagcggatcgaaattgtttcattaagtagatcggaaatgtttcgatcgtttaaaatgctgaaacataaccaaatcatctcatgagacattttgctacaacgtatgaaacagcggtttttaaagctgtttcactatatataaaaacaatgtttcagcaaatagtgaaatgatgtttcaattcactgcaacatttgatctatacatagtgaaacaacatgagtatacttgctgaaacattgttggtagaaaaaaaaatgaaacagatccccttaataaaccgtttctgtaatatatgggtgatttgttgcaacggcacgtgtgatggggacggcgcggaagcgcgggcatccgatgcatgcggtccgatttgaagaattttcgcaaaccaccgattcagatcatcggaatgcatgcgtggcgtacctcctcggcggcgggatgagcgcgccgccgccgcacgtatgtctccgcagctggcaatgaaccaccggtgcatcttgaagatgaggaaagccagcacgccggccggttgattagtttctcacacgcacgtagttaatcaatggaggtcgttggatatagcaagaatgtgatggcggtgtccctcctcaccggcgggtgcggtggtgggggcggccaatgaatggcaacctccgaccaccacacgccgggagggaaagggaaggggggagaggaggaggagagaagcggtgggcaaaagcgcgcgatggcaaaacacaagtcatggaggggatggaggttgagatggtgtcaagagagggaggcgacgggaggaatggtcggagttggcgtggttggctcacctcgccccgcgttgctagccgcgcgcgcgcatgcatgcagccacccacacttgccatcgtcagttttttcaggccgttcgatcgcaagcagagacagacagctaggcagaaaatgcttcaatccagtcgtccgatctcttgaaaaaaaatcgaacctcttgctatgactttgctgcatgcagcctttttgtcagatcctctctttatatacatgttatatatgcttccttactgagcagtatgcatgaaggagagatgacacgagatatttgcatgtacataatacccttttagcaaacttgaaaatgatttttcttttagattactgtcttcaacgcaatcattgccgccatgtcatcgtcgtaggataccacctccgttgagctgtcgtagcttatctcgccaaaagtctacaacgctacgccgtcatcacattgcacacaaaccatcatgctgccccaccatcattgctgcagaatctcaactccaccgagccaccgaagcatatatcaccagaaaatcgccgctgacatgtccgggcagcgaaggcagttggacgtactagttccgtaccttgtttttgctcatggcggactgaggagctcgcattggtagcgagagggcgtggaggaggaagggcgaattagttccgcatctccaaaatttgcaacaactaggaaaaacttgaagctagtcatatagtctttttcatttcggttatttgtttttctttgcatcttagttttgagatgttgagtgtatgcactcgtataattttgattgtgtatatccaattatggatatagatgccggatttctatccattgtctaaaaaaaatgtcaagttctgatacaatggcaagttctgaatggtaagacagccagggaaatttatttttcaggttattctcgagtctttgacttcaccacatgttatttttcaggtttacgatggtgcagggttgaccccatcggtttatagttgcagcctcgcagtgaaactcaattacgacactatctacagtccagggggccatttacggcctcaggggattgcaattgtaaacaagattccagagaagtttcagggaggtatttccagttgtggggatcatttacaatcccaagctcatcgctatatatccaaaatagtttgtgaacgttgagttgtggggagtaactaacaagcatcattctgaaaaaccatatatatcaaccaggatttaaacttgaatataaaacttggggcaaccgtagtagattaccaattggtcaccattgccaatttttttttaagaaaaaacactcaccattaacaccatgtttgtgaaaacatacagccttattgaaacagcagtaaacgagggcgggcagggatctcaccatatatggacgtagttcactgatgactaaatttattttgaaagtagttcactcaactctgatttatgaaacggtaaatattcagaacttgcacagcaaatatatctgacggccacaccgaactgatgaagctgtgactagaagctggccggaaattacagcactgaaacagaagcctggtatggcgtacacacaagaagtaaaaaagtttggttagtgacgctgagggtgatgatgaatacttgaaacattttgcaatggaggatagaggtggcacctgcctgtggtgagtgaagcgaacggatcggcgattatggcttagcttcccccttgcacgacagctctggttgacgagtggaagtggtgctggaactctggaaaatgcacgagcttcttggttgctggcttcatgccgtcatagaatccttgaggcatttgagccaaatgcacctcccggaggaagtttagttcatcaagcttcggcggcgggctgctgagtcttgcacatttagcaaaaacaagcacctcgaggtttgccatgttcttggtgccaaacgtgcactcattgagctttcccatcgcgatgatggacagcttcttcagtttgtggtagccattggtacaagtcaacttctccccttcgtagacgttgtataacgagaggaggagaagctgctgaaggccttgcagaagctgtagtggatctttaccttctactggcagtttgctgtcccagaggtagaggtatgttatggattgaagctttggttgtagacggtcaaatttctgcatacgacccccaagcttcagcttacggagattcttgttgacatttagataactcaaattgaaccccctcttctcaccagcagcacatgttatagtgagcgattgtaggaggtccatcttgttgattgcatcagagatgcctttgctgcatgagattgatgccttcttaactgatagcttcctaaggagcttgaggtatagcagttcttgctcgaaaggtaccatgcctgccttttttcgttcagaaggcacctcgtgtgttgcacctgacagcgtctgcagatgaagcagcgacagcaggccttccttgatgagcacggactggtcgcggaaggagtttgcaagatagagatgcctcatctctttaaattcagacacatcgttcacctctgtgatgccagtgtccctgatatcgaggcacatcaagcggcggaggctctgcagagtttcagggagatattccagctgtgttcctcgcaggcctaggtagcgcaggcaaacgaggcaggtgatactggagtgcaagcgggtgagccgagttccctgaagatccaacgtgcgtagaagcttgtacgtccgaccaaatgacagctcaagcttgggaggctccttcctctcggttctgaaatacagcagggagcgcagccgaatgtctttactcatcgcactagacatttcttggacagcttcattgccgtctccatctccatgcacagcgagtacacggtagcggtgcaacagtgctgtctttctgctgaacaagctcgagctgggtctggttcggggtgccgggtgagcggggtcccgtgcaaatctgcagattttctgtgcctcacacatttccagagccagggatcgcatgtgctcgttgaccttgcatttcagcacctcgccatccaagcctgttttcttcaccacgagcagtttgtagtcaatgagtctttgtagcaggttctctgcctcttgctcttggctctgaagtgggctgtcgttcggtgggaagccttctgccgtccagaggcgcacaagcttccgtgcagggatcaatgaattctcagggatttctgatctctctggaaaagccaggcagtacaagaagccgagccggatgtcagcgggcagttgggcatactctgctggtatgagtggatcacgcttcttatctcctattaccaaatcatcaacttggttttcctcgatttccttccatttatcgacgcgattagcaccaagcaacgctcccacggcccgtatgttccacgggttgcctctgcatttcctcaagatgcctttcagagtctccaccattggcgtcaagtcatctccatcgatgttatctgtctctgtcttccccttgagagccttttccagttgatcgtattctcctcctccttgctgcccatcattgtttctatcgacggccacaggagcaggggtgtcatcagcattgcgaaaagctacatgcaccagtagctgctgttggtaagccagttcaagagggcgaatctcaaccttggcatgcaactcttcgtactgtatacgtgtgttcctggtcaggcacacaatcttcccctcccatcctcctaggacatgtcgtaaaacatgcagcgaagatgtatcgtcgacatcatccatcaccatcaagtagcgattgcccacagtccgaaaggtacgctggatctcttcaattatcttcaattcatcaatggcatcgggatacatggagtttgtctcacgctcttcgtgtttcagcacagcccgcagcaagtcactcaaacatctagtttttgacatgtcgaccttggaacgtattttgaaatgattcctgacatcgatgtctttatacacctggttcatgagagtagtcttccctgagagctgctctccactgacaaagatcactggagcagcatctcgcaacaatatattcttcaattcttcaattttttccataaatccaattggtactgtatcttgttcttcacaatgagaatgtggggtgaaaggaaggattgcaggaagccgctccatcacttcttgatgataattttgcacctcagtcggcatctcgttttttcggtctctgatgattttcacaagtttgtcagttgacaacatcccaatagccgacttcatcgcatataaatgtcccacataaacaccacgcattgcgtacatggcgatctgatcttccaagcaagaggcggccttcagggcatcactgatccaggtgtgcaagcgcgacgtttgccaactctgggcattgatccttccagttccagccaagaaaaatgaagccttgttgatgcaattctgtagttcctgtagatcttgtttagccaaggtaatcttgtgtcctcctcctgatctgatgaccctaatatcttcctttagcaaaaggtaccaggacagttctacgagtttgggtaataaggtagaagacggcagcaatgcggcctccatggagcccaaacgaatgtatgccactccctggactattgaaaaaaaaaagagaggcaaagttaaattcccagcatgaaatataattcattttcttttgttgctcctaaatatttcacgtttttgttgtcaccacacatgtaatgaaacaattatcttgaaggggaaaaaatgactataagcaaatctggaaatacagaaaataagtcctgaaaagcaccctagacacatagtttcatatgtgtgtgctgtaattttattagtgacattactatgaaatgatcataattctgttaaacagattttcttatatgcataaaacctgtcaagtatcgctacagctcacctacattgtttacacagacaaagtaagggacacaaagtaggcatatatgttcaacatggaaaagtagttttgtttttctaagcacctgaatttatgtccacaggttagggatgcatttgtgcagagctagtgtaattccctttattgattgtttaattatataaatgcatatagaggaatttcctattaagccattggaagttgaattcttgtatgccactgatgatcatgtgtcatgtgaacttggacccaccatgcatagagactaaaatttggtggcatatatcctttataaattactagctgaatgcccttgcattgcaacaggacattgaaagtaactatcatatattataaatcccaaaaagcgaaaagtcaatccaacggaaagctccaataactccttttctttttttttaaagatcaataccaagttagctacggtttaatttactaatttcagacattggcgagattggttagctgatatcaacactaacaagtgtgattagtaaagtgtgactcaatcattttctttgaaaggaaaacagtagctcttctatgcattaaggatagaaaaaaagtttgcaatattctccaaattaagtttcgctggttctttgaagtgtgattcaatcattcaatggggataccgattggagaaaattgaaggcaattgttttttttttggggggaattgaaggcaattgttgatggtctacgacagtgtgaagcctcttgaaatcatgattggaaggccacacaaatagccgaaaccttaggcacaaaatactgatcttacagtgagagaagaaaagaatgagttcaccatcattttctgaaacaaagatcatagcaattcaaataagacagttttaatcttatctactgccacaaaaccatgctataagtcaagtagccaactaaagttagaaaaaatgttcgtctcaaagctggtagccaataaaagcaggacaccacagtggaagttcatttcaacgcatgtaacagaattaggtccacgaaataaaaaataaacacaccatatatcttctacagaaggtatataccgcaaaagaaataagaataaaaaccacacataggctagcgctaaagcacggccatacaaagagagtgaataaagaactacctgaaatcccccgttctacagttgagaaaatatacagggggaaaagcatagcaagcaacccattccagagaaggaattcatgacactaatctagtaatttactcaggatgacaggccacacgcatatttcgtctacctgactgatttgcatactgtgtaaatggcaaatatagtcgaaacaggaacacagctacccttctatgcgagctaagaaaattagttaaatggggggcataacataaagcagcttgccgtatgcactgaattagtcacactgagcgtatttgatcgattcacattctcattagtcactatccgtaaatccctgcattcctctgaagcggacaaactctctcaagcagaaaaacttggcataaacgagttatgagtgaactagtgttgcctatgaggactcctggatggcgtcaaaatccaacaggctctgacgagcacccatgaaaccctctgattgaacccccccccccccaacccctaaaatcctcacatagatcctacttgccgccacgaaatgcttaatccgtcgcaggtcggcgccgagcttgatggtcgggttggtcatctggggaactcggagtcaatggtgatgcaagtgaaaaatcgaaatccacagggggatagaaagttggaaggtcggggtaaggtagaagctggggggcgcgtaccatgtggttgtcgacgaaggcggacggcggcggtttacttgactccattgctcgccggcggcggcgggcatgccggcgtgatggaggctacttcagcgaatgacagttttgcccctgtctggggaacggggagtgtacagtggcaattccaattataccttttttaaaaaaatcaaaaaaaatatcttcttttttcccctccttcctctctccctcttctcttcctccttcctcatcgccacccttagggcgcttcatcattatcgtcaatatggcggggcggagttcgacggacaaccgacgactctagatctagagggcggccgacgagtgcacactcaagccggcagccatcgcttgcaagctaaggtgatcattgtgcagtgcagtgcacgccccattacagttcaatctcactacctcactggcgtccaggggcgtcaacgtgcatggagacgaccaacaagaagaagatcgatgtcgtcttcaattgccttaaatcgagtaggcaccaagcacactgggcggcatgatcgtgtcggaggataagaagctggagaggatgtgctcgtggccgtggaggtaagctactcggcaactgcttaaccatcgatgccaccatctcctccatcttcgatggttttgcgtgcggtggtggcaaggaggagcttgagctccacagtgattggaggagtacatcctgacaaagcaatgaatcgcaagatcgatctaggatcactacgacgctgtggtgcatgggatacggtatagcgattgaagtgtggaattaatctcgtcaatccctttttcttgtggattggattaattgaacaagctactccatataacggaacgtgatcctcgtgaattcttctatgaggggatgagaaaaacgttaaccctgttagcttaaatggcatgggaacagaaaggcatttccatggaggataatcccatatttccgttaattgcagtctacttcatcccatgatcccatctcaaactaaacgcatggatgagatctaatcctaaaacgtttcagttccatcctacttgttgcagcaactaaaactaccttactactacttccgcttcaccgaggtattgacttttctttctttcttttttttcaaaatcaaattatttaagtttgtgtaactttataggtaaacatagtattattttcaaaagaacaaatgttggattcaatcatactaattttatattagaaatattactactatttttataaatttgattatacttaaataagtttaactttaaaaaaaaagttatgtgaaaacgagaaaatagtacttacaaactatttgctataatatttactttgaggatggagcgactctcgtagcgtaattttaaggagcggagcgatagctccactaaggatattgaaattgtttaattcacgagtcacaacacactatagtaggcctcttcttgtcaaagctgcttgcctttggtgagctcggcaacgatgacttttgtgaggtctcaatagttgctttcttttccttttctatataggtttttgccggtttcccgtttaattaaccgtgcttgttcggtttttgggcccgatttcccttattaactgggccaattcttttcttctataaatttcggcatgagaaactcctactatctgttccttaaagaaaacaagagtgaataagttgtcctagtataaaacaatttctgtgcagagaacaagaaacattgaatgttgctgcctctctctgctcccgttcacacgagaaatgcttaatctctctcctctttcaactagtaaaccttattaagggatgtacttgatgagggtatttctgacttttattactaattttgaattgggaatctagggatcgtgttttataggggcagagggagtatggcattgagggcttgtttagatgccggttaaaattttcgccctattacatcgaatgtttggacacatgtatggattattaaatataaataaaaaaatacctaattacacagattgcgtgtaaattgcaagacaaatcttaagcctaattgctccatgatttgacaatgtggtgttacagtaaatatttgctaatgacggatcaataaggcttaataaattcgtctcgcagtttacagacgaattctataatttgttttgttattagtttacgtttaatactttaaatatgtgtatgtatacataaaaaaaaattagccaaacaactaaacatggcctatattaagtagtgtttggatccagagacttaactttagtctctttatttagacactaattatttagacactaatttagagtattaaatatagactacttacaaaactaattatataaatgaaagctatttcacgagacaaatttgttaagcctaattagtctataattagataatgtttactgtagcatcacataggctaaggggtgcagg

SEQ ID NO: 77969 - DNA, 18822 bp, Oryza sativa
gaccaaacacgacctgtttaatgctgcagacccccatccaaagaattttataacggcattgtggatgcccttaatctataaaggaggctccagtccaacagatagagggttctaactcttagcagctagcactcttgcaagattctcatctcattgtaactcattctcaatcgctcatagtccatatacagaagtaggtagtattacatatctatgtagcatgaacatgtataattcctcgtgttcattactctgggattgggacctggactcaaattgccaaatctccaagggagagtatatacacttccccgctagagaagtttcacactatgataaatgtaattgcattctctatttggttagcaaataataatagggagtagtctagaaccaactaatatacatcttcacatgtcccagtcgtgacaaactttggaggcatctatctagacgggtatatgagccttttccctcttttataaaagtgaaaaagtttgtttgcaaatgcactaataaccatctactagctagcactagtcgggacgggttgatatacagagaaggcatatagtagcttggtagccgacatgatcatccaggtccgagaaaatgataaaaaggataagctgctttagtttgctgcacgagctaaggagagctagctagcactcggcggccacacaagccacatctatccatgaaatgacagcaccaagctagccatgtgtgatatgtgcgcatcttactaatttggtaaggtgtgattgactgagattgccgtatactccctccgtcacattttttaattgaagttgtgggtttatatatctaatgtttgaccattcaatttatttaaaaattttataaaaaattataaaaataagtcacacataaactactattcatgttttcttatctaataatgataaatataataattataaatttttttaaataagacgaacggttaaatgttagacatggaaactcccaattgcacttaaaatgggatgaagggagtagatatgtgtgctaatttccataattaagacaagtgatgattaaattaactttgttttgactctggatgcatactatatatgctacaacagatttttttaattagaaaatgataaacataattgggagttactttgtgcactactctggtccaaaacaaaaatctgtctttaggttttctagcagaaattaatgttaagagaaaagtattggcaatctatattctatgatgctgtgtttgggagaaggagaaaggaggagaatgggaagatacgcaaaacgaggtgagctattagggtatgattaattgagtattaactatttaaaacttcaaaaattaatggattaatatgattttttaaagaaactttccatagaaaatttttgcaaaaaacacatcgttttagcagttcgggaagcgtgcgcgtggataacgagggcaatgtcctctttctcacaatccctcaaacgcataagtttgttctaattcaacgatttctattgacactgttcacttctataatatatataccggagactatcaattgtcctataatatgtcatccgactagtatttttttttaatttttttatccaaaataccttaaagaaatacaagattaacaatcgattgatttatacccttagaagtttcaatttttttatgtaacatccttacataacatagatatttgtatataagttttaagtttttttggggagtttttatccttttaaaagtttttggggtatatgagagcgaaattgctcacacaaaatataatagcacaaaaatattatgtgcagcatatgaaagattatttgcattagaaagagcacggcaaaaaaaaattctatatagcatataacagataaattatattaaaaaaataaaatgcataaatcttcaaatttatacataaactttcgtatatattgtgtaatataaaaaaagactaaaaaatcataactttttctaatctttggataggataaatcaattatgaaacttgtatgcctatataagagtattttagagcaaatgtaaatgctggaattgtttatattttaggactgataaatggagtaattaacaaaaattaactgacccagaggcacaagacaagtgcttaacatttttctcatttgtgaaaaacatacatgctatttgttaattccacaccggcctaactatttcttttccagtatgcaacccttggtagttgcatgcatatacagcagcttcgatatgatcagctgcttgcatgattatatgcatacgcgcatgcacgcttgcattgtgcaatatcattacatccgtacgtagatgaagcacgtcatggagaaaaatatataagcttatttatacagtcaaactaatcatgctctacctctagatcattattagctaggtcaagtccatcactaaatagtaattaattattaataaaagctaagctaaattacatatactagctgcttgcatgttgtatatgtgttttgcacgcatcaaattgttaatggttatactgatcattagctagctttaggacgcaaattaaactaagatagttaggatacttagctacgtagctggtggacacaactaccgtacagagtggcccttgcaactgcaaatgcaatcactgtcctggctagctaagcaaatcagaagggttgttcactaagctaatcccctacgtgctgcttttcaatctttcatacagggaaaaaagacagctagcatatatgtacagaaaaggacagaatttttaatatagtggcatgtgtatgattaattttacttaattacagtagtactgtgtgtccttcccttagtaccactactccattcgttacaaaatataaggatttctatgtgttttcaaaacatatctagacaaaaagatatacatatacatttttaaaagatgtgcagaaattattttgtagtagatgtagtaatatctctactattataaaaattgaatatgttttttcggtattttggtacattattcgtgtatgagtcggttatttaagttcgtttgcttttgaaaatactatccgtatttgatctgtttaaaaaaactcgcatgctaacttgagacgatcggacttctaactacagctcatgattttctaaaaatatatatatccaagcgaactctcacagtaaattttatcgtaactaaaccatataacaataataagattaaaatagagttcacccgttgcaacgcacgggtatttttttctagtttagaataaaatttagaaaactgtaattacttggataaaacttcactttactataattttaactttgtagtacaccacaagattataacaataacaaacgattttgtcagaaattaaactgtaactttatctcatatgtgtgtatgatatgtgaatctaatataaaacggtatgagcattgcaaatatatatatgacaggtggacccaacatcgtaagacactctctgttaatattttagtacacggttgttgcatcagcaagggccaaagggcacctcctgaaccacacaaatgctagagtttttttacccacgccatccatacatgagcacacgtgaaatatatgcacggtaggaatttctctaatgtatgtttgtaacaattttagagataaatttaagttcaataaattttacaaagaaatacgtgaaccgtaggcataaatgaataaccatgtctctatcctttggagcgactaaaattgcaccgaaattcttcggcgaagaaagtgaaactaaaggcatatatttcctcctctgttactttatttttttaaagtccctttcatttataaaaaataagtttatttttaaagtaatcattgcattataggttgtgaaagtagtgaataattatattggaaatagataaaagcgaggaatagttacatacttaatttaataaagtaggaatattttattttttttaattttgtattggaatacgtgatatatgcgaaaaataagatttattttgagacggatgaagagtgataaaggtgaggacacccagaatgcaaaagcaaacattgcatttttccatcaacagcgacgcaaaacggcacgagggcaaacgaaagcattggaaattggaaaggatcggatcggatcggatcagccgctgggattgcgagacttgtgtcctcctgtccactgggtgatattgattcaagtgacacctgcgtcttgttctgccgctgtcatcctctcgtctgcttttgccgacacacatgcttaattgggctgattaattaacccctctcgtctcttttgccgacaccatattaacctcacggctagcttgtcatccaacaaagaacaacctgtcaagattttaaatctcgactatagcagtaactattttcgaagatatctaattgagtagtgtctagctatttgttcttataaaagcaagtttaataggagagcttactaccagctactctctccgtcctaaaataagtgcagttttatactgttcatgttcaacgtttaaccgtttatcttatttgaaaatttttatgattagtatttttatttttattagatgataaaatatgaatagtattttatatgtgactatttttattattattttttataattatttttaaataagaagaacggttaaacgttagacacggatatcaacggctacatttatttttgggacggaggtagtattagcttatttaaaagccaacatatataatagattagctatttgtctttatagagtactcaattttatctgctattagtcactataattttatttagcctgctatgagttatttgagaggacctaccgttaatatatatcttagtccgttatctaaaaaacttaagtcatgagaatttcgaaccaattcggtatatatgtaggagaattaattgatcctgcctgctaataatgtctaatagtagctagtacgaaacagtgatgatcagatatatatatatatatatatatatatatatatatatatatatatatatatatatatatatatatatatctgataatatacagcagcatatcgctctttgtcaaagacagatcgcgcaacatgtgcttttaatccggtatattagctgagagcattcagcatttcgatctcttttctcaagtggtgtcatctcatgctggccactgcaataattcacttaaaataactgaaatggttgtttttatgcttatcaatctcaattagaaatgggtcatggtcatggattatttgttcaatctcctttattcggaaaaaagtgtattcatcctcgagaggatatcttctcatttatttacatgttacttgaatagctattaattttcttttaaaaaataacaagataaatttgtataagatatatatcactatgcaaacatgtaagtgacttctatagaaaacaaatatatataactccctgtaagtgactcatagctactccctctatttcatattataaatcgtttgaccttcttttagtcaaagttctttatacttgatcaaatttatagaaaaaatagcaaaatctacaacaccaaattagtttcattaaattcagtattaaatattaaatatattttgataatacatttattttatatttaaatgttactatatttttctataaatttgaataaacttaaagatgtttgactaagaaaaatagttaaacgacttataatatgaaacggagggagtactattttaattccaactctcaaatgcatgctacagtactacttaattaacccaatccacagttaaagacggcgagaaaaatatcgatcggatgtgcaaatttgggtatgaagattacgcatccacgacataggtaggcgacgtgattcgatcaccgattccggcacgtacgaacagttgcgagtgacgcctagtgcatcacgcattcgctatcgccagatggatgtgatttctctgcgctacggtgttttgcaccaagagatcagtggtaagattctggcaagatttgttggaaagctcccactttgtccatccgaattggctgacattgaggtgatttgggcctaacctttttctgctagatacttgggggtttatgctccagggagttgataccaacatgtagtgtcaagatgcacttgatagtgcagtgttaagggatatatggttttaaccccgtgatcctgtgttcaatctctaacacgctcacaatttcttcttaaaaaatgtttggagggacgtcttttcgtctaaatctggtttttccaacatgtcgtgtccattttaattttcttttctgccccacttcttccttgtggaaaattctcaagctaggagtgaactgaacttgtgccttagctatggggaatccagttaattttatggccctcacaacttccattttaattttcctttctgccccacttcttccatgtggaaaattctccagctagtactgaactgaatttgtgccttaagagcaagtttaattgtgtaaccaactactagctccaattcatctatagccaatctcgatagctcattcatataatagttacatactacaatattaatatctggtcccacctgtcatacacactgttttggagtccgtgctacagctggctataaatctatagcccgctgcccttctctctccttatttatcttcttaaaatatgtttatagctggcttatagcctgctattgtaactgctctaattagctatggggaatccggtttaatttgatggcctcacaacttacaaatgtgctttagttttggtgaaattaattttaggttgaggtagctagccaattaatgtcgtcgttgatttggtcagagatacatgactgattaaaccatggttgttctggcgtagacgctgggctaactgatctgtgatcgtccttttagctagtttcgttcttttttctccctgtagtaaattttggcagaatagcgaggaaacggcaagtgttttgggttcatcctccgtcgcctaattagccgtaaatgcgagcactcgtatcaaatatttagaatttaaatctggatgggttagttccactaaaagaaacctaaccagttgagacactttcacttcacatctaattattgatgtgatatagtagttagcatgatacaattcagtttggattagatgtgacccaggaagcacaacgtcatgccactgcttcgaccaaccagtatttttattaaagctatgttagataagccatggaaagaaaaacaaacgaaacaaacaaaaataatttatgttcaaaacaaagctaatactgaaaaatgactggtaaaaaggaactaaaaaattaaattcaaacaaaagatatagaagttaaattttttttattgggccgataaactaatgaacagaggagacgaggggagatattacattcctgttgcttttttgtttgtaaaaataattccctctctgtcaatagcttggtatggtagcgtcacacaagacaacaacctcacctgggccggttgacatgtttggcaggctcagctcggctcatcggagatgcggcccgatctgtgtcaacaaggcctctgcacacgctgatgggccaggccgaacaaactactccctccgttttaaaatataagactttctatcattacccacatacacagagatattaatgaatctaaacacatacatgtgtctaaattcattaacatctaaataaatgtagacaatactaaaaagtcttacattgtgaaacggacgaagtaagaaataagttcgctttagatctctcaatttgtcggccagattgattttcgtccctaaactgaaaaccagatataacccgtccgccaacttacaaaaccagtgcaaacgatgtcctaatgtggtttggacggtggttttagctgatatggcgcctatgtggctagtttgacttagtcatcttcttacatgacgttgacgtggcattagaagctagaattaaaaatttaaaaagtaaaaacaaaataggtgggttccacctggtactcaaataaaaagctaaaacagtgggacccacatgtcagtgggtcaaccccctctcatccctcttctctcccccttcctctgctcgagtgctccatcaccgcccacttttgccggtgcctggatcggctcatcgccatcgtcaagacccccacgaggaagaggagatcgcggatgcagattctgcccaccggcgcgatgggctgcggctctcgatgcgaggcagataggtgtcgccggccgtcgtcctctcctcgatttgcagccaccagatttcgcgaatagtagtagcatttttctaatacggcaaaataattgcattggcatggatccaattgggttctaacccacaaaccaaagtaccaaaccactaacctttcagaagaatccagtatttcacattttcacagttccacacgaaagcaacccaacgaattggctgtcacacgaaatctacaattgcaacgactgtgccccagaatggagcaattaatcaatgaacgaacaattgcagttgacaggatggcacaatgttttcaatcaacggtcttgatgaaactcattgacagaccgagttgcacgacaaactgaaagccaatctcttcatttggcagcaattggtgacgaggggcgtcgtcggatcttcaggtagccgaatttggcagcgcctggggatgatccatcgaataggattggtaggtagccagttgctgccttgtacctttgctgaatctgcaaatgtccaaggcaaagcataaagctaatatctctcgcatgatacaaaaagaaactagtgcaagagtgtaacacttaattctgatgttagagttgttttccagacgtaacgtagaacatctcttattactgattatgatcgtagaactggaattccgaacatacctcgatgatctcctcactgcttttgaggcagtttttccccatgacgcaaactgagcctccggaacctcctccggtaatcttagcaccaaatagactaggactttcaccttttgacatatttctgtgctgcatttcttgtaccagattaactagcagatcagtcccatcagaaccaagaccacatgcattatagctgtagtggcactgccaacagtatgggatgaaaaacatgtcagcaatatacaacaaatgtcatcaactgtacgtttagatggtcaatcttatggtcaaataagagtacacgatacacaaagtagtggagatgctcaaattcacctggtacataagttctccaagggctgacaattgctcatcggtattagctgcttctaagagtgctttgaaggtctatatgccacaaattaaaacaaagttaataatacaatcaacattttgttggacacgtttcagacccctttttctaagtaaaatgttctgtaattttgatggtaaaaagcacagagcatgtcaacaatatcaccgcagcatgtttccaaaaagagtaaattcaaacaacaaaaagcttcataagggttcccaccatacaaatgtattgctgcctctcagtttcaggaaaagaaaaacaactgcatcaaaagcaaatagtccaaatggagagatctaacctcaactcgaaagttctcatatatgggatgcctagtaggagccttcacattgtaagatcttttagggtcaattgctgttactgtatcatcgtgatctccatatttcttcaaaaatgcatctccagtaatgacctctggaatatcttttgcataaatagcttcatatctgaaattgagatgtaactgtaagatatcattatccgcgcaatacctgaaacgatgtgtgttttggtgaacactatgataagagtgaacctgtgaggtggtatgttgcacaaatactccagggaagcttcggatttcagtagttctatggcattttgtttatagtcattagattgaacaggagcatcagaaactgaggattctgaagctaagtcggatgctgcacacttgatcatttttcgtcccatgtaagtgcctacccttacagatccgtaatctcccccaccaacactaccaattcaagcaatagtagaatactgcaattagctccaattcttgcaatcacaaaagttcagccttgataaattgataacaaaaggcccggtctggaaaattttctacctatgccgtatccctgagtccagaccccaaaaccgcatatgattaggaatggcaaccaattccttcacttctgcaggctgcagcaaaactgcgatcaaacaaatacagaagcaacattgtttttttcactgggttaaagatttgatctaccttgcaatgaatattgaacgctactaacctggcaaaccatcgcaaggagtttgttagcttctccacaagcagatgtcatttggtccattactccacatggagctccgacaacatgattctcaacctgaaagaccataggcccataaacgttaaggacttaatgagttgtattttaccaccaaacatttcttaagaccataccttctgacaaagcaaagcgaggtcccttggagcaatgtttagacctacataccagagcaaaaaataccaaggatgctatttagtacatgaaacagtgtttagttaaatatatttcagaattacacagaattggttataagccctaagttaactcattgtctactctatcccgaaaagagaaaaagaaagtagtggaaaagtaactactgtcaattctacaaaccataggcagctgcaatagcagccatagttgcaacctccactgatgcagaagaagaaacacctttgccttctggcacatcagacgaaacctgagtttcagtgcataacaaaagtaatcactattggccaaaatatcattgtcgcatatgggcaaaaagaaaaaggaggaaatgtatgtctgtgcatttgtcattctacttgaatccctaaaagagagtttagaaaataatttccctagaccaaaaaaaaaaaggaaaatcacacatgcacaataagggaagacaaaaaagtgaagcttaggtgtaccagaatgctcatgctgtcagtgaacttcacatctagctcagtcatcaacactagaattgttccagcgacataagcagcccatctgaaacaggatggagttaacaaacatgtcaacacagttgagcagtttaagcttctgtggggaatagaagacatttacttctgggatgggttgcgacaaaaaaattctctggctttctcgtaggatattggtttgtcgacatccattaaatctgacaatttcatatcaaaagttggtgaacggttactcaattcagacccaaatgatacctgtgagagagtttattggtagtaagcaccatatgaatttcataattgagatcttttttctcatgtaagaattagccaggacaagcattttcagcatataactaatatgcagtatccacgttcactgaggattaataaaaaaatatatttggatgattgagtagaacatactatttgtaccacaggttccatgcctccgttctcaagccgtcttgcctgtgtattttcccatagcttctgattgcttgggtggttcctctgtacagcaacatgacaggcttcccgaaggggcagctagtaattgcaccaaaacttttaattacaactgactaaaacagaagatgtattgttgtgatgccattagatggttcatttgctaatacaccatccaccagtgccaagcaatgcttttggatcaaacaaggagaatcacaaaaaatgggacttatacatcccaattattaattatttaaaagtcggggggggggggtcaagggagaataaaatcgcctaacttaaagatcaagtacagaaatatgatttttcacctgcaattgagcatacctgcaagactagacttcctgaatagtcaccaatgccacccatgacatctaaacgaccaggtgcccttgctatatacatttcctcctgaaatggaaccacgcaaaaaacaaataagggattatgattactcagtcatttattaagcattttgaatgacttccttcaattgttagaacaaaaggttaacaagaataattgattaatcagttatcaaagctcagtttcgataagagttgagaaaaagaaagatcggttaaagaaacaattcaatggccaaaaaaaagagagagctgtttggacatgttctgcaccatgtaatagatatggaaattacatgatacaaatcgtggtcaacaatgccaatcacaaaaaggatctgcaaactgtattatcttaaatgtttcccttgaattatatttcgtaagaaagcatgaaactaacatatggtgaattgacatgtgaaactcacaaggaccatgtatactacatcaaaatgagatacgatttactttgatcaaactaatatagtagcttagtgaaacttaaaatgaaacatcacaggatcattgttgatatattttgtgcatttaggaagttattagcttattatctgattgtacattgttgcacctttatgcactcttgcaacagctacactctagacatgctacatgaacagaagaagcaaaatttggtgcatgtggtagtatagtttagcagtaaaatgaatacagggaattccaagtacctcccagtcaaagagcacagatgcagcaattctctcttgaggttgcttcccattactctttaactcactttgattaaattcagataagctcttcaaaaaggacatggtgtctggtaatccttgcagatccccatgaagtatctcaaagtcttcaaaacatctaccagagttaaacttgttatgtcagtaacgaagtctattgttcaacaactacccaaatatgaaaagagagggcatttaactcacgattcggtgctttcttttgttttaatattttctgagattggacaggcaccaacttctgtctcggaaagagaataccagtcaggaatcgctacatctctccctggagccctttgtaattgataccctaacactatggcgtcttgcaatcgtcttgctccattgaactataattacaaataggatatgttgattggctcagatgattgtacaacagggtttccaaaacagatctaatttttttgacaatttaaaagaaggaaacagaagttcccagttcaatgaatgctggttttacatagcatggagcatagaaagtttcaaaagaagcttactgtcctctaacctccctgagaaaagttttccacatgaagtgtaaaaactaaagagctcaggatgaaaacaggcatatgagcaaaaaggtagacatggaaatccaaccctgttgtaactcactttgtcagaaatacacttcttcccaacagcagtgtcctcgaggattcgtgcagccacctgaatggacaagcattagtttatcattacaaataatacttatacggaatacaatcgatttagtgactatgcatctatccttctcattttggtctagataaatgagtattgcttttatcttatcacatctgattctgaacaaaaaaacaaaataaaatgttgttgcattaaccacataaatattgtgaattttggccagtttgcatgaaattatgcaataacctgggaaatcagttgcaaaattacctcaccaccatttgttggaccatcatagcatggttgaagtgtgagagcacggagtagataaggtttccagtgcccatgaaggaagtcccttctggtcatttcaatactgctctggtagtgctgaaatagaatgggacatggcggcatttttagcatagctgtacataagttattcctagcataacttgatgattagaaatgattcaacctcaagtaaattccgcaaaaatggctcttcattaaaataatctctgcggacaaagataaatggcagcttgtaggccaaagcctcacttgcagttccatatccaattttccctatagggtagtgagagtaagcagtgcatagcaaaatatagaaaatatggactagtattaaaaaatgaatatatcatgttttaccaagcatgcagtcagatgctgccatagcatcaggtgtgtaagcatcttttgcaagcttaatgaagtttggaggaacctcttgagaatcagatgcaccgcagacctttcatgaagacagtgctaagttttagacaaccacaccgggcagatgctttacttatttaaaggatagaaatccagtataaaaatctataccaaacagatccagccatcaggcagccattcttgcttcaggttccatcctgctggctggggacaatagtacattaataatttcgttttatttgtgatcatacttctttaactcaaataaaaacataggagcattcagtaatgaagtcaagattgggagctttcaacaaagcatataatatgaaacatgctgttaaaacagtactacagtgcaatcatggttttttttttctgttgcgggaacatcacgcgatgatatatctagatactagctaaaggcaacatagattcaaaaaaaaagcacaagatttatttcaggataatttaaaacacagagttatataaaacaatatcaaagggggaaaacagaaacatatcacctaagcttatgaaatttaaccatagggaacgcccacctgtcccccaaaattaaaaaccaccaccttcgcattttctgctattccaagttccttcctcacctaatagatcaaaaaagggaactgtaaattaagaaagcagaatgttgttcaagcccatggagcatcattcatcagtagaatcacacaaacctctgatctagatttgcgtagccctcttaccacaagaggcacatcagtgacatcacggaaagccggcactatggatttaaggaaaactcattttttaaaaaaattaaaactgagaaatgaaatactgacaattttgtccgttcgaaatatgaacattttaaagaaagaataggaaaaacacaaatgaacatactagggcagtatccaggtagtcgaagtaagatatcacaatgagaataatcctccgctatctgcaaaatattgagtagatagttggatattgagcaggtaatcgtatctgcacatggaaaagggagattgctaaaggagacaatagtgcagataacctaaaggccagaatttgaccactctcaacaggaaagggtaatgagctgatgtgggaaaaaaacaaacctgccaaacaatagaacggtgatgatcgccagatgccacaatatattctgcatatatgtagtcccaactgcagattgcacatatagtgaaacaatagcgtattatcagtgttgcttgattccgcaatgctaaagtatgcatccttatactatgatatgcaattctatttggcattctaaagtttggcaagacatggaactgaacatgaggtagagataagttgtgatgtgccaactgattcattcaaaacagatgaagtaaagcggggaagagacataaccccacctaaaattcccaatgcagaccgaggggataccaacatctgcagccaccctgcaggccacaggaacaacatccgagatctgcaggccccaaaagcaacaacagcacccacattcacttcagtccaagtaaatttcactcttaacaagtaacatccccctcctaaaaatagcaaaatgcatcgcaatgagacaagagcaatccagaagtagtagtaccactaggtctgcgttgatggaggtgagccactccgcctcggtcctcaaaatcgactcgcggggcaccacggccgtctcatgatactgcattccacagcaattcaggcaaaaataggtggaaaatgaagagagaagcagcagcgtggaaagcgaggagggcgtgggtgaaaaccttgaggagggaggcgagggggtcgacggtgagggcgtcggtctggacggcgccgcagtcgaggatggccctgcggatgtggaggaggccctgggaggacggggagcgcggcagctcggcggtgaagacgaactccggcaccgccgtggccacgtgcacctcgtgccccgccgcgatcaggtgccgcaccacctgcgatgggaagcgaacgctactgaactgctccagtgaacacgaagcgcagcagcagcaaacggagtacctcgatggcgcgggtggcgtggccgaagccgtggccggtgaggtagaaggcgaagacgaggcggcggtgcggcggcggcggcgcgtgggcggcgtctccggcgggtggcatggtgtggtggcggaagggaaggaagcttttggatcggaaagggaagaaaaatggatgggatcccgtagcgttggtggttgcgcctttttgctctcgttttggagggacgcttgcttcaactgccaccactccgactattcgcctctcataacagtccactccccctgtctctctctatctctctccccaataatacgtactccccgttttattttaaattcagttatagattactatgcttaacatttgattgtctattttatttaaaaaatttaaaaaaataagtcgtacataaagtactattcatattttatcattcaataataataataataataataataataataataataataccatattaaacacagaaactaataactacacttaacatgggatgatggagtaccaatttttacataaattaataaagtactaaaataacttggggcataaaaaaaagatattcccttcatttcactatgtagcaatttaggacgagattagacccagacttatcctagatttatgaatctagacatacctgtgattagattcatgatatggtatgtttatattcatagtcggatccatagtagattggtatatattgggacgagaggagtaataggtcgagggataaaataggaaatagttaacatatgggaaaataaactagtacacaaattaatagataagaaataaaaatatgtctcgagattataaaaccccatatatcatgaaacaaattagaatgtcaaaatcacttaccctatattatactacctcacctcatctcacctctcttgttcttctctaatttttttccaactacatgattacatccctctcacactattgtgtctttcgttttcttaacaagagaaaaatatctcacgactgctgactattattacacattcattaataataagaaaaggacgcgactacaccgagagtgctagctggatagtactaaagagagacacacttctttaaaaaaaaaagctactagtacactcaatatctatgtattttttttctttcttagagaagtttctcttaaattacttatccgatttataatccgattacaccgttgtgttcattgcaattaaatatttacaacaagatctcacataattatattttgatgaaaaattacaaattacttttatgatatgtctaaattacttttagatttcattaagttactttttaaattataaaagtaaattctgtaagtctaaaagtaatttatatatatattatagaagtaacttagaacaaaacgaatgtaactttggcatgtcatttgaagtaaatccgttgtagagataaaaatatgactctatctagaaattaaattaatcagcacaaattatggaattaactaaaaagtcatattttatccctacaacgaatttacttctaatgtcgtgacaaagttacttccgttttgttttaagttacttttagaatatatgtaaattacttttagactttattgaatttacttttatatgtctaagaattaatttagtcaaatctaaatgtaacttatatatatatatatatatatatatatatatatatatatatatatatatatatgataaaagtaacttatgtatataataaaagtaatttacaaatataaatattttttcatcgtaacataatcatgtaagatcttgttgtgaagatctaattataacgaacacaatggtgtaatcggattgtagatcggataagtaatttgagatgaaactttatttgaataggaaaaatacacccacgtgaactttatttgaaaggaaaagacacccacgtggatggacatcatgacgacgtgcacagttagacagctctgagatgcgtcacgctatagagctaaaccgagagcgctcttgaaatagatttcgcgataaaaaaattatgtttaactctctgcatctcaatcaaaaataaaacagaacaaaaataactatttgggcccccttgcaggcctgatctttgaggaataagttcactttgggtctctctatttgtcgcccagtccaatttttcatcccttgaccgcaaaaccaggtacgacccgtcccccaacttacgaaaaccgggcaaacgaggtccctcggcggttttgatagcggttttggttgacgtggcgcctacgtggctaatttgacccggtttttatctgacatggcactgacgtgacgcttacgtgacaattcgatatggaaaaataataaagaccgtgggacccatatgtcatcttcacacacaaaataataaaaaatggtgggacccacgtgggtcccacatgccatattcaccccatcatcttcttcctccctctccatctgtctcctctcctctctccagcctctaggcgccatgacccacggggtcacggggaggtccggcggtggcggccgcccaccccgacgagttccacctactccccccaccgc

SEQ ID NO: 77970 - DNA, 41459 bp, Oryza sativa
  unsure (1)..(41459): unsure at all n locations
agggagaaaacgggagccgtgccactcctctccctcaccgccttgccacgccgcgccgcacgctactcttctagccgacgagctcgccgtcacgccgacctcctcctctctcgccgccgccgttgcaccgactgactcctctcctcctctctcgccgctgccgtcgcgccgaccacctcctctcccgccaccgccgttgcaccggccacctcgcgccggccacctctctccccctcccctacagcccccgctccgtcgccagccacctctctctcgtctgccgccgcgcctgctcaagagaatcaggagagaagagaagagaaaaaagaaaagaaaggagaaatgtgaggcccacactattttctctcacttacatgtgggccccatatgtttatttatttatttttgctgactaggatgccacgttagcgaaatactgtctcgggaccttttttcgacggttttacatagtttaggggtacacattctggtattgcggttaggggacctcaaacagactcggcgtaaagtgagggacgtccggtgaacttattccagtgcgaaatactggagacaatttcaacggatgcatcgtaaggccggccagcccagtccaatatcctctactaccctattctgggcctctatttctcttgcgtgtgggaagtgggctcgttttgacgggccactcgctgacgcgagctttctcctacgaaatcaggcccaaaacagagtgccctgcccttgccactgtctactaaactctcagatcgatgacacgacaacggctgcaggtcacgccaacggcaataagaagatgcaaatgaatttatttgagttgctatctcagatttgtgttaagttggagagagaagagaaaaaaatatcatatatatgtaaccagatatagcagactataataaaataatttaataatatagcattagctagacattaatcatgtactacgtttctatatccacctactaaaaaagcaattaaattggttgtaaatgatatgataatagatatattaagacatatctaatgaaaattaattatcaaataagtgaaaacccgttaaaaacgaaacctataagttttgtaaattcataaaaaaaattttaccagagataagtatagacatgaattacattactgccaaatcttcaaatctcaaagtccaaacttaaatttatctctctcttttttacctaaaatttgtctcttttttacctaagatgtggccttttgtcgccattggtttgtaatgaccttggatgggatgagatccatcctaaaataacgaatctacacatatctcatatgtctagattcgttatcgtatggtaaatcttatcgtatcctgttactacattctcgaacgaagggagtatataattaattagctaagctagctaggagtacctccgtagcattcatcctagcaagtgtagtgtgtcatccagcatgtgcaacgacattggctggccactataccttgaaccaacctacctagttagctgggcacgatcagcaacggttatggcagtttatgtatgcaatgcgcggcgcatttcttggtcgttgcagtccaattagtttataatgccttcagctaatataactcaatttgatccctccccgttggagttggacacaagaaactgcatcatctgcaactctgcaagcatgcatgttctgtatttacaccatcgtgtaaacatatactatctccatcccagaatgtaaaatatttttaaagcaggcacagatattaaaaaagtaggtagagataattgaatgagggttatcaatcatacattttcattttgatacggatgtagtacctttgcttctttaaaagataagagcaaaagttactagtaatttactactccatccgtcccattttaagtccagctatgagtttctgtgtctaccatttgatcgtccgcctcatttgaatttttttataattagtatttttattgttattagatgataaaatatgaatagtactttatgtgtgttttttaaaacttttttataaatttttaaataaaacaaatgattaaatgttggacacagaaatacacaactacacttcaaattggacggaggagtactgatgggcagaagttcagcagcgtatctgcagttagatatcctcggttgccgttctctgaaactactgtgaatgcatgcaagcaagcatgcctgtccaaaatgttcagtttggtccctactctgctgctttgatctgctcgaccaccgattcctgatggttgatgctgccgttatcccgcactagctagctacattcacaagctacagcattacatcaacggccggcgcggttaatatgtcgtcctaaattgtaataacttttagtatttaaaatttatccggagtatacaatttctgttactctcatatctcagctaatcgcaacaatatctcatttagtttcttcagctatatatatacccatatcaatcgatcacagccatttttcatttaattccatatatacttccttagcttccgtttatattccgagatagaggaatagatagatggatactctgtagatagcactactgtcctaaatgctagtacatctatcttatctgcaattccagctacaggacagtggtttgctagctcatcttaagaagaaccagagtaaagggggggggccttactggcagggccttattttttccgagagaatgggggttttcatttaaaaatggctagcttgctgctggctgttcaagcataacaaactggtggtctgggccgtacttcataccaaaacagaaatgcagaagtgacctgacaaaattttgttgcaatttgacttcacatgatcgatcacagatgcccttgctagttgctacaaacctccatgatcgcttcacatgcgcatgcaggtagcttcttccaacaagaaaatttggtgtattatattgtgcatgatccatggttaaaaattaattaaggtttcagatttgtgttcagagatattaacaaattactccactccagtagtgtagtggtgatctgcatcggttcttgattattgttgggctgcgagaaagggaatcttttctttgatcgtacgacaacaatccaaaccgtaccaatctattgtagttaactgtaattaatttgattaagctagcacggcgagcagatcgagcttgaccaactacgtacaacacaatcttcagcttcttgccaccttaactgaaagggaagaaataactaatcgccactacttcgtcagttgcctctgccctttgaaatttcggttcttcctaactcccaggtctgacctcgagtcaagaactcaagattaattacaatgtgtttgaatccaaccgttgacgcttgatgatggatgtttgcaaattttatttgggagcaggacttgatcagaattcagaactgaagattgttcatttttttcagaagaagatgaaccatgagaactctgacgaactaaatcactacctggctagaacataatgaagtccaatttattcattacaatgtcagctacttgaatagttattggaacggattatttattccatgtgtataaaaaatattttttagaaaaactatcttctattgcattatttataccactagcttgtttcaaactatttattaagtttattttttaaaatatttaaattatcgatatgataaagtggataatttgctcaataatctaaatcaaacaggtttaaactatggatacaaaagaaagcaaagtacaaaaatgagatattcaatgtctacactctacataattgtactgaaacgtgcatgcaacttattacaattgcagtttatattctacctagagcaccaggacatactgacttagtccctttcaatccatgatccggccatcttcttgcacaatgattagagaacaaaatcaagcatatggtagttcaagatatactaattgggttttaggtgctgatcgattgctcatttgggtcctcctgctcatgattagcatggtggaggaatctttcagcaacttggattgtacctgtaaccttcagaaaacaattattttgtattcacatgaaaactataacgatacatagaagaatgtgaagtctaactggttgatacaattagggaatcttgcattaaatattttcacacttgatcaacccattttattgaattattcaacacaattcatgttaagaaactttaaaagttcaggtatgatcagaactaattaatcatattattatgcatcagaggcatcttaatttgcagtgcttccattgttcttttcttttgcttagaaagtagtaggacatatttttattgatgataccatgtgaagcctcctcacatgcttgcaagcatgcaactccctccacactagtcaggcctgccatgttctccccatgcacacaatttgaaactgagaaaaaagaaagttagaagccttgaaccaagatcaagtaagaacataggcactagtcagagaaaagtacaccaactttttattatatgaatctaccgatgcaatccaaatggcaagttgagagcctcaaaaacaaactttgtttttgtttgtgatatgcaggctaactgactgaaaaccactgagcattttgttttggttcccaatgtttttcagtttgcttgagcagttcgtttggcgtttcattagttggatacacgtaaggtagatgattctctgaattcaggtcttacttttaagttccatacttacagccaaattgatgctgatcaggtacatacagatttgtagatttatcatttatgctgctctactaattcaaaatgatacttcagagaaatggtgctttttttttttgaggggtagagaaatggtgcttgatcaggggaaatatgctgtttgttcaaatgcaaagaagcatctagctagtccttgataccatacagtaaaactataaaagtgacatctgcagcaatttcactctgctctcttcacactaggaaaaagttcaggagttgtctggttcattgaacagaaaaaatctatcatcgttgtatagcaataataggagttcttgagcaattgccttcacccatacaccacagaaaccaaggcaaaaatattcattttctttatccaccaccaactctgcatttctttctgaactgtaaacaaaagcccatgaattttccacatcacaaccagcaaatgagtgatcttgtacttgagagaatcaattgccatacccacaatcttgactgactgaccatgataggacaacacccatagaacattcagcttaaattctactcaatctgtcacaaaatataagagattttgaatgaaagggatgcaatctagtcctataaatctagatagagaatatatccatattcttagtgctagaatatgtcgcatccatccaaaatttcttatatagttatattttaagatggaggaagtattagtaagtactaggtaccaagataattgagtatttgaatgcagtaaatctgtcaatatgttcagatggggtagcatttctctttcagttttcaccaatcaccttgacccacatcatgtatgcttcagttatagtgatcccgtagtatcaatgtacttcctccgttattaaatataagcatttttcggttgattactaaatgttaatattaagggaaaagatttattttcaatcacctggttggtcaaattttaaactgcttgaattcctctcctaatcatctgattggctgaaaatactttggttcccacacattgaaatcttataatttgcgaacgaagggagtagtaaaattataagagtaaaagaaaaaaaaacaccttttcatttgtgcagttggaaacagatcctctgcagtaatgccctatgacttcaagtgattgacatatggaccccacacgggttgggcccatatatcagtgacacaagtatgtactgcagaggagattcatctttgtggagatctgccgtactgtaacaggtagagagccctgccaaacaggtatctcaatgacatgtaagacccacataaatcaatgacttgtgggtcatgatgacatatcttaaattttgtaaaattataatggcatggttccaattttcccaaaaaaaactaagggtggagtttctgacaattgcatcttctactataatagctcctccaaacaatatagattttagcagttgtagaatccaaaaaatgtattagttgcttctcagaattttaagctcccaaaccgggtttaagaatcattaatctctaccattaaaaaaaagcatcgatttgtacagttaaactaaccgaaaaaggagtcgagagctcacgagacggcggctcacagccagaggcagcaaaccccctccttcctataaattctcaccctcaccaccaccatctcatctcctccattccattctccttcccaccattcaaccaaccaacctgcagctgctcaagaacacctcactccaatcagcagcaatggaggatcatcagggtggcggtgtaggcagggcgagcaacaagatcagggacatcgtgaggctgcagcagctgctcaagaggtggaagaagctggcgaccatggcgccgggggggaggagcggcgtgcccaaggggtcgttcgcggtgtacgtcggcgaggagatgcggcggttcgtgatcccgacggagtacctcggccactgggcgttcgagcggctgctccgcgacgccgaggaggagttcggcttccgccaccagggcgccctccggatcccctgcgacgtcgccgccttcgaggccaccctccgcctcgtcgccgccggcaacggcaacgccaaggccaaggacgacgccgccgccatgtgctcctgctcctccgacaccgagatcttgtgcagatgatgatgatcaacaccatttcgccatttgtgtgtgcgtgtgtgttttcctctctctcctttcttgcgttcgttcgttccttctcgctttctttcttcgcggctactttttttttgctgaagaaaggagaagaggttggctgcaatgcgatgcaatgcaacagactgagagtcagagacagtaattgatgatgagatatgtaaaattttatggtttgtacaaggggaggagatgaaggattcattcttcactgcaatgatctaatgcaaactttaggctactaatttatatatttgtgtcacagagtactctcatatgtatatgttggtttgttttgtttgctgcattcttggttcagaaactgaagcctataagcaactgaaaaagctgaaaatggcttacacttcagtattttctcagtgcagataacaataatgataattactgaccaaaatacaagtatctaaagagattagcaatggtaggtcacaagagtgcaagggattttttttttaccgttttaaccttctgcacaggcagggtaagacctactcttcacttgaagtaaaaaaagaagccatttttacttactgcaagctccattctgaagaatcttgactagtgatggtactagcatattcttaatcatgtgagtttgtataatgtttaagattatagtacatgctcacatggcaatcacacctggtcctcaaaggaacacatgtatgggattgggaccaaactctctccatattttggtgaatcttaattaagctaatactaattaaactagcatcatctccgaatatatcatctcctgtagagtgtagaaacatagccgtgatagcattaaaagaacatttttttgagtgaaagaataagatcaatatcattttggtggtatctcagaatctgaagttacagctgaaaacaaccaatctcaatggtactctgaacttgggcgagttcctgaaactgaattaggtttctctaaataatattgacaagacaaatccatcaggcgaaactgtctggccccaactggtaaggggagtacaatgattgctctatttggagatttgttctattggcagcaccctcaaaattctgggaaataagtacatttttgcagagataagttagtgacagtctgactgacagacacaaaaattccctgaatttcaaaatgcagcacagagctgcactcattgtgatcagccaggcattcttgaattgcacagatccagatccaaagttacaaaattgttaagactgatttatcaattctgttttgaaaatgaccagtttacattaactaggcatgctgccaattgcaaaaacccattcagttttaatggacatagagggtactgcatctgttcatccatgatccatgacgttcaattgatgggtgagatagatatactatcatcccatattcctatcgcctccaactaccaataaaaacaaaattatttcttcagttataaatatattcagcacggaatttcagtacttgaaaaacgcaaaagcgcaagttcctaaaaccctatagatatttatatcttttgggtttatgtacaataacctgaaccgaaattcctccaagttcagatcaaccaatcatcatcagaaattcctctcctgcagatgcttttttgcagttcacagctttgctgtttcatctgctaatttgatttgtctctctccaccatgaactatatatatatggctcaaagaaagaaactagaattaattaatctcttaattaatcactctgtcaaatgtactactccatagattaacttgcatgcacatcaaagctactgtctaagccaattgcttctccagaaatccatggattgaaagcaaaagtcaccaagaacacgccatgcatctgcttgcagcatgatgcaactatgctagctacccatgcatattcatgctaattctgaattttttttctctcgtctctacattatattttgcacttgcacctgaagcaatccagtattttaggtactatataatccataaaattagtgtaaatacgtacgtgtatatatatatacggtatatataccgtatacgtacgcgtggctagctgatggctttcttagccttggcggcggcggcgccgccgttcttgcggcggaggcggcggaggagatcctcgaagtcgtcctcgccgcagggcacgcggaggccgccggcctgggcgaagccgaactcgtcggcggcgcgctccatgaggtcccggaacgccggctcgcggaggtaccccgtgggcaccacgaaccgccgcgcctcctcgccgacgtacaccgcgaagtaccccttcggcacgccgccgccaccggccgtcggcgacgacgacgacgccggctgctgctgctgctccagcagcgtctcccggagtccatcgtcgttatcgccgtgatgcgccgccgccgacggctgatccttccccctcctcctcctcccgcccttcttgggcgccagcaagtagcccatcaccatcatcgccgccggccggcgaggccgcagcaagatcaaacaccacaccgcactacgtttcttggtcgtcgtcgatcggcggcgattctggtcgtatcatgagttggtggcggccatggcggctgctcgatcgatcgatcgagatcgctagctaagctcttaatttgattctttggatctttcggattggtggtggtggagaagcacaaccaccacgacgacgacgacgtggtctcagcttttctcgatcacttcaattcctatacgtggtggtgtcaaatggcaaccaaactcgtatgattaggaggttgggaagctaagggggtgagtgttttatagttgtaatttgatagggggttaattttttaaatatgagattaaataaactcagttgattttagccggtacggtagtcttcactctggtaagaaagaaaatgttattttaattaggatcgacgtgtgcagtcaatgtaaggtgaagttactcgtgcttaatatcatctctgtttttaatagatttttttagataatggaatttaacatcccggcctttgctcaaaaagagctacagccaattattacattatagcaatctagaaaagagcgtagttcagctaaataggacacaccaaacaaaaacagaggaaaccaagtcaaaataaggagaacacatttattgaagtctatttgtgaacctccatccataattggcaaataattgcataaccattgactccaacttgcggcatgcaatctttaggaactccccatcatcctcacacctttgtagctgtgcccaaaaccggagctagtgcattgccctgaaaattacctgcatatatgaaatagatggtgatttattaaaaaccaaatcatttttactcaaccatagagcccaacaaatggcagaagctctaaccagtatcagtttactctttttcttatcaacccccaaaagccacccatcaaatatatgagatatattagttggaagattaaaaccaaaaaaaactaaactgctctccatatgaattttgcataatgacaatctatgaagagatgttgaatagtttcatttttcatacaaaagcaacatcttaagctaccattccaattccgtctcgccaaattatccttggttaacacaactcccttaagcaagtaccacataaagatcttaatcttaagcggcatcttaaatttccatgtatatttgtttctctcaatataaccgttgttaattaaagctagatacattgaccttactgagaacctatcattctgatgataattccatctaaaacagtcagaagaaggatttaattgaatatgtacaatagaagcacacaattcatgccaatatacaagattctgaccaactaaagctcttctaaaagaaacattaagcggaacagatcccataacagtggcaatagtggatgatttacttcggactatagcatataaagatggaaatttatccttgaaagccaagttacctagccatttatcttcccaaaatcttatttgttccccatcattcacaatccaagagcctatatctaaaaaagtacttttgactttcataagccctgaccaaaaaagggaatcaccttgtttcttgtccacttgggttatagacttgttataaagatatttccttttcaataagttctgccaaacccctttctcatttattagcttgtacaaccacttactcaaaagacatttattttgtaattccaaattatgaatcccaccgttaaattttttttatcacgcgtttgatcattcgtcttattaaaaaaattacgtatttataatttattttgctgagggttgttttatcactcaaagtacttaaagcatgatttatatcatatatatttttgaataagacgaataatcaaacatgtgtttaaaagttaacggcgttatctattaaaaaacagatagagtataatttaaaatgtaatctttattgttcatatgaaaaatttattgaaaaaactttattatagtattacacttgtatatttgattattgttttcaaataccttttttaaggaaactatgacagtagctctaccggatatattgaggaggagtaaagttcaaaaaaataataagaaagaagtttagaggctcaaggggattagaggataatcacaagtccacttagttaaaaagaaaaaagggacacccttcagggcggtttaaaatgagctgctcaacctcgatcttgttccaactttttgcacgaaaaattcttatgtttctttccaaccataagctccaccatgtggtcagtagcataccaagattatttgcctttgcatggtcagtttctttccctttttttttcttccttattccttggcaatggctgatctttagctgtaaccaaaaccctgctttcttctaatatattagcgtgcagtccttttacatgtttgtgaaaaaatggtgggggtgattgtttttcaatctatgtaaagaataagtggttttagttttgttttgttaactttttaaagtccaaaaaggtattcttttgctatcgatatcgagtggagtagatatctatttaaggagataagatgcaattctaggagtgttttacgcaattttattaacttaaaaatactaatacgtacgtgtgaacttggccacagcccacatcccaattaataatcgtcttaccaaatcgtgtacacaatactcctgctgtgttgactaatcatcatgcatcaacggataagtggccagatgtatcgatgagattagcaatgtacggccggataattaagtttataataagtacggttccgtagtactaatgacccattgactctataattacttgcaggattattagatgaactaaacggacataccgaccacttcatctctctttttttttcactattcaattcgctggtattcttttatgtactaccagagttatgcttctgcatacacgtatccctttgtggatagcaacattatatactaaatccggattcaaatatgtgaagcattttctaatccatcgtgtagaatgcggtacataattaagaaatgtaacactcatatcaccgcacaccgtgttactcccgcgaatatacgcttttgaattgttccattgtgtttaatttagcctgttctaagacaacctttttttttagatttgtctaaatttatagaaaacataataatatctataacaccagattagtttcgttaaatctaaattgtattttgcaccaaggaaattgtatcatgtttcatttaacactaggtttactacatacttttactttacacaagtgtaaataattaagtttcactttgcactataggtggtgtcatacaattgaaagaaaatcttataaaatatctaagtggagcttacaaaatctttcgaatttagaccatgttttacgaaagttcattcagatttcttgaaattttcatagttttgatagtgtattaaagtgaaatcttttcaatgcaccatggtgtaatgtgaacaaagtacatgataaaccggccctgtgcaacctacctagtgcaaaatgtaatttacttttgaatattaatatattttatagcactagctgaatgcatgtgcttaatacggataaaagaaattttattataatattatgtgttacacatcatttttctatagggtatgttcttaccataattcaattttatatgtgcctatccgattatttctcaatattaagaagtttgagtagtaatttaaaaaaattacaatgaaagtaggtggggtggcatcaccatatatcttcctttaaattaaggagtacaactatttgtttgtgttgaaaatattgttaattcatttataaacttagttaaactttaataaatttaacttgggacaaacataaacagcttacaatatgtacatatatgagaaaaatatgctttcaagtgccaagtatacataattaatggccaaatcaattattgtacgtgcacacatgatatatacatggtaaataattcaactaattagctagatggacccggatgcaagaaagaagtaatttattggtgatgcagcagacaaagaggagtacgaaattggggacgactagagtacggcctaagatcagttggccggccactttcaccccccttaatctatgcaaatatcttaattaatcaccaatccctcccttaattaattattgtaatctcatctctaatcccttcatcatctcgcgtctcccgctgcgtgaactgcacgattgtcagccagccaagccagtcaaccaattgccaagcaaaattttctaatctggtttagtttgtctgaatttccgcgtagtgacagcatctaaacgcaactgtctggataaactactaaattattattgctgcagagaatgattgattaattaagcaccacgcaattagcacggttcagaattagcatcggattataatttggacgttgattatattgcatgtcgccgtatgactgatggaaccgtggcgccgaattcagagagggcgctggtcaaattggttgaaatgatttgagtggagatggcactaattaattaattaattggggttggatgaacagtgttcttctttgaacagttcagattcaaagcaagaagatatacgcgcacgcacagattgatcaaccctgatgaagatgaagaaatccttttcagtagagttgtaatttttttctcgcatgcatttgattaattttgtggttcaggtaaactcacactgcacgtacgtgcatggatgcacgcattgcaataatcaagattaattttaagccaagaaagagatcaatacattgtgtctattgatacaagccaaagatcgatatgtaatctattttcactataaaggaaaaggagagaactcgatcggtgtacgtaatttatttttaatctttttcgcgtgggagttgtccttctaggttaatttatcttagacttacatgagtgctcatatttaagatcgaccatatatatacactttcagtaataagtgatgtgggataaggtgtgcagttattacgggggtgagtgtataatatatacattggtgttcgtattgagtttcaaaaaaagaaatttaagccaagaaatatcactgttagaaggggggccattcctatggacaagtggggcaactgttttgttcaaacacatacacgggttgtatagttagtctaacaatgacataatatcaatcattttcagcacggcccctgaataataatcttatgtctcaacctgttaattctacgtacattttcttcagacagttttgtacgttgtcttcagtatccaggacggaaatttcaaactccaaaatccaaattatgtttgtcggtgtgctgccggtgaggtttaatttcacacgatttcttgtttattaggcaactgacaacaacaaggtcgagctcgatcagtgagtgtatatatatacagatggacatatgtaggtataataattctaataatagcaaagcgagtaaagctcaagtgcgtagatttcttaccgcgattacatttacagatagtaattctttcaacggtatatgtcgatagcgaatcgttcgtgataatttcgttaatatcaaaatatacgatatgtgtgcgtgtgttgtgacttatgatgtgtttcttaagaaggcttctattaattaattaataagatttttgagataggtaaatggaattatcttgaagattgggttcacgcaaatgaataattaattagctgcccgcagacaagacccgtgactttggccgaggaaatgacaagctgagattagcgagcctttctccatcaacttcctagttaatttctttttcttcttcttcagatattaggtagagctatatggtcttgtgaatgcatgcatgattgattgatcttttcttttgcgtctctttcagttgaattggcctgttgatcacttgtgtgctagtagtgcagaattagcatatggccttaattaataatgtttaaccactatagatttattttctccagtaacaaaatatcatcctgaaaatcctgtcctgacatgcattatttcttgaaggaatatactgcatgagatcctatatatgtcgagaattatctgatctttttctagacgccggcaaagcactaaatatctacatgtaataatataatagaaaaggacgacatatatgttgaaatacatacaattaacaataactgaattgaagaggcatattctagcagaaatagcttcatcattctctagcagaagagaatatatagcctttcccttttaaccaaaaaaaatgtagcctttttgcaacaaaacaaaagctatacattgcgtcggttacgttagctaggcaatcagatatggtcaaatatatacataaacaaattattattataattctgcctccagaacctgacgtgactaaaatcaaaagtcagtagaaaagcagaggagcaaattgcgttttgggtgtccgtacgtacgatgcagtggaggcaggccaaatctggtcagaaaaatacttgtctgaagatttgaaacggtccatgattttctagtaacacaattagattaattaagcaagcttggcatatcattagctcaagtaaccaagcaacaccatataatggagtagttaaaagagatgctgcaaagttcagagaatatgaaaatccatggacctgaagctgtcgactgataatgtgaccaaaattcagaaactggttagctaactgaactgcaagcaaatgcgttcagcacagtggtggaccaaaattcacgatgatcgaccaatttttacatatatcagccttcaatcatgagttcgatcgctgttcacctacctgaattttcaccgattatcatgcttggttttgcatcctgaaaccagaggctgcaaaaagaatgtaatgcacatcagttagcagtagctgtcccattccagatacacgagcagtcaacagcaacagatttcggtgtcaggtctcacgttcagacccacggcgtctacacgatttcaagaatggctgcaatggcatgtcaggttgggtggtgaaagcgagataaagagatgccattacatgcatgatcaacaagatgattatgatgcccctgcttacagaatgattacaaagttgtgaaggagaatcactgggtcgtacgatgctttgagagccctgtgatcttcctctttctggtgcaggaaaggaacttgtgttgttcatagacacatcattttcgtgatatactctgcaatttgcagcatgtgacatttttgcatacatgtggacatggttcctgctgaaaaatggaaaaatgccaaaccatttggttatcagtttgagatttttttttttcatcgatgtgaattgtgaactactaattgagagttgctgcttcaggctcaacctcaacaaccagcagccatgaggattgacgctggcaacctaaacgagatttggagggagagacatccctcaaaacatttttaagaagaaattatgagtgtattggggattgaacacgggatctcggggttaaaactatacacctcttgctactacactatcaggtacatctcttatcctggcaacctcaggaactgttgctaacaatcataaactagctgcagattggcgccgttaattttcatctccaaattccatttgagctggccgaaatagcatataaacaaggtgttgcaccacatgtaatgagtaattgtgtaattgcacttgcaacctcgtatggaaccatgtactggagattaattgcatgttatcgccaacggattgttaaacgtaaattaatgtcgatcaaaatgcagtatgcttttctcagtctatatataacaagttaaagtatggccttaagagttggaattgttgtgtataaatacaccttgaggcagatctggctgggttgattagttagcatggtaattagccaccggacttcgcattggctagtcatatccttgaatggcgtatactctatgttgatatacagacactcgatctgtgtgagatgccgggtttgtgacagcctatgaaacgccaaaggatgaaaaatataagtcaaagtggttatcatgccaagtgagccagaacttatagacgaccaaagcattaatctttacttttcaaacggttgctgttcttcaattaggccggtaagaataaatagattagtttgacctttggtaagacacattgaggcatggatcgtttgttcttgcccaatgaaaggaaccaacgattttgataattgtcacatggatcatggatgcagggcgccggtcttggttgaattttgcaactggaaatcctcctcattctgctgagatcttatacatttaaaaataataccgtggacctgctgaaaagttgttgtttgcctatgtatcctactacaactctagaacacaaccgttaaatttccgtataattaatttcgattaatcatttggcgggacctttttgtccgacaaccgtattccgtttcccacgtcgacactgaataagagttcatttaaacccaatcatagagaacaccccaaagaccccaagcatataaaacttagaggacaaaattcccctctaaaaactctcatcggccaaataatgcactacgagtgtcatgtgccaaacgcactagaccactagcggagtgtcatatggtaaaaacatgctttcaaatatcctaccacaagtgccacataaatatatgctccctccgtcctaaaatataggaatttagaatcagatgagatgtttgtccatatatattgtactagcaaacgtgttccaggttcttatattttgggacggaggtggtatatcacaggccatgtcaatcacataagagtttcttccatataggccctgttcttttctccaacaagagttggataaagattaagattttctccaacaagagttggataaaaattaagattttcgtggcacgttttttaaactgctaaacggtatgtttcgtgcgaaaactttctatatgaaagttgctctaaaatatcatattaatctatttttcaagtttttaataattaaaactcaataaatcatacgttaataccacctcattttacgtaaaatacttaatctttatcttcatcttcatcttcaagagaaaagaacaccaccatgttcttacactggactacgtataccatcaaatctttcaggagggctcttgcagcgatcatacggtaaagtactcagctgcgaggggcttaattaagcttctcttgtgatgaccaatagatctgcacattagataaacataagatttttcattcacgtacggtgttaagtttgcacagatatataagtcatgaaataataagctcacctgcagtgtgccggtgatcagcaaacatactgatcatctctgcgtctatctccctcgtcttcgtacatgcgcctgcgtcttaaaagcaaatgagtatacttcgaaacagggttcaaattgtcgttttcaggttatactggaattaaatttcggcctgaaataatttaaaatttgatcaaaatttagtcaaatctgaacaaatacacaaaaaaaaattgaaaagaaatccaaaaattccgggcgaaatcatttcatatctatagacccgaaattctgaaccctgtttagaactccatcctatagatcgatcaaggtagttaagctagcttgcacagcgatgaggcggcgatcgaggagagaacgggacgtcggtcaccagcagcggtggaggagcttgcacgctggtgctgctgctccggggagtagaggccgtagcggcgagtgtcgccggcgtgggggcggcggcggcgcgggtgggaggtcggggacgaacatggcggtctagggttttaattttgttttggaatggggaatcgagaggttgacgacgtggggtggttggagttggagtaggagggggaacgcgaggtcgcgaaatatgggccgggccgggcccatctcctcctcctatatggattccgaatgggccttccagaatacaaatggatctggtggaaggcccagcacagcaccaaaatagaacacattgaccttttttttctctctttttggcaaaaacattgactttgttggagttatggagtactatcatgttttgtcagattttaaattgggctcaaaatatttcaacttcgctcaaaaagaaaacggaacaggctataggcataggatggagcgtagtttgggccacaccgcaactcccctctttaagttagatttaggagttaaaactctactaaatgcactcttaaattagactttaatcgcacatatacgtactagcatatagtgcctagctagctactcgaggtttggtttattttgggacgaatggcgtatatctagatttataatactattatgtgtcacatttcgtacgaggttgatttattttaaaaccatgggtgtaatatgcccagtaaagccaccacggctcgcccataactccatattctttatgaccggcctctgctatgataaacataatctagaggttcacctcaagatttggcttcatacagcatatccgggcatttgagatactctcttcggtttttaatagatgacactattaacttttgaacacatgtttgattattcgttttatttaaaaattttatacaaatatataagatactctctccgttttagattataagttgttttaactttggtaaaggcaaattagtttaaatttgaccaagtttgtagaaaaagttaattaaattttcatctcaagaaaaaatattatgaaaacatatttaataaaactaatttagtgttgtaaatattactatatttgtctacaaacttgatcaaacatgaagtagtttaagtttaaccaaagtcaaaataacttataatatgaaataaagggagcataaatcatgcttaaattactttgaatgataaaacaactcacaacaaaaaaaatataattacgtaaattttcttaaataaaacgaatagtcaaacatgtgacaaaataacaacgacatcatctattaaaaaaaatacttcagtacctttatataattatacaaaagttttaaattagtaaatgatcaaatgatttacaaaaaatctaacatcaacgtttattttaaaaggagtagtactctatagtagagcaagttcgatagtatagctaactgctaagtctaaattatctatagttaatttaatagttaatatatatagtagttacctacaaatatatacttatagtgtactgatacatggtctgatacttggggctcatagctagcgcgtgcgcgcggctagcaagcacctccccttaagactttaactacatctattaatttattagttaatatttaacactaatgatactagtagtaattagaaaagattctgaagatttttaagagatttttttactaacagattgaaaatttaattttttaagttagatttgaaaacttttgatttaagtttcaaattttaaagtcaaattttgaaaactttcaaaatccagatttgaaaaatttgaaaacttttaacttgagatttaaaaattttcaactcgagatttaaaaactttcaacttaagattcgaaaactttcaagtctagatttgaaaattttgaaaactttcaacttgagatttgaaaattttcaactcgagatttgaaaactttcaactcgatattcgaaaactttcaagtccagatttgaaaattttgaaaactttcaactaagattcgaaaattttcactcgagaattgaaattttcaaggctagatttgaaaattttcaagtcaatatttaaaaactttcaactcaaaacatttgaaaaaagcacatttgctattggctaggaaatagtggggatggtggatgcatcgagtttgttgctagagtaaatatagtatgagagagttattagcttttcttggtcttagtgtacctatgaaatatatagatcaatttggaatggagggagtacttaggtgcagaaggaaatgatataacttttccccccagattttctgttacttcatgttttaggtataccaatatttttgtgtacttggttgatctgtgcactagcatataacaattatccggccatcaaaatggatgaattttccatttcatcatgtgaaagacataataactggaaccttatcaaagacatatacttattagttattgcatgaggtagttaacagaattgattgctttcattccccagctttcactggtgatgaacttcaacttcttgtatataatctttttgatgctgcagttcatgtgatgtactgatttccttctggtcattgaattactatcatattgtattgttttctttaacggggaacagaaagggataccctttctgaaatcatgctgctgttattgaaccctgtgttccttattacaggtaaaagacagcatgtcatgaggactttccaaggtcataaccccaacactatgaaagttcattctcgcaagtctcaaccttcaaaaaagaagcctcgcgagttctatgacactgttgaggtacacattattgatgatgacagtgatggtgatgcgaatatccacaaggattactcaatggaagacacatcaaagcaccttgtcatgtacaatcctgagatcacgtatgacaaacaaggggaagttgaagttactgagcctatagataactatacttcgctgaaccaaagatacatgaagccaagacacggatataacactgttttaccatctatcggtgcttacaccgtgcaatgtgctcactgcttcaaatggaggatcatcccaacaaaagagaaatatgaagagatacgtgagaatatttgtcaggatgtgtttgtatgtgaaagagctcgtgaatggaaccgtgttatatcttgcgttgatcctgaagatatatcacaggatggaagtagggtgtgggcgattgacaaggcaagcatttcccagactcctcctggctgggatagagaggtcagaatcagaggagagggttgcagcaagtttgcagatgtgtatgtcactgtttcctttcctggatttgcagtagtacgtgatatttggtaccatatttttggccgtttccatattcggatatcaaacttctttctttatgtgcctaatagcatcttcatgttaatcgtggcacactggtcctgtttatttatgccttgactagctgctaactgctaagattagttaacactttctaaataattagtgcgatctcaagtttattcatactagtaccacctatgatcatgaaacttctacagttttcagttaatactttgtaacaccatagcaaatatctcactaattccttatgatatgcctgcttgaataatgcaaacagccattattatgtttgccagtttcctcaggaactttttcattatatgatatttcgaacagcaacattgcttgtaggacacacaagatactcgaggttgacatatgtgaaatacttttcttttttccttcaggtactacacttctccaactgggaagaagttgaggtcattggtagaagttgggaggtgggattcatccatttgtgctctttttgttgcatattttgtgtggctagtgtattacttggggtacctagttctagttggtctggtacaacaaaacgaagctctggaaaagctctggaaagttcttgaaatatttcccaggaaatgatgtaattattatgtccatattctaggtacttggcagagaacccacactacattaggcaaggggttaacttaacccagttctctttcgccacccccaagcctctgcaagaagactatgtcaggaagcatacatatgcagcaactcctgaattaccagagcttcttgagactgcgcaaggtgtgttatcagtcctaggtttgttacatctattctacttttttttcatttttaacttcttgttccccacattgttggaaaggaggcgtgcttcaaacaaggtaagttgctgcgcaaatggcacagttggaggtatctttgcaatgcaagcatgtctagttattttcagtcaaatgagctgtgagaagtcatgtactcatgatgcccttgcattttgctactttacatcctttcttgatcttagcaccatctaaatatcatttagtgttgtgatattaactgaatatattttcccccagtttcatcccatagctatatcctgtcaaaactacctgttcttgggagcttttgctgatatatttgttattgagtatacattgttatttttcagtggatccactctgctgggcagcaccccctacacgcagcgaactgcttggtgagcttggtgcttcaacctcaagatctgttgatgtcagccagtctgaggtgtcataccctgtagacttgcaccagcccgaggagtctgcgccactacctccacgcacaaagaagaaaactatgaaacgagggcgagtgtcagcaacggggtctcaatcgactccacctggttcatccaaagatcagtctggaggatgcgtaagcgacgtcgagtttgtttcgctgtgaactctggatgcagtgcctttgtctctgtcagtctgccttttggttcgtctcattgtctatacctctcaagaaacataaacttcgacctatatgcccaatgttttgggtttgatcagatgcgctaagcatcgaattttggtaatctaactacgtcttaacatggccatgacataggctgtagcatccacataactaggtagccagcactagtctgatagacttggcagaatatgttagccagcattagtctgatagacttggcagaatattttccatggacagcctgctacatatgttgatatggtagttgtactggtattgtaacatggaagtctggagtagacagacagtgttatcagtgtaccagatgttttatgcttcgtttttctgtctcttgtctttggatgctttgtgttgatgctcgattaaccagtcagatacttaaggattcatattcaggaaatcctgacactgaaaatctgcttatccagaaaactgaaagaagagctacgcatgagtatgtgccaagaacattttgtatttgcaagggcctgtgaatggaaccatgttttatcatgtgattacccagaagaaaatgtcaaaagatgaaagcagtgaagttcctccgacaatgtcactaggcttacactgaaatgccatgtttgaaaatttagcatcatcaggtccaattaacccaaattctagaatcaggcaaatggttcactgaagacagcagagtgaacccaatggcgtgcctcagtcacaatcgatgccgggagaagctcctcaacaacaccatcaaccagattgtgtgcatatacatttgtgatggatttctctatcaaacctcgtggattgaaaggagccatcttcctcttctttccgtttccaagatcgatcgttctgctctcaccccacagccggtcagggcagaacgtgtacactttcctcccacctttctcctcccttaaacgggaggatctaccacggcagaggaaccagctgaacccatccagatcgccggcgtccaatggcgacggcgccattgctatatccagcttgaagaacttgaactcgcagaactgatcatcgtgacggcgacatgagactaggatgacctcctcttcttcctcttcctcgccaccgccttcgccagaggcggtgacgaggaagtgatcctcttgccagttccaccccggcgagggcaccggcgtcctccaggccgtctccgtcatgtcgaacacggagatcctcccacggtagtcggcgcagaccacctgcttcccgcgcaacgccgcgtccacgatgaatgtgaacgcggcgcggcgccgcccgtggcgagcttgctgcgggggggaggtgttcgtgttcttgtaggttgtccagtacacgtcgccggggcaggatggtgggataatcggaggccgtctcgacgcaggccaccaccagtggctccccatgggagttgatgtggaagacgaagaggccaccggcgacggagcggaacaccggcaggtccacccgccggccgttgccggcgtggacaggaagacggttcgcagtgttttctctcgccgggggctatggcggtagttctggaccatgagcagccacccgcggttctcgaacgccaatgtcgcggcgtccaggaagaaggcggccatgtcggttgctccacgggtctgcttggtggatggatcgaacaggaaacatttgttgctgttgcattccagagttaacaatgccaatggtagcttggattgcttggaacaagaagtggtacttgttggagaagcatctggctccatggtgaatcttaattggtactagctagttcctccagatctgagataagcaaagggcagaggttgatcatttggtacaatgaaaactctacttatattacatacagtgtaatactatatccaaatctgtgagatataagcaaagaacaaagattgataatttggtacaattagagtagtgcttatattatacaaatgtaatactacatggcacactatctagcatctaccatcctgtgcagccaagttgtagcatgctaatagatagagtccagaataatgtaatttaaccattggtttacataacttgcaatgcaatgctattatggtcacaaatagtgagtggtgaataggtttctttaacaatgggttcgaatcctactaatgcttcctaattccaaaatacttactattagctaccaaatcccacttatgttcagagcgaaagggcacgtagagtagcactccaaagtcctaagtgcaaatctccataggagtaaattttagattggattatttgaggggctaagttttcgatttaaaaatatcacatatatctggttggatatagataccgggtaaaaaacagacaaaagaatatcacgcgccctaactacatcaccaatcatgggggatcgaggccaagaggacaattaattaatctacacagcgcatgcagagcaaataatcgaccaccggatcaagagagagacctaaccctaatactcgcgcttggcacaagggatcgatcgagggaagttcacctcggagaagagaagcgaggcgaagcgaatgaggattccggcgggggcgcggcgccggcggcaaggcggagggagcgatgaggatcggaggagtcgctctcgctcgccgattcggtgatgcttcccgtggaagtagggatgcaaattgggaagaagaagaagaagagaccgaggcggactggtttcgtttgggccgggccgaaagtgacgcgaccatgtccgtattccaaagttttttaatggacctgacctgactggcttggattagaatttggaaacttttgtttgcctagtaccctatcctttcatattattagttgttttgattttttttattttaagtttgatcaagtttattagcagcatttaaaacaccaaattagtttcattaaatgtaataaggattatatttttaatacgactaaaaaaatattcgtatgttgcaacaggtaaatgctattttgatattataattgttatacggtttaggtaagctaaaattcactgtgttaattcgcttgaatatttttttaaggaaatcatgagctgcaattaggagtctgtatttcatctcaagttagcatgagtttttttaaagagatttcttatacgactccttttatatttctaactcaaacacggatttgtatttccaaaagcgaatgaacttaaaaaccgactcaaacacgaataacgtaccaaaataccggcaaaaatatcttcaatttttataatagtagagatagagatttattttatgttgaaaatgctgctatgtttatctataagtttgaccaaacttaaataagtttgattaaaaaataattaaaatgacttgtaatatgaaacggagggagtgctagacatgggggtgacaaatttgcctctaatatgtattggactacgaattcagccaaacacggattttttttttgaatcaagtcagatatgaatggcttggatttctttttgtctgttatttgaataaggatagcgtatgcggacatattttggatgtattcacaatatagatcaactaacaaaaacatcagacattctaaagaaaaggtcttcatgtacttctactgttactccatcaatgcataaaacttcaaaattaaattcatttcattttagcggtaataaaaaaggaaaaatcagaaattgcaaaatcttctattgcctgctgctctttgtgtaatgaatccaaacttgaaattttttacttaaatggaggatgagtacatgtagattttttttttaaaaaaaaactgtgatattgtttagctactgtgtaccaatggacaataatcttgtgtgcacaagatatattcccaaagaatagataaaatatgcatgtggcagccagctaacatgggtttgaattaccagcaattcttacccaactgataaatccattttggatggcatcaagatgaattgtcatagttactctgataagtcggaggacatatccggtgaaaagagctaagtgttgaaaactcatgaaaatcatacctaaaagtttcgtaaattcatgaaaaaaatactagagagaggtgcagatataaaatacattctcaccaaatctcaactccaaactcaacttcgtttaagaggaaaaaaatttcagatgaatagtgtcatgttactattcacctgaaatttgtctttttttttactcctaaataaagttgagtttgaacttgatatttagtgagaatatatttcatatctacactatctctagtatttttttttatgaatttataaaacttttaggtatgattttcacgactttccaacacttaagctcattttcaccggatatgtccctaataagtcggggcatttgcaattggaaagagggaaagaaacaatatgaagagaggaccccagcagttgagtgaaatccgacaggccatcccaaaatcttagttaattttctcaagataattatatttataagagaatatccctaaaatatacgctatactactcagtcatggttgagctagattaccaaggtcgaccttaatcaagctcgaacgaagcctactcaaaagctcgggggtgaaatagactcgtgtcgagtttcaacaaacgagctcgctcaagctcggctcgttaacgtccctaaattcagccatattttaaggtttgacatttaaaggttcacactaacattctagtaagagagaggattagagccgaatgggcctaaatgaaccgagcaagccagcaaagactttaggaataagttcactttgactcccttaaaagtgacccaaatctaatccgtgaccctcaaccacaaaactagatatctttgaccccctaaattgttaaaaccggtgcaagttgactccctgggtggttttggagagtggtttcactgacgtggcgattatgtggtggtgttgacttcgtcttcttccaacgtggtgttgactagcacttatatggcattagaattaaaaaaatatatgcgggacccatttttcattcaccaaaataaatattatgggccccactaacatgtggaccccacatgttagtctctctttgaccccttcttcctccctctctccccctctctcctcgggagggacgcgccgtcgcagccgtgggcggtgaaggcagctgcagactcaacgctggcactcacggtgagggggcagttgaggcggagccgcaccatcctgctgcggcaccagtgggatgacgacagggagcggcgctgatgaggctgccgacggcaagcttcgtggctagtgagttgggaggaggaaggagagcctagagcagggggcggcatcctcctcgctcgtcgctccgccccacttcggtcgatgggagaggagtcggaggcgacgacttcggcggagaggtcgtcagcgacgctgacgtagccttaggagcagcaggtgcactagcctacccctagtcaccgtcgtccccatcacagccggcctcgccgccctagagctccctcaccaagcttcatcgcgctgccgcctctgtctctctctctctctttctctctctctctcaccacccctccatctcttccccccgatccccaatcctgcggcggcggcggatacccctacctgccggcgcgctgagaggggagctacacgaggtggtgttggaggaggaggagaaggaggagagctccaccgccttcgtcgagtcccgttttgtcctgccgacgaagctgggtccgagcctcggcgtgcccgtcgcctccttgggattctctgtcagcacgggcgacgtcgactccgacaatggagagaaccggagcagcagcagcagcagccagcaggccctccaccgccgcgagcgctccgtgccgccatgactcctcacccttcgtcgcggcgacaggcggtgatgcggtccaaggggagagaaagagtcagagagagaagtgagagagtgagaaggaaggagtgaggataggatgacaagtgggtcccatgtgttagtgggcccacattttctttgtgtgtgtgtggatgacaaatggacccacattatgtttttaactctaatgccacctaagcgccacatcaacgccacagacaagtcaacactgccacgtagacgccacgtgtcacaccccgaagttttcctcccaagtcaaaattgtaatttataattgaccctaagaaaatgctggtgaaatcaggagaaaaccctaagaaagtaatgcaaataataatcggatttgacatgtggaatttttcttgagttctacatgtcgaaattcattaacaggatttttagtggaattttcagagctctagaaataattttaaccaattaaaaatcactaaagtgcaattgttaattccagggaaaatcctttttccttttctttttctttttcctctcttttccctcctttttgtcaagtgggccgtcggcccacttctcccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgcattccccgcgcccgttcccctccctctcccgctcgcgcccgcgcccgagatggccgggattcgaaaaccgaatcccgcctctctctcctccccactcccccacgtcggccgtcgaatcccgccgctcccggccacgtccggttcccccatcccctatttaagcatcaccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgcggccgaggtccacctcgtccacccctcctccgtcgaggttcgtcgccggagccctcatctccacgcgcacgggtgagcgccacctctaccgccgccttcggccatagatcccgatcgccatggtccatctctctctctctaatctctatcttctccttccttagggcacgccgaagctcgtccgctagccgacgccgtcctcccgtggcttgccgtcgccgtccgccatcgccttcctccgcgccggccaccctcggtgaggcatcccctcccttcttttccccttcctctcctctagccgccgctctccgccgccgtcggtcgtcgctttgcgccgctgccgcatgtgcgccgccgccgtgtgagcgccgcgccgccggcgccatggtcgccgccgtctcgcgccgcgcccgcgcgccccggccgcgaggtcccgcgccgccgtccgatctacccttgggtagatcggggccgtcggtccggtcgccacgtggcgccgccgcccaaccttttcccgtgccgctgaccggtgggccgcgcgccgccaccctctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcatatctaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccggttctttcgacgctccggtgtacttcgaaatagtcgccgaggtacctccagcagcagagcaaggcaagtcatgcttgtcacttgaacatgttgatcctatattgcaaatgctccattgttttctttcaaatattgcattgttttataatatcactatgggatggatacctactgctacagccatgcttttggatatcatgctcctttgttagcttgggttataacatgattagactttggactaggacttgcttagccatgcttagttcaactagcacacattggggatctcatttaaaacctagactataggtttatatgataatgttggtttaataccaccgctctggtgttggttaaataaaatgaaccacatggtgggctgtgggtgcacggttttgctagtcgcacccatggcagttaaggaccggttcgcaggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttctccgaggagtaggcttcgtccgtgccgtcgaggatgcctgtggagtggtgttcccgctgccgttcaagtcaaggcttagctccagtttcttttgtttttccgctgcatttctgtcagacctttataatgtttgtaagacgtggatctgtatgtcaacattgtcgtttgtgtaccccggctggtcctggacgggggttttaatacacattctgcttggaattctattcgggaatttctgggcgtgacaccacgtcagcgaaaccgccctccaaaaccatcgagggagtcaaattgtaccagttttaatagttgaggggtcgagatatccggtattgcgattgaaggatgcaaattagattcggtcactagttaagggagtcaaagtgatcttattccaaaactttaataagtacaacttttaagaggggagtttgcttcaattaggctttaggctctaaccaattaggcccggcccatgaaacatcagttcgaaagggcgcgccaaatctggcgctgaccgtgctgcactgccctgcactcctgaaaggcaaagcttaatttggacggttcgtgtaaacctgaactgaacagctctagaactgctatactttgtgagaaatatgattgcacttatagaaataaatgtaagagctttactacaagaaaatactccatccaattctattactagaatacaaccggtataaaacgtaacataaaagagaaatattattaagtagtaaagtaaaccattttcaataatttaggaggtaaaatgagcttaacaatagtttaggatatcaaatcatctaactaattagttttggggagtaaaattgacgtttttctatatgaaatacacacactctctcttttatattataatttataaatcgttttgatttttttctagtccaacttcttaaagtctgactaaatttatagaaaagatttagcaacatctacaacactgaattagttttattaaaactaatatttaatagagtttgataatatgtttgttttgggttagaaatgttgtaatgtttttctatatacttagtcaaacttaaaaatgtttgatcaaagaaaaaaaattcaaaatgacttaaagtatgaagtacaatattacaatttatttacactttttaaaccaaaagattacaagtgtcaagggaaatcggctacagagatcgtctcagtgatttcagtcagcagtactcccccaatctatttttgatggacatatttccaaatctaaaaaaattatttttgataagcatatttcaatccaacaatctatactcttaatgattttttcggatttaatgcgtgactctccattcttccacacaatattagctacatggacatcgagaaatgtaaatattaatgtcacttgtttacgagtagcacatttaaatagatgataattagaattacttattcttgatatgtgtgtaaagataaaatataactattaaaagtatatggagggagtagtacatcagcagagactaacacggtcaactgatcaaggcggtacaggcacacgtataaacgtctttctgacacggtggggtcggggtggggcccacgggtcagtgactcctggggttttcaaagtttcgcgaagccctctcggttccctctctttttatcctcttcgccgttgcgagctcgcccccctcctccgcctctcctcgccgccgcgttccacctctctctctctctctctctctctctctctcggagtcgagggttagggtttcagccatctgcggcgtctccggcgagcgagcgcgagggaggccggagcagaagccggccggggcgcgcgtcctggtcctccccgaggacgcggcggtttcgatcccctctctctcggggttgtccgcttcgccgtcgggagagaatccggccggagcgcgagcgtgaggtgcgcctcctccgccggcccgaggaagcatgctctcgatccctcgggttgttggaggaagcgcgcggcggcggcgctttcgatccatcgggttctcgatctcctttcgcagccgggcgggcgcggtgaatctgcgggtgagttgccttctttgcccccaactaatggagatgaaactctttcgcgatcaaattcctcttctttttcctggttcttgcgcgattgtgcgttcttgacaccttcttcttggatggatttttttgctcatgcgtatgcgttgcagggacggggaacgaacgagatcctacttccttgtagtgcgatggcgacggaaaattcttcccctgcttttacggacttcttgccccgtgcgctcagcccgattccgtttggtcggcgccattcgtgtgcgcgacatgtacgtgttctaattcacctcatcctctgcttctagttcttcccccaattgacggtttacctctgaatcttgtgattaggcatcatattttttttccgcccgatcaactgttagaaactattggattcctgactcctgaggtttattcctctagttactgatcaaataaatcgcactagtggttctttgatccatataatgccgtattttaacgaatttgtgtcattttgtcccaatacaaaagttagctctcatgtttaatggacttcgtccttctcaaaaaaatgtttaacgaacttcgtgcgtacttatcttttgtgttcttttcgttctgatgtatatgctgtatacttcagttgataaagtaagtcactatacaggaagtcaggaacatccttgtgtcaatgtagtttggatggctgtgttcttatcattttcaattatttacattaaatggttgctcagtaagatatttcaagcttggaatttaagtgcaattgtgatcccggccattattcacaaaggaaatcccgcatttagattgcagcctttctgtttcattatggatgcttgtcttacatgatttcttcatgttattggtcatgtactcatgtcgtctttcacatttagtcatgcattctttcacacaagagcagatgctttctctcaaactggaaaatgattcctagtgtcaatattgttctagttgaaaatttactcctcaacaaaactagggagcaggttcaaatataatggtgtgtccatactggattgatttacacagtagtgaatattcacatgaagtacaacaacatgatcaacatcatttgagtaaaagaatggcaaatattccctttccatttggcacttactagttatcacatggcatgcagtttaaatcatttttaccttccggttatgtacattaggctaatttgcatctttatggagaaattatttgcacacagttgatcttagttgttaacaaaactggttctgatatttctctcttttttatttgaatgatttatattctatgtgaattgggaggtatattctttcaaatgtctttgcttctttactgttatgcgcatatttggcactttctaaactctggtgtcatgtttaacggttggattcctggatgcaacagggggacataatgatgaatattgatcaagctgaggattcatgcagtaacattagtggtgcttcgagatcttctcagtctcatactgatcaaactgaggattcaaaaggttagtctacgcaatgtaaatcaccaatgctttagttgtatgccttgcagcacatactgatgcactctattaggattagagatggaaggactgaaaatatgttattatgctaattgtgctatgcttctgataggtatagcttcgtttggtcaagttcttagtttcttcatgttggtcttccgtatttatgtttaatgcatattgtcatccatgtttttgaagggccccctccttttcggagttcttgctatggttattccatgagttacattcagtgctctcacatataaattactgcatactgtgtatatattcaggaaatgaactatgtactcgtgtcaaggctgttacggatgtatcatgtggtagtgaattacaagatacttgtgaagaagaaggcatcatattatggccaggtctcaagatgagctttcctcaagcccctctagtcaggatccaggacaatgaacttgattacgcgtacgtcgatgtttctgaaacttctattggcaattcatttttcattacacagttcaaccttcctttgtcacttcctgtttatgttgtcctctgtctatcatttcctgtgtatgctgtttagcatagatatgtcatgtactcaccttaagtattatatttgttgcaaaatttcaggccctctcgaaatgcatgcaaacaactggcagctaatcctgaggcccctctgtttcgcctgcctcctttaggatcctatgaaaaagaaatgtgcggacctgtattgcttatatgcaacgtccattctcctggaatgagttgtttctctccatataccaagagcaccttctacagggagaatatggagattgatattgacgatgtgttgtactccaatggtagctggttcttactaagggaggcaaatataatcagcctttggaatgttaacacagagaagcgatggtttgttggcgaagctgaggagattattcatcagggatattttatcgggaacccaccattcgatgtgacaatagctcttgcgcgacaacatcccccaaagctcggagaagaagctataactgcaatctggctcagatcggttaagattggtggctggagcaaagggtcggtgaggtgtgattatgagcacagcgggttgaatagcctcaccattcatcagggcatgcttttttggttaactgacagcggttcgttgtgttgtgcgaggcaaacatctgagggcttagaacttatgatttggaacggctcagtgagaatatatgggatgaacttttcactggtaaagcattttgatgacctatacattgtgaacggtggcggttttttcccaaatgaagtagctaaatcataccaaatcgtcgttggagatgagcttcttgttgatgaaaagaggttgaaggggaaagacgtatttacagtctcaagacaaggaggttttgtactcccatcatccgaagcggataatggcaagttattcactggaaacatgataccggatgtcgactgctctatgtaagtataacaccgcctgattacttgatgcaaaatattttgattggataaaatatacttataacatttgaatgcttatatttctctgcaggtacagctggaaaaacaatcaaaatgaaattataaagccctgccactttcttcgccacgctacctgtagcagtgtttgggctatgctgcgtaccaagaggcgaacctagcaaaactccagtaactaccttgtgagtatcttctagttgtatttgttgaccttgcttcaatcgcagccataggaactacccaagagttagtaattatattgagactgcacatactgtactagtgtactttaattttcttaattagttaattatcagaaagctaaactggactacagatgttgattcatgtccataatcataaaatgcttctctattctcattgagttgataaatttttttgatgcatttccatatgaggaagtccggatacctttgaaactaattactatatactgtctgatatcgttctcaataaaattctgacactgaattcctttgatcaatacaggtagaggcaactcttgccagcctgttcaataaacctgggccatgttctttgcgctttatccactgccagtgcctgtcggctgtcgcaatactgcatgaatcaactgtgagataacatttggaataagctgtttttcctgttgggctaccacttatcatgattggatgaatatgtgctcttctagtcccgtacatatatgtcctatactggatgatctgtgcttcattctataggttgatacactgtgatcttctgcaaaacatgcagagcaatgtaactctcacatactggatgatgtatactgctcgttttctttagagaatatatttgaacaaagtaaaacggttgccagttggatgttcaattttattctgcctcctgacaacataattctttgtcagtgaaccagttgccacagttttccccaaactcggatactttctcgtgataatttttaacatctctcttcctttccaaactttttgaagtatatgcatggaaaccttttgatgatgagagtgtaaaggcatttatgtgatttttgggaggtacaaatgtagatttgaatattgatggtggttggctatgatttttgtgttcacttgaaaagtgtgaacttcaagttgagagtatagtttttgagctgaaagtcgggggaaattcaagatgtaagctcccccattttgttgacagattggaaaatttgctgttcaaggttgagagtaagatatcaaatctctagttgaaagaggatatatttgcctcaaaagacattgacccacagttataacttgtaattgaaattatatgtagccatgtaggcagaggatttgggatggtgatgaagaaacaaagacaacagtaattacccatgctcaaataatgagtttacaaaatagcaataggaacaaaaaccataaagattcaccactgatcattctgtaaccagtacaattacaaagctgcttacatgtatatacatggtatgcctccataagatgtcaaaagaaatgataatgtttcctacagagaattgcacaaattcaagacctataagaacaaaaagtaaaagtagaatcaaattcaagcccacatgtccaatatgtggcactatttagctcaagtagcgaatgtactagggagaatccaacggtgcacttctgtaacgattgatgctggtatcactgtctcaacagtctcatcaactaaatcatatgcataaatatttgtgatggacttcagtgttgaaggacctaatgaaccagtgaaggtggccacctcagttccattcacgattgagccggcacatttatttggaccaaataagtagactctcctcttcccttcctccttcacatggtacgattggcccttacaaaggaaccagctggtattatccaactccctgtcatccagcagtgaccactccattgcttgtagatccagcttaaagaacttgaaagcactccctgttttacaaggatgcaatatggccacgacttgctcattggacgcaacaagaaaatgagaatcttgtttactccaatcaggacaagatgacactgttctccaaatcatatcagtgatgctgaaggacaagatttgcccatgaaaatcgacgcacacagcctgtttccccagcaacaccacatcaacgatcaaagcactctggaccttgtacattgcttctgacatttctggatcactaatatgcttatagatgctccagtacacatctccaggacaggcaatatgggcagttggaacagcactcatgatctcaatgaatgcaaccactagaggcattccatgagaaccaacatagaaaacaaagaacccctcattaggagaacgaagtaccggtaggtccaagtgcgtgccggtgctaggatgaacaaggaacacgatctgatcttggaaggacaacggcttgtgctgcgccattaggagccacccaccattctcaaattcacagaaagcatctggaaacaccgtactggttaccccatggatctttcggcttgaaacatcaaacagcagtcgcttcttgctgttcaattccacagcgaaaagggccaagggtaccatcaactctttggaacagttattcttctctgtaccatttgtttccatggctcaacctggcacaaaaacacctgcaaagaagcaaagtgtatggattagaagaccagctcattgttcataagatatggcagtaaacccctatatattcaagtctgatggattaggaacatgtacttttttttctttttctttttccagataccaaactagcagaagtgtctcacccccatctagtgccaagcgtgccatctgaaacctgaacagaaccgctcatactactagatttcttcctagtgtgactttgggtgtctctagtttgtgacttttgagtgctcgatggcacactgcttccactacgtgcttgcatccaagaacctaaacatcacnaagcgcnggncgcagggcggggtgtggcggtggactggtggttcaccctgaacaccccgcccgtgatcatggttgattcgactgtttgttcaccacgcacacgcagcaaaaataaaaaaataaaataaaatggagcca

SEQ ID NO: 77971 - DNA, 10851 bp, Oryza sativa
aagattgcaagctggaggacaaggtggatcgtttggagaaggaattagccgcattgaagggagaagcaccaccgcagaaggccagggttcgtcttaccgcaaggaagagagctctttttgtccctcgctaccagttggcacctaaggttcgtgtggtggaagaagaagaagctaccccagccccagtgaatcttcccgtcattaatataagtgatgatgaaggagaagagtcaaagcgcacccattcgaaggttgagtggggagctacccaagatgatgagatcgagccttcaatcaactccgatgcccggaagacctagaacgccttgttaagtctttgccttagatcgttgtgttagtttgcttgtttaagtttggttgtgtgtgtgggtctcgcttgtagtttacatcattggtgggatataaatgcatgcgtttgtttgctttcgagtgttaggaagcttgtgagttagtggtgtaagagctttcagttataatgtaataatgaaactcagttaagatcaataaaagttaagttagtaaaaaattaattccctgtcctaagtagttttccgctgtttctcttcttgtgctcctgtctatgctagatggtgcttactcgcagcaatgggaatggtcccaacaacaacaacaacaacaacaacaacaacaatggagagaatcccacgcttgcccaagtcctggctcaacaggcacagctcatgaatatgatgatgcaccaactacagaaccagcagaaccagggaaacaatcatgcacctccccagaacaagttagcataatttcttcgtgtgaggccgcctactttttctagcactaccaatccagtcgaggctggtgattggctgcatgccatagaaaagaagttggacctgcttcagtgcacagatcaggaaaaagtctccttcgcttcgcatcagcttcatggccctgcctctgagtggtgggatcatttccgtctcaacagaactactgccgaaccaatcacttggcttgagttcactgctgctttccggaaaactcacataccctcgggagtggtgtctcttaagaagaaggagtttagggcgctcactcagggatctcgctctgtcaccgaatatctgcatgaatttaatcgtctggctcgctatgctccgaaagatgtgtgcactgatgatgggcgtcaagagaagttcctggaaggactgaatgatgagttttcttacccattaatgactggggattatcatgatttccagaagttggtggataaggctatacgccaggaggacaagtacaaccatatggagcagaagaaacgtaggattgctcacttcaaagctctacaggggaatagtcagaggccgcgtcttgctatgggacctcaggcagtgttgcagggagggtcttcgtctgttgttcgtccgcaacgtcagttcttcaacaacaatgctggcaacaacaaccgcaaccaagctccacgtcccgttgcaactccagtccagcatcagcctgccaagagggagcaaggcagcaagcctggggtgtgcttcaactgtggtgaacaaggacattactccgataagtgtccgaagccccgccgcgtgaaggttgtccctgcctagagcaactccaccgcaccagcgacaaaggctcgtgtcaaccatgttgctgctgtagaagcccaaggtgctctagatgtgattttgggtacgttccctgttaactcaattcctgcaacagtacttttcgattctggtgctacgcattcttttttgtctatgagttttgcgggaaatcatgggatgcaggtagaagatcttagacgtcctttgatggttagtactccgagtaagcaagcactcacatcacaacgtagcccctctgtcagaatagagattcaaggagtaccatttctagccaaccttattctgttagaatccaaagatcttgatgtcatcctagggatggactggttagccagatataaaggtgtgatagactgcgccaatagaaaagtaactctcaccagcaatgatggtcaagttgtaactgttcatgcattgccttctgagcctttatggtcaagtctgaaccaaataactttggaagagattcccatagtacgggagtacccggacgtgttcctggatgatttacctggtatgccgcctaaaagagatatagaattcagaatagatctggtaccaggaacaaccaatccataagagaccttatagaatggcagccaatgaattagcagaggacaagaggcaagtagatgatttgcttcagaaaggatacatcagaccaagttcgtctccatggagagctccagtcatctttgtggaaaagaaagatcatacccagaggatgtgtgtggactatcgtgcactaaatgatgtgactatcaagaataagtacccattgcccagaattgatgatttgtttgatcagcttaaaggtgccaccgttttctccaagatcgatcttcgatcaggttatcaccagttgaggatcaaagaggaacatatacctaagacggtttttaccactcggtatgggttgtttgaatgtacagttatgtcttttggacttaccaatgccctcgctttcttcatgaacttgatgaataaggtgtttatagaatacctagacaagttcgtggtagtctttattaatgacattcttatctactcccgaaccaaagaagagcatgaagaatatcttcgccatgcactagagaagctacgagaacatcaactgtatgccaagtttagcaagtgtgaattttggttgtctgaaataaattccttggtcacatcatctcagccggaggagttgccgttgatcctagtaatgtggaatccgtaacgaactggaaacaaccgaagacagtttcagagattcgtagtttcatgggtctcgcaggttattactggaggtttatagagaatttctccaagattgctaagcccatgacacgactgcttcagaaaaatgtgaagtacaagaggtcagaagaatgtgagcagagctttcaagagttgaaaagtcgcttaatatcagcacccattttgattttgcctgatccaaagaagggtttccaagtgtactgcgacgcatctaagcttgggttaggttgtgttctgatgcaagatgggaaggtggttgcctatgcaggttgcctatgcatctcgtcagttacgtccgcatgagaagaactaccctactcttgatcttgagttagccgcagtggttcatgcgttgaagatttggcgtcactatctctttggtactcgtacggaggtgtacacggatcacaagagtttgaagtatatctttacccagccggatctaaacatgaggcagcggagatggttggaattgattaaggattatgacatgggaattcattaccaccccggaaaggccaatgttgtagcagatgctctcagcaggaaaggttattgcaatgctacggaaggacgacagttgccgttggagttatgcaaggaatttgaaaggctgaatttgggaattgtcagtagaggtttcgttgcagctttagaagcaacgcctactctcattgatcaagttagagaagctcaagtcaatgatcctgatattcaagagatcaagaagaatataagaagaggaaaagctatcagtttcttggaagatgagcaaggaactgtatggttgggcgagagaatctatgtcccagagaacaaggagttgaaagatgtaattctgaaagaagctcatgacactttatactctattcaccctggtagtaccaagatgtaccaagatctcaaggagaaattttggtgggcaagtatgaagcatgagatagcagagtatgtagctgtgtgtgatgtttgtcagcgagtcaaggcagaacatcagaaacctacaggtctgctgcaacctttaaaattaccagaatggaagtgggaggaaataggaatggatttcatcactggtctacccagaacgtcatcgggccatgactctattttagtgatagtcgacaggcttaccaaagtggctcatttcatcccagtgtggacaacatattccggaagccgtttggcggaattgtatatggcaaggattgtgtgtttgcatggcgttcctaagaaaatagtatccgatcgaggtaaccagtttacttcaaagttttggaagaagcttcaggaagagatgggttccaagctgaacttcagtaccgcttatcatccgcagacagacggacaaaccgaaagggtaaatcagattttggaagacatgttgagagcttatgctttagacttcggtggaagttgggataagaatctgccttacgcagaattctcgtacaacaacagttatcaagccagtcttcaaatggctccttatgaagcgttgtatggtcggaagtgccgcactccgctattctgggatcagacgggtgaacgtcaggttttcaggactgatattctgagggaagtagaagagaaagtaaagatcattcaaaaaagattgcgtatagctcagtctcgtcataagagctatgctgataatcgccgtagggatctgagttttgaggaaggagatcatgtgtaccttcgtgtcacgcctcttcgaggggttcatcgttttcacaccaaaggaaaattggcaccgtgttttgcgggaccttacatgattgtcagtagaagaggagaggttgcttatcagttggagttacctcaatcattggcaggtgtttataatgtgttccatgtgtcacaattgaaaaagtgtttaagggtacccactgaagaagctaatcttgagcaaatagaaatccaaaaggatctgacatatgttgagaaaccaatccgtatcctggagacagatgagataaggaccaagaatcgggttattcgtttctgcaaggtccaatggagtaatcacacagaggaagaagctacctgggagcgagaagatgaattaaagtcagctcatccgcatcttttcgacagttcttccgaatctcgaggacgagattctgtttaaggggggtaggtgtgtcacaccctaaaaatcccaaaaatataaattgttgtttaattggaattattagaaataattttaaaagcctagaagcaaagatctaattttaaataataaattccaatataaaagtggcccagataaattttaattaaatacacctcttgattctatagttcctagatttttctgagatttattttagccaaggaagtatttttaataaatggaattgcatttcatgaataatttaaattgaaaaaggtttttaaattccaccttttggctttgggccgaaagtcggcccaaaaccgccctttctctctccccggcccaactcagcccgcagccgagccgccgctcgcgcgcgctccctcccgctgacaggtggggcccacctgtcggggtcgtcgtcttcctcccaccgcacggccgcaccctagccgccgccgccgcccttccaattcagccgcgcctttccatctccggtcgaattgattgaggggaaacgatcttctcgatctcctctatcttttctcttttggaagcatcgtctattctcctttggaaatcaccgaattcgatcttgaatcggattcgtttttcccctccgaaccctaatctttccttcccgtcgccggccgccgtgggccttcgtcgccgccctctagcccctatttaaggacccccgggacctcctctctctgccgccaccctcgccttagcccgccgccgtctgtagcgctgcctccgcgtgagctcttgcgccgccgtttgtcctgccgtgcaccgccgtcgctccggtcgtcgtcatcgctcgggaaggccgccgtcgtgatcgccaagccgtcgccgttctcgtccacctctccgtttctgctgaggatcgccggagcaccgccgtcgtcgtcgagccgattatcgccgccacttcatcctcgtcgccgtcgtcgtccggttgccgtccgccgccgttcatgcctcggtaagattcgtcgcgtcgcccgcaacccgtaggtgccctccgtttgcgctgccgcgccgtcgttcgccagcgagcgtgtgaggttgagccgccgccagtggtgacgtcacagctgacgtcatcgacgccgtttcccgtggaccgcgatggattagatcgatctcggccgttcgttttgaatcgattagatctcggccgttcgttttcgtagaccgtcgccgtgcacccggtccaccgtgaacccgcgccgctgacgcaataatccctttttccttttcaaaaataattcattattacgtcataattcaattaaaatctatataaatgatttaatccgatttaatctttaaaaattcataactaattcatcttagctcggttttagttggttcaagtctctaattttttctaaaattgagatctacatgttaaaaatatccacatgtattgttcatgcttgtttatgtgctgttttggtgattttgctcttttctgcttagattccgacgttcccggagagtccgattttgcaagagaagactttgaagagttataaggctagcaaggcaagtcatacagatcccaaacaaccctttgagcatgttgatcccgtttaaagctattatttctattcaactattgcatttatttttgaatgtcactgggtgggaataacctattgcctttgtatagcccttttgatattgattatctattctttgtcacttggttaataattggattagctagaacattatatggttttagctaaagtgaataggatgcttagccatgtttagagacactagctcatataaagggaatacttatgattcactattatttaatgatggcttaattatagttcacgatggtcaatcgtgattggttaattaattaatgtgccaactaaaacttgataatggtgggttgtgagcgcatggttttgatggtcgtgctcatgacaattaaggaccggttcacgattttcggttgtgaaacattaaccgtgccaaccacaagccagcatgggcaacgactttactttctgtatagtatggttcataggagagcaccagactgtgaagtggcggagataagcccacaggggtcgctggggagtccatgccttgtttacaagggggtgattatgatccgggagcagtgcactactttgaattgtgttatgcagagggtattgtcacaatctctattcgggtacttgttaagtatcgcgacgcatggttgacatgatgttgaggttgtgtcttgtgggtacagtggtacacctctggccagagtaaaactatttgaatagccgtgcccgcggttatgggcgggtctaacaatgtctttcattgtctttcgtaattagtttcacacttctcatcataaaaaaaatgatgctgtacttgttaataacttgtttagctcctggtctggaatggtatattcctggtttggagatagaactgtacagccgggattggttgttcagaatggttgggcctatgcaacacgggtgtgttgtatagtgtcgatttaatattgcttaattactcaactgttttactattctctcaaatgtttattaaatgatgtttatgcaaatgagcctatgttatgccatcctttgttatccattgcacttgcatatttgctgcgtgacttgctgagtatgtcatatactcaccttgcaatcattcatcggaggaggagttctacagtgatgctgaaggtgtggatgattaggcgtagccctggtcaagctgcttgtgggatggagtcgtctgcgccgtttattttattttccgctgcttagatctttattggttgagaggaactatctacctctgtaatgacattatattcgcttattaattagagtaataattgtaatctattatcaatttgttattgtgtgcctcggctgatttctggacgagggtttacacacatgtaagcgtttggaattttggatagaaattctggcgtgacaataatgtaagattgcatccaactacaccaatgagaaaaatccgttccatcgaaaatatgaggcttagttgtaaacatagcgggagtagccatggcaaaaactctagatcaataaaaatccaaagaagaaaaaaaggctctgataccacttgtaggatcgaatagcaagaactaagccaaccagagggaggggtgaatgattggtatacccaaaaacaaaaaacttttattggaaaataaaagttaccctcgaattcgacggatcgcggtctgaccaaaggtattgcgccagtctgaccgcctgatgaacgtcggtctgaccgagatcgaacttcggtcgaaccgccgagattgcctgtcgccgactcctgtcaacgccggtctgactgccgtactcccaccggttggaccggcgcggtactgccggtctaaccgccggtatgtcactggttgaaccgccgaaactcggtgaaacacaaatcgtagaactcttaaagtggatgacgactttattacttctctctatgtttacgaagtgcgccaacagcactccttacaaaaatttcaactaaactcgaaaccctaactcaaaactcaactcaattgctctcaaaagcgataccgggaagtctcacgctccccctctatttatacccgaggtaggcagcctaaagccacgaaccaaactcatactaggagtcctaaacaccttagaaaaccctctagtacaagaaagaaactttacataatcaatcgtaccatatttggactccttccaaattcgactccgcatcccatacgcacacaataactccatggtatgccatatggaatctctatcaaccacgtgcatcaactctagccttagtatcccgcatgatctctgatcaccacggacatcgtcttatccccaagccgactcccggtccatcaccgcaaatactcttccgagacatcgagtcatctacacatgaacaaacaaagaaaccatattcagagaccaagctatctcaatcttgacttattagtaacaaacaacagtattacatacgtatagtatccatctagaagtcataatcatgaaataatcacggatatccaaataaacaacccgaagccgaaaccgacacagagtcggccggtcagaccgcgggctggatggtccgaccactcgatcaccgccagtctgaccggcaacacctgcccggtctgaccggtccacataaaatgataacctgtagattcacctatgaaatccaatcatccccaaaaccacttcgtgaataaattccaaataacaacaccaataatctccaatgcccaattgttcatcactgaataataatcaaaaacacctttgattttacatttctgaataccacaacctctagttttccgaacatacttccttctactcggattatgaaaatcaataattcccatagaatctagccaaatattgacaaacaaaaaaaaatcttaacttataatcttatatatcttattaactacttcctccgtattttaatgtatgacgccattgactttataatcaacatttgaccactcgtcttattcaaaatttttatgcaaatataaaaatacttatatcatgcttaaaaaatatttgatgataaatcaagttacaataaaataaattataattacataaattttttaaataagacgaaagatcaaacgtttgtcaaaaagttaacggcgtcgtattaaaatatagagttaacggcgtcatattaaaatatagagagcactacttaaaaaactgcaattttctaatcatcacacgtcgatttttgtctgtccacgtgacgattttcgtctgtaatcgattttcatccgtccacgtgattttcgtccacgcgacgattttcgtctgtaattgattttcatccgtccacgcgattttcgtccgtagtcggtgagaccgcgtatgcgtttccgtcttcttaagctgcggccaactcagtgtcatagccggataaaaaaacagaaaaatccaaaaatccaaaatctctctaggtagacttgctcaaacaccctagagttttaattcaaattcagaagatagcatcgcaaattgcattttggctcattcatttgcccaaaacaatcatagcatctatcagattcagatcggagcatatagacgaaaaaaaatccggtatcacaaccctcttcaacaccgatccggattctatcttataaaagaaagaaaaggaagagcgatgcgtccacggaccacgaatcatgtgcagcaagcccaccagttacagatcgatgctcaccacttcgagattgaaggagtggcgtggggaaggaggtcgtctccctgctgccaatgggccacagctaagcttgaggacgacttcaaggcgcgatggacgatgaggcgaggagccgacgccgccccatcctcctccctgctcctggacggcacgcgggcgccgagctcgctccacgccgtcgcacgaagccgcgcccgcagagaacggccgctctcgccgcctcagctccccaagcgcgccggcacaccctccctctaccccgggcgccctcctgcctgctcctcgctgcaccgccaccggcgctctcctcctcctactcggaggcagatgagagaaagagagaagaaaagatcgagataatgaagggaaagagagagaaaaaagaaaagaaagagaacgtgtgggtagaggtgggcaaaataagaccgaaccgaagaaccgaaccgaaaaaaccgagatcgaaaagaccgagaccgagaaattcggttagtagttcggtcccaactattaaaagac

SEQ ID NO: 77972 - DNA, 20251 bp, Oryza sativa
atcctgatgaagatggtgaagctgttgatcaaaaggaatatagaagtatgattggatcttttttgtatctaactgcttctaggccagacatacactttgctgtgtgtttgtgcgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgaatttggtggttgtagaattaataggaaaagtactagtggaacatgtcattttcttggtacatcattgattgcatggtcttctaagaaacaatctaatattgctccatcaactgctgaatctgaatatgttgctgctgctagctgttgttcacagattctttggcttttatctactttgaaagattatggtcttacttttgagaaagtacctctcttttgtgataatactagtgctatcaatattgctaagaatcctattcaacactcacgcaccaagcacattgatattcgttttcactttttgagggatcatgttgagaaaggagatgttgagttgcagtttttggacacaaagttgcaaattgctgatattttcactaaacctttggattctaatcgctttgcttttcttcgtggtgaattgggcgtcattcatccttttggcatggtttgaggggtagtttgtacctcatggttttatcaagcaaaaatatgataatgaaaaaattgagaaaagagagctttgtttatgcatatggtattttcttgtgcatgctagcaatactttgaaggtttatttgtctctagcatagcttgtatgtattctagtcttttcatgagatttagattttgcttttaagggagatgatgcattacacttaaattctatacttgaattaagaaaatatgcaatgttgatgctagcatatggtttgatttataaatgctctatatatatgctctattgacttgttattcctcaaatacctttaattgctcattgtgaaaaagagaataaaaaatataaaaaaaataaataccgaatccttggaaacagtcttgacgacaagaacgtattcgatgtgagcaaaataatgggtgccgaatccctggaaacagtcttgacgacagggacgtacccggaataagaaagagaaaaatatgagaacaaaggctcaagaaaagaaaaagttaaaaaaatttctctttgttagttttgtgcagaatgcttatttgagaaagagtgataaatgcaataggtatatgtgtttagtgtttattctttaacctatgtgcttgttaagatgttgcattataaatccaatgaaatcatgaattttgattgttgattcaagcttaattgtaaaatctttggttcatgactatactttaatgcatgtttgttatgttatagatgggttcatcttctttttattgcaacacatgacttgatatgctatatgtatgctaagctcttgaacattaatgaatataattcttatgcttgatgaaaatttttggatattttggagaagcaagatgaatttttgaagagttgttgagaagagcatgtttttggttcaattgagaatttctttcttttaaaaagggggagaagttttcttttagatttttgagaacgatgtgtacgtttgtacgaagtgtgctttttaccacttttgtttttaattttccaaacactaaaacatttttatggatttgccaatgtgttcatcaagggggagattgtaaaatcaaaggtgttttttattattattctgtgatgaacaattgggcattggagattattggttttgttatttggaatttattcacgaagtggttttggagatgattggatttcacaggtgaatctataggttatcattttatatggacaggtcagaccgggcaggtgttgccggtcagaccggcggtgatcgagtggtcggaccggccagcccgcggtctgaccgaccgactctgtgtcggtttcggtttcgggttgtttatttggatatccgtgattatttcatgattatgacttctagatggatactatacatatgtaatactgttgtttgctactaatgagtcaagttggagatagcttggtctcggaatatggtttctttgtttgtttcatgtgtaggtgactcgatgtctcgggagagtatttgcggtgatggaccgggagtcggcttggggataagacgacgtccgtggtagtcagagatcatgcgggatactaaggctagagttgatgcacgtggttgatggagattccatatggcatacgatggagttattgtgtgcgtatgggatgcggagtcgaatttggaaggagtccaaattcggacgattgattatgtaaagtttctttcttgtactagagggttttctaaggtgcttaggactcctagtatgagtttggtttgtcgctttaggctgcctacctcgggtataaatagagggggagcgtgaggcttcccagtatcgcttttgagagcaattgagttgagttttgagttagggtttcgagtttagtcgaaatttttggaaggagtgctgttggtgcactttgtaaagacagagagaagtaataaagtcgtcatccactttaagagttattctatttgtgtttcactaggtttcggcggttcaaccggcgacgtaccggcggttagaccggcggtatcgcggcggtccaaccggcgagagtacggctgttgtcacatcctgatttttgtttcaggatttataaattattttactaaattaataatataatttatattaaatgatctttaatttacaagtgaagtaaaatgtgggaaataaaatttcctaaatctaaagcatggatggatttaatttttattaaattctccatggttaattatactctctgaaattttctcggatttttcagagctcaattcctaaatgaaacaaagaacagttcagtaattatttgatcattaatgatctaactataattgttaagagcttttcttgtttaaaaatccttaaattataaattgttgtttaaaaggaattattagaaatgattttaaaagtctaaaagagaagatctaattttaatttgttaaatctcaatataaaattgggctagataaaattttgttaaatactttgcttaattctagaattcctagatttttctgggatttttttgagctaaggaagtatttttaataaatggaattgcatttaagaaataatttaaattgaaaaaggtttttaaaagtcttcttttggctttgggccgaaagccggcccaaaacccctctctttccctctctctctttccctcggcccagccggcccaatccgccgagccgccgctctcctctctctcgctgtcgctgacaggtggggcccgcttgtcagggtcgtcgtcctcctcgcgccgccgccgcccgcaaaccctagccgagagccgccgccgtctccttccaaattcggccatgtctttccttctccggccgaattggttgagggcaaatgatcttctcgatctcctcttccttttctcctttggaatcttcgcctaattcggtttggaaacttgtggattcgaggtcgaatcggattcctctctttcctccgaatcttcaacctttccttctcgtcgccggcagccgtgggcctccgccgccgccttccaacccctttataaggacccccgatgtctcctctacccgtcgcccccttcgccttcgcctctcgtcgttggaaaagccctagcaccgtgtaccctagctttgccgtcgccgccgccgctccagccgtgcgccgccgccgctccagccgtcgctgtcgctcgggaagaccgccgtcgggttcgcaaggtcgtcgccgtcctcgtccgccccttcgccgccgccgaagaccgccggagcgccgtcgccgtcgtcgacccgaaggtttccgccgcttcttcttcgtcgccggcgccgtcctttgctcctccgccgttgttttggtcaccggtgagttcgccgcgtcgcgctctacccgttggtgccctccgttcgcgtcgtcgagccgtcgttcgccggcgagcgtgcgccgcccgagccgtctgctccgccgagccgccgccgctgtcggtgacgtcattgctgacatcatcagggtcgtccgccgtgagccggtcgtggaccgttcgatctcggccgtccgttttggatagggttgatctcggccgtccgttcccgtgaactgttgccgtgcacccggtccaccgcaaaccctagccgctgacgcaataaaccttcttttccttttcaaaaataattcattattgcgtcataattcaattaaaatccatataaaggttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaattagattataatcttgtaaaatttataataaattcatttgaaatcggaatgaggccgttcaagtctcataattcatctaaatttatgatctacatgtttgtttactttttatgtactgtttatttggtttttattagtctttttcttcgttttgcgtgttagcttgtcgtttccgtcgttgcgaaggttcgcaagtgcgccggaagtattcaagaagattaattgaagaccgattattgcaaggcaagtcacacagatcctaaacacaatcctttgagcatgttgatcctatatttaaattctctatttatttcaactgtgcatttattttcaaatgtcactggatggtgtgaacctattcctttgttatggcctgtttgcattgattaccttattccttgataccttgggttattataacttgactagttgggctttatatattggttcagctagatattagatatgattgcttagccatgcttagaaacattagcacacaattgggataactaatgtttcactatcacttatggttatatttaatggtagctcaccatggtcaatcgtgattggttaattaattacttgccaactaaaacttgataatggtgggttgtgagcacatggttttgagagtcgtgctcatgacaattaaggaccggttcgcgagctactgttgtgaaaaattaaccgtgccaaccacaagccagcgtgggcaacggctttaccttttgtataacatgattcattgcggagcaccaggttgagaagtggcggagataagcccacgggggtcgctggggagtccataccttgttttataagggggtgattatgatccaggaatggtgcgctgcggtggattgtgttatgcaaggggtattgtcacagcccctttccgaggtaccgtggtggtactgaggcacatggtgacatgatgtggggccgtgtcttgtgggtacagtggtacacctctggccagagtaaaactattcgaatagccgtggccgcggttatgggcgagttgagcaatgtttttcgtgattagtcccacacctctcaccataactatggatgttacctggtaataatttgcttagctcctggtttggaatggataattcctggtttagagattagatctgtacagccgggtatggttgttcaggatggtcgggcctgtgcagcatgggtgtgctgttcagtgttgattaaaatttctgattaactactctactgttttatttctcttaaatattttgctaaacgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccggaaggagaagacgtttggcttataccccagttgagctgcctgtgggagtggagccggagcttcgctaggttttattttccgctgcagttttcttcatggtgaggactaagtgcctcttaagtaagtatatatttgtttagttaatttgatgaatctgtatattaaattgtcagtttgtgtacctcggctgatttcctggacgaggattttatgcacaaataagttcggaaattactagtgaatttccgggcgtgacagctgtcagaccggcggcgacaggagtcggcgacaggcgatctcggcggttcgaccggagttcgatctcggtcagaccgaggttcattaggcggttagaccggcgcaacacctttggtcagaccgtgatccgtcgaattcgagtgtaacttttcttttccgctaaaagttttcggtttttgggtataccaaccattcaaccccctctgggtggcttagttcttgctattcgatcctacaagacattgatgctcgacacatgtttttattttccaaaagttacttttgactcttaatagttagtacattgaaaggtcaccaataaataagaaaaaaaatatcagtcatcgcttaacaagttaacaaagtttggtcaggccgccgctagacttcaacgaagtaattaacagcaatcagcaagtggcctaattgccaacctagatgatgcgacattccagcagcaattaagtggcctcatcctcccagcagtaaggatatgattggagcagtttttgcgaattagtctttttattcaaaacaaattctagaaatggaccactagcaaaacattttgctgaaatgcatcattcaaaatagcacgaagacgtgtatttgggaagttgggaatattaaaataaaatcattgtggtctgtctgtaagattcgttgaaaaagaggcacactaactagtacaaaggattatgcgtgacgagctggattataataagctgacataaaataagctgtgagttgattatattttttattattgaaggtatttaggggtagtgggtctttagtcacccaataatataaagaaatctcctctagaggagattattagattatattaatctgggcttactctattataactacacctatcactaataaatctactctgtttatctactagttatctcttcaacaatccagattataataatgctaatctgagtctagctaactctcagcctcatgtatagatatatctatctcctaactcaacatttccattcggctctcgctccttttcttggcgcttatatttttcttttcacatcaaactagcttctcaagctgtttagctacatagaattttttttcctctgtactctcggattactgattttcagcttggacaagtactgcttttcttgatcttttgctttacatggaggaattatagtttttctccatactatccctaataatcatatctcatcttccaataggagggtattactattgattctgcatctctcttctacccgctccaacaatttgaagctagtaaacttgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtgttattgattgtatgatttgaagaaaatcaacatctgcccctagaggcacccgaaccccccttatatatgggaaggagtccgtgttacaaaagataatctatatccctaacggaatatacaaatacaggtaaaatacagtcgtaaccgactaagtctcaaggtgtttccttgatgtacaagttaagaaacaaacccgagatacaaataagatattctatatatattcggtatcctatatccagtccaaatatcatcgccatgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcataatcatgcatcatatgacaaaagcatatgcggcgcctaaagaggcattctagccgactgctttttagccataacaaaagaaatccgagtggttaacactctaaaaggttcacgaatgaacacacttgacaggcatccgaataaaaactctaaagattacccaccaagtattataaaaattatggtaataaataagtctaatagcctaggccatgactatttaccataatgaaaacaggcatataacataccagggaaacgactatggtaaaaacaagtcattccaagttaacccagacagcttttgtagcctaaaaaagcttacaaaaacagcataacgcctttctgtcgggcaccttttaatttgcattgcaataattccaaagaattatatgaccgcgtaaaaaggattttatcagcatcgggcaacactattgtgcacataaattgccaaagcaaaaaatgcctaagtccctaaggaacacaatgggccacgctgttaaaagtattgggctgaggtactgttcaggcctaggcccatttgcacctccgatacccttaacaagaaatccgagatccaagcgacgcttcgtcttccccgccggaacgctcgccattttccccactccccgctacagtaaagagctgcgccggcgaactagggttcaccaatccacccaaatccaccttcaaaacgtgatcaaaatccttctcgtgatccaccgcctcaattcctcatctctcccaagccatccctcgaatcaaatcagcgcatttgagaaaaatcgatggcggaagagagagaaagcttcgaaagccaatgggcgccgtccgacgtgacggaagagaacctgaaggagatggtggcacacggcgttctccctgtcaaggatatcatcgggtggcggccagcgtgcggtgaggcctttccaacccccgatacacacgaggtcgtggtcttctctcatttcttttatggcggatttgctcttccaacctcaaagttcttccgtgggatactgaatttctatggaatcagcttacatcatttgaatccgaactccatagtccatattgcaaatttcgtccatgtctgcgaagcttttttgggcattagacctcattttgctctgttccgccgaatatttttccttaagcctcaaccgaacaaaaacaaaccatgcgtagttggaggggctggatttcaactgaggggcactctgagccaaaagtatttctccatgcctttcaagacttcgaacaaaggatggcacgccaactggttttatattcaaaatcccgagcccgctcttcctgagtactcctgtcttcccccagtataccaagatacatggaactctctccccatgggagatgaagctgcccaagccttagaactgatggaacgcatgctgaaactcaaagagcaaggcttacagggagagcaaatcactcggcatttcattaagtgccgattagctccaatcaaagaaagatcccgcacagcatttgaatttgacggcaagcatgatccaaaccgtgaagacccagattctctggattttaagatcatgaaggagaggatgtacaagatattctcgaacgctattgtcgtcagctactcacatcaactgccagtcgtaccatacaacgcattcaatccgcctccgcaggtatgcatctgaaatcttcaacccatgagcaaaataatatcttgtcttcatgttgagttaactaaccacggaggcatctcattcaggaatatgtattgatgaaatctgatcccccaattgctcagcgccgatctcctcgccagcacaccattcaaggaagtggggggccgacaatcaggtcagacccacaacctcaaacctccaaaccggctgggcagacaggtcctcgcaagagaaagctggtgcttaatgacgacgagggcgatgacagcaacaaatctggggacaagggctcgcccaacaaactcccaaagcataccatgcccaggaaaaaattggctggccgtcaaatgccaaagattagaacatcttccaggtataaacctctcgataccattttatttcggcatgcttctctcatagaaattatgctaaatatcgaaaggacactttgcaggaaaccgtccgacatagatccaaccggaaaagaccctgatccggctgtgacagagccaaatatatccaaggatgctgagccgactgctgaaagccagctgactgccgaaagccagccgactggcgcccatgcttcggatgacaaggccaatccgagtgaccagccgccgactggaaaccagtcggcgacaactgaaactgcaacaacccgagagcccccaactggaaaccagtcggatgtaggtcctgatcaagaaatccctgaagttgaagcgcaagcgacagcttctcaaggaccagaagctggtaatgactcgatgattgggtctccagataaagagcaaggatcacctcgcactcagccaggcacatcttcaggtaactcatcttctcaagtgatgccgttctgaataactccagcttgttcgtctaatgtcttgggaatacatcaggtccactaggcgacgacgaagaagaaattctccgcataaaggcagctaatgactctcgtcctcctatcttactcaaatggtgggacgagaactctcaagtttccggcattgttataaatcgccaaaaagaagatgaggaagtgtgccagctgaagaaagtacttggagaagccactcgcattgtgaatgtaagtcttctaggtgactgcctttgatgactttgttttctcgttagcaaaactaatccatgaaccaccgtgcagagaatccatcttcgtaatgaagccaagactgcaaccttagaaaagctggttccacacttgggaactcttgaagccgttagggaacagctacacgaggccaaggagcatgccaagaaaacggagaaggaattaagggagcgaattgcacagctccaggactccaacttcgagctgagtggttcatcaaaaggtaatctctagatctgtcccatttgtgctgtcataactggatcctcaaacatttggacttcaaacagcgcaagccaccaggatggctcaaatggagaagcaaatagaagccttgaaaaaaaacaaagcagaactggctgcggaaagggactcagccttgaaggaggttgaaggtactgccaactgacaatttgaactttcctctcttgaatgcagcagattcttattataaatgtgttttgtagaccgtaaaatcaaatctcaagctcagtttgatgtcctggttggtaagatcaagaagcttgaaggagcaagagacgaagtcgccaatgtcgctacaccacttgtccaagctatgttccttaataacagtggtccgagtgcacttgacgcaaccgaaatctttgacaagctgagagttgcaccggatgtatacttcaagaatatcaagaaagctggaagtatgggagctagtatggcattggcgatgaccaaatccttgtacccgaggattgaaattgataccattgatggctttgcagacgggacaagtgaagaagctgctcttgatcttatcagtaatgctcaaagtgcggctgacaagattgcaagtgatgttgtagagcaattccacaacaacgaccttcagccgagcaataataactctgatgatgaaaggactgattctgactgagtataaatgtagcaaatggaggctcaatttgtacaatactggtgtatttatgctgtgcttgatagttctaaccaagtctttgatttcttaaaagcttttatcaagctttgttgagcctaaaacccaaagaagctattaaaaactttcagtcctcgcagactatgtagaaaaaatcaaacaaggcaatgatagaccaagtaagcaaattaaattgataaaaaatcacactccattattatgatgatagcccccgactgacaacggcaagaagaaaacttggtgttgacagtcaaaatagggaaatacaatgataagcttaagcatagaaacggcgaagatgttcaatattccaagagttgtcgacgagagtaccgtcttcgcgcttgagtcgataggaacctggccgggtaacttcagagatgataaacggcccctcccataaaggagataacttgtgccgatctcgtgtagtttgaattttccgcaaaaccaggtcgccgactaaaaaggcacgggatcgaacattgcgattatgataacgccgcaacccttgtaagtatcgagccgaccgaatcaaagtttggtcaggccgccgctagacttcaacgaagtaattaacagcaatcagcaagtggcctaattgccaacctagatgatgcgacattccagcagcaattaagtggcctcatcctcccagcagtaaggatatgattggagcagtttttgcgaattagtctttttattcaaaacaaattctagaaatggaccactagcaaaacattttgctgaaatgcatcattcaaaatagcacgaagacgtgtatttgggaagttgggaatattaaaataaaatcattgtggtctgtctgtaagatacgttgaaaaagaggcacactaactagtacaaaggattatgcgtgacgagctggattataataagctgacataaaataagctgtgagttgattatattttttattattgaaggtatttaggggtagtgggtctttagtcacccaataatataaagaaatctcctctagaggagattattagattatattaatctggcttatctattataataacctatcataataatctacttgtttattacagttactcttaacaatccagattataataatgctaatctgagtctagctaactctcagcctcatgtatagatatatctatctcctaactcaacatttccattcggctctcgctccttttcttggcgcttatatttttcttttcacatcaaactagcttctcaagctgtttagctacatagaattttttttcctctgtactctcggattactgattttcagcttggacaagtactgcttttcttgatcttttgctttacatggaggaattatagtttttctccatactatccctaataatcatatctcatcttccaataggagggtattactattgattctgcatctctcttctacccgctgcaacaatttgaagctagtaaactgttcagtttacaggtccccttgactgttacaggtatgcatcgtttcatcaaatttgtacatatgattttcttatttacctcaagcctcaaggtgtgttatacaacacaattcctagattttctatatgcatatgtccacagaaaagataatactggtcatatgtttgttttttacgtctggttaaacaaacaatcctagaaaaactattattataggcggtcaataattcatttgcacaagtttagctaaccagcatgtagaaattaaataatttgtattggaggattccacaacggtatgtggatatcaatttccagttctattaagaacccacccacggaaatgaattttcaactttttgttaatgtaggcgaaagaaaaacacattttaccaggcaactatacactgtcactggtcgcaaatacgaagtcacagtgatttcttacacgaaatatgcattttatcaaaagtcacaggtcgcaaatcagaagtcactaatacctatttcatattacaaatattttaaaatggaattatcaccaataacaaagttgttgatctcggccagctctttagtttttaatatagggcatatctcccgctgaggctgtttgaaaactttttttaaaaaaacatttttagagttgtttctatttctagacacggtttgttaggttagccgtcagcactaatcatttattccgttagtttttcagaggttctcccgtggaaacaagttgctttaaaatattaaataaatctatttttcaagtttcatataattaaaacttacttaatccagtgctaatgattttctcgtttttgttcgcacttctctccggatcaaacgtagctaatagtgtagacagttagttacagggtctgcctgtcaaaaccgttactcattatttgaaaatgccaaaactttgaaaattgatagaaatttgattttaagtccagtattagtgaatcaaagttctagctctcaacaagatctatctctttgagactgtatagagtccaaatattcgttataagctcttagatctatatttggaaacaaatttatgaattttttgaatgcccttaaatggagatgtgttctgtaatatgtattgaatttgtaaagctcgatgagattctacaactttataactttactggtgataattttttatttgatgtcatttatcctcccaaatatgctaaatgacatgaggtaaggttatgagaggtaatcctctttaccgcccatgtgcatgcttcacgtgaaaaattgcgtgactcgttgttttgtgaaatgtgaattattttattggtttttttttcatacaacatttaaaaactagaaatacatttttctcacgtgactggaatttatctgtacaaaatcgttgatttctacttgtcttagtcataggcggttggctaaacgcctgtaggaataatgggttaccgtcttaccgacctcctatacaatttttttatgtaccaatcattatttcgactattcttcctgaactggagctaggttatactaaaatgataatttatttaacagaaaatagtagtcactataaattgatatgttccaagttgataaaactacattcatttttgttttttattaaattatactccttgtatcccaaataaggtttaaccactttttacttatgtctcatcatataagacaggcaggcatgcatacattaattatcacctcttagttctttaaatttggtttactttaaattctccaccattaaacccccaatcacattgtttgcatgtatggatgtgatccaatcaaggaggtgattaaattctttcttgttctttgtggtagtagtggttgagccttatacttttagatggagagaataaatatatactataggcaccattagtttttttttgtctgtactatgttccacatttttctgtaactctatggaccgaatcgtcttcacgcttgagtcgatatgaacccggccgagtaacttcagagatgatgaaaggtccctcccataagggagataacttatgtcgaccccgtgtagtttaaatcttcctcaagaccatatctccgactagaaatgcacgtgatatgacattgcgattatgataacgactgaattaatgttgcctcacgagcttcttccaattggttgagatcatccactcggtcttcctcgtagcgttcctctttaacattgcgaaatctcatggactcaaactccacttcgcttggcaacattgcttctactccgtaaactaagaaaaacggcgactagcccgtagcccgactgggcgtagtgcgcaaagaccaaagtactgacggcagctgctcaacccatttgccagcatagggacgcagtcggttaaaaaaccgtgccttgatgccttgaagtaccacaccattggcgtgttcaacttgaccattgctcataggatgcgctacagaagcataacatatcttgatactaaagtcttcacaaaaatctttaaaaactccaccagtgaattgggtaccattatctgtaatgattcgattcggcaccccaaaccgatgcacaatgttgataaagaagtctcgagctttgttggctgtaatagttacaactggtttggcttcaatccatttggagaacttatcaacagccacaaaaagttgattaaatcctccggtagcccttttgaaaggaccaaccatgtcaagcccccaaaccgcaaatggccaggaaagagggatggtttgcaactcttggtccggcaaatgaatttgcctagcaaaaaattgacaactttcacacgttcgcacaaccttctcggcatcagacaccgctgtaggccagaaaaaaccctgtcgatatgctttgccgactatcgttcgtgctgccgcatgatttccacaaatgacagaatgaatatcttacaacaattgcctaccttcttctagagaaatatagcaatgtaggattccagatggactctttttgtataaatcggcctcaatcatgacataaagcttgttgtgtcgagaaatccgctcggcttcattcttgtcttgaggcaactcttgctgagttagaaatttgatgattggctctctccagtcggcatcaattactcctacttcattagcctctccatctccgactttatcctttcttgatactgtcagctcatagagatgctcgacaaaaatatcagaaggagctgcttctcgttttgacccaaaattagctaatctatcggctgcttcattgttgtgtctaagcacatgagttaactctcgaccatcaaatttatcttccaatttgcggacttcttgtcgatatgcaaccatattgtcgtcgagacaggaccaatctttcatgacttgattgacaaccaactatgaatcaccacgaaccactagatgtcagatccctagggatacaacaatcttcagcacatggagtaacgtctcatactctgccacattgtgggatgcagaaaagtgtatccacagcacgtagcttaacctttctccagtcggaaaaatcaaaacgacccctgctccggtgcccgatagtctctttgacccgtcaaaatgcatagtccaatactccaatttctccacaggtgtgtcttcttgacactcggtccactcggcaacaaaatctgctagtgcttgagatttgattgaagttcgcagcttgaaagataaatccaaagacatcaactccaaggcccacttcgcaatacgtccagttgcctctcgattatgaagtatgtcaccaagtggaaaagatgtgagcaccgtgatcgagtgactctgaaaataatgggataatttcctgacggtaattaagacaccatataataatttatgtacctggggatatcttattttggagtcggccaagacctcgctaacgaagtaaattggtcgttgaactttttgaacatggccgtcctcttctcgcttgacaaccaaaaccgtgcttaccacttgcgatgttgctgacacataaaacaacaatggctcttgcgggtgtggtgacgctaggattggtggagttgagagaaatcttttgaaatcattgaaggcttgctgagcttcgggtccccattgtaaattgtcagtcttcttgagcagtttgaagaagggcatccctcgctcgtcaagtcttgaaataaaccgactgagcgccgccatgcatccagttagcttctgaacgtctttctaggaactaggcggtttcatgttgaggatggcattgattttctccgggttggcttgtatgcccctatgggacatcataaagccaagcagcttccctgacggtactccgaaggtacacttttcagggttcaacttcatcctgaaagcacggatgctagcaaaggtttcctccaaatcagcaattaagtcatccttctgcttggtcttgatgactacatcatcaactacatcatctgagttgaaaaacatctctggattatgtgttgataagttgctctagcattcttcaatcaaaacggcatggtaatgtagcagtaagctccaaatggtgtgatgaatgaggtcttcgagcagttggattccttcaacctgatctggcggtatcccgagtagcaatccaaaaatctgagtaactcgcagccggttgttgagtcaactacctggtcaatgcgaggtaacccaaaagaatctgtaggatatgatttgttgagatctgtatagtcaacacacatgcactattgttctattttcttccgaactaagactgggtttgccagccattcgggatgtaagacttctttgatgaagcctgccgctaacagcttggttaattcttccttgattgcatccttcctatcctgagcgaatcggcggagtcgttgcttaataggtttagcatcgtctttgacatttaaagagtgctcaatcacctctctaggaatactaggcatatcagatggtttccacgcaaaaatatctttattagcttaaaaaaaggtgatgagcgcgctttcctatttacaatctaactcggcgcttattacagcaattttagatggattagatggatcaagggggatctttttggtcttggcatcgccttctccggaaaagcttgaaggttcatcactgacagatagcaagagattgctacaatcgacaggtcgacaactagaagtaggcatctcttgatcacctgaaggcaactggtgagagatcgctacaaccgctggtcgacaactagtagtaggcatccctcgatcacataaaaacaaccgaaaggtggcgagagatcgctacaatcggctggtcgtcaatcaggagtaggcatctgtcgatcacttgaaggcaactgataggtggcaagagatccctacaatcggctagttgacaaccatgagtaggcatctctcgaccacctgaaagggtgctagtgttggctattatatgtgcatctcatgtagccagcatgactcacatacccaacttatagcatacccggatgtccgttcgcaatcatgtcaggtgatcaagccgacaacgtttgcgaggaattatccgttaacaacctattctcaaatagtgcagccgtggcctgcactatacgtgagataagtcgttaatctttgctggtaggattggtccgacaactccgcatttgtcgagaatgttctcgataatgagttgtactcgaccacaacctactctagtgctcaattgtttctgaaaaatattttctataagaaaagacatatatggcagagaatatcgagtacgtactaaaaaaaactgcatgaatcttctagtattatcaggatataactggcagattcagattaaatatcgcgtactatgtaaacgtaaacaagcatgacttataacatgaacatagcgagcccccaatattagaccatagttagtctagtataggaaacactcgcacaatagatatcgtataaaaaacatgctctaggtaaacagaataagttatggatctgacaatatcgcatcgaactgaaaaataggtacattaaattgtttataaaatattacgtacctttgtagataattgccatatgtatctacgaaattagtagattaatttaaaaaatcaatctaccaattaccttgatgcgtaatcgttcgacatcatatatatttgaaatcttctggtacggtgcgtgcctaggacctttggatgatctcgatagatcaaatggttggcgatgacgattccgagctagttggggggcgtactctggccgggtcagatctcccaaggtgaaagtcgttgaagtatccctcgttgaaaaatccacggtggcaatgacttgatgaagctttaggtgacgagggtcctgatacgtcatagaacacacttcgttcgggtcgtatacccctacagccaaagtcgtcgagtaatttattgtcggagaatccatctcttgaacctatctcgccgaaaccttgaagcaccaaaatcccctacctggcgcgccactgtcgatgttgtagatcacgactacggtatttgcatagtatggggatcgttggtgccagattgtgcgcgagattgaggtaaaagatacgaagacaaggatttttatacaggtccgggccccttaactaacaggtaatagccctacttctgttggttgaagccagtgttgctcttatccatcagagtcacacaagtataatatttgggatagcctatccagttgtcgtcaactcggcggcatgaaccaacactcttagtcgacgacagggtagtcttcctcctcgaatatggacttggcgagattagagatagtgcta

SEQ ID NO: 77973 - DNA, 669 bp, Oryza sativa
ctggtgtgtggcaaaagcgaccttctcctgatcattgcactgcaggagattcagcttcttctctattgcatggagccagtcatttgcctccatagggttggtggtgctggagaaggtgggtggcctgacacgtaggaactcaggcaacttggactgagggggagggggaccaaactgctggtgctgctgttcggcgtgctgcatcatcctctggtgcatctgctggtgctgctgctgcatctgctgcatcatggctgccatcatctgagtctgatgtgccataacttgggcaagggtcggattctcgggaagtggtggcagaccattgccggaatcactgctggggtgcacaccatcagcacgttcttcgccgttgctgccctcgcctatcgtgcgggtgccagtcctggtgtagaccatctacagggaaaagcagacgggggaaaagaagaaaaacagatgctcaggaactaagctttattacaaaggaatttaaactgcaattgttctgatctgaattaaaacacttaaaagagcaagcaaaaatccttattaagacagccatatcataggcacatgatatggaccgttgactgaccccaaacaagcaacctaaacacacaaactaacaaggagaaagctagacagtcgataaactaatgggaaaaa

SEQ ID NO: 77974 - DNA, 1382 bp, Oryza sativa
tatcatcttaatggcttttttggattaatgtgtgattcttcattcttccacgcaagattggctactggacatcgaggaatataaatattaatgaatcgcttgtttacgaggaatgactagtagcatatttaaatggataataagtagaatcacttatccttaatttatgtgtcaaagataaaatattactatcaaaaatagatggagagagtattatcattagtgttaagtgttaaataaaggtagttgaggccttaagttaagggggtgtgcacgctagcgcgccagctagccacccccaccgcgagtccgcaactacccaaccccacagcaccgcgtgcccgcgtgcgatggcattcgcgccgcgcgtaggccgcgcgggctgatcagctgatggtccgcgcggggctacgattctgctacgacttcatacgagtctacgaaccagtcgccgcagcccggtaacgatcttggggcaggcttgcacacaggtgcaaagatacgtgtggcagacatccgctcgacggcaaccgcctggcagtggagccaccgtgtcactgtcacctaccaaagctctgcaaggattctaactttccaatagcccgtgagtttacgttttgtcctgatgcatgatgaacagcccatcatcaacgggagaagccaaccaatctatcatggacatgtcgtcctgtgtcgtatggcgtgcagtttgtactttggattacaggtaatattgatctgtacatatactacttttaataatactccagaaactaaatactactagaaaggattttgttcgccttttagtacgtgagggataattatcccttgatgttattggtcggagtaccattgcatcaccatgaatgagaaataataaagaaatgaaaagaggattgcaaaccaaactgggatgctccccgcatatgggttctgcatttagcagcataacatctaaaaagcagataccacaaatattttcaggggactactccaggaccaataggaactagagattactaccatgaagggcacatgcttgcatcgcatgctaaccatctactgtagagtagtaaatacaaaatctccagttctgccaaaaacaaccaactcgagtcaagaaaaaggacagcagtttcatgcaaaagaaaacattaaatagtacatatccgggagatatgcattacttactgcgaatcagctaaatatttccccaatttattaggcatgtattcccccctggaaatataacaaagaaccaactggagtctggagagtattaaaaccaaggcaaggggttccttctcatggcgcacaccattctactcctagtagtgctcctcctttcctccaccaccaccatttcgggctgcaggaat

SEQ ID NO: 77975 - DNA, 1325 bp, Oryza sativa
  unsure (1)..(1325): unsure at all n locations
gagtcagcgtaggacccacatgggccctatatatcaagatgccacatcatcaccctctctccccatcctctcccttcctcctcttctctcactctctcttcctctctcacttttctcctctcaggtaggcaggctggtgggtggggaggaggtcgccggggtaaggcgggggaggaggtccaacggttggcgatagcggcgcctgccggtacgaatcctgctgccgcgccgccatgtcctcctcccgtgggccgtaggaggtctgacggccggcgatgggggagaaggggagggcagcgcctgcgggtatgaatcccgctgccacgccgccatgtcctcctcccgcgggttgtcgtctcctccgtcccaccagaaccctaacgatcccttcgccgcggcgaagacggaggcggaaggggaggcggcgccgcccggaaaccctatcatgcccagtgaccctccctcaccgcagatggaggccacttcagagacactcacccaagaggagatgttgcgtcggcggaagagctgtaggcgcaacaccggcgtctcgtcgacatgtatcggcggctctactggacgctcgggaaggagcgtcnggcgcggcaccagtagtacgcctgggagcttgtgcggagctcgcttgagccgagcagtgtcacgccccgaaccagttccggctggaactagcccgtgacgctccaaattaacctgttaatcgataccagtcccaggaaacagtgctggtatcacagggagacagaatatcatagcaacagaggtctctttattatagagtaggagtacagtcatgttgggctacggacagatcccgagctcacaactgcattacaaaagcgaaacggaagccaggacttggaccaatcatcacaggcgcgacttgggaactaggccgaaaccctaaaactcatcgtagccggcttgctcctggaagaactcctcatcagcaggatccacttcatcttcttccgcaactgggggggggattatttatatagagcaagggtgagtacgggagtactcagcaagccaggggaaaataagtgtttaatgcaggcttcaaggaaaggctgttgtttttgcaattgattttatttgaactcttttctaaaagcaactaagtgagtgcttctcaaacgacacggacgaggcagtgcgtctcgtccggtcggagtatgtgcaatgtatcagtctttagattttgaaacaaggttggcacccggccaaaagctttttaaacggccacccgggccaacacctttcaaatggccacccgggcctagctgatcccatcagctgcaggt

SEQ ID NO: 77976 - DNA, 5927 bp, Oryza sativa
gtcagccttctccctctagtctcggctagggagtggccgccaccgtacctcgggcctgactctccttgggggagggccatgtggcattgggggggcggccttctccgactagtctttgggaaggagtggccgccaccccacctcgggcctgactccccttgggggagggccacgtggcattggggggcagcctcctctaactagtgtttaggaaggagtggccgccaccccacctcgggcctgactccccttgggggatggccacgtggcattggggggcggcctcctccgactagtctttgggaaggagtggccgccaccccacctcgggcctgactccccttgggggagggccacgtggcattggggggcggcctcctctgactagtttttgggaaggagtggccgccaccccacctcgggcctgactccccttggaggagggccatgtggcattggggggcagcctcctctctctaaacatgatacccccgggcccatatcaccgataaggatgaagttaatatctaggtttttatacttttgtacgaagttaatagtagtcactagtaacgacattaattgttataaagaagctgtcatatttagtcatgtcagtgagatatcagctaggagtaccaagattaatgtttcccaggaaagaactttaaaatcctgctgcaacgggtacgtaggacatccagtaccaatagtagtgaagcgattgtcaccttaatttagagtctatttgaggaatttaaaattttaaaaagcagctgattggtaaccattttctgagaatctgaagaagctggtatccaagtttctaacttctagtttattttttaatttttacaactataatttcgcagaatctgatcgaaatgttggactgtttagtggagcttttgattttaggagaagctatagcagccagaagcagctccacgaaacaagccgtacacacactcgacttcttaaagcgctttattaaaaatcactttatttaggaatgtaaatagttggaaactgtatctatcattactatttctttggaaaattctcgattagttgagaatttatatatttatcaatttacttatttagtggtgactgcaatccatggcagaaagaaactagaaaactcacactgaaaaaaactagaaaactcaaattttaattatatatacacttgtctaaaattagaaattgtagaaacggtaccacctctataaaaataatgttaggttcattgagaaattttcatcaacgatttcacccgtaactttattattactcccactagtatactccctcggtccctcgttactcctgggggcagtggaccaagtcccaagccatttgagccatagcgcggggtggaagtaaaaaaacccaccctgtagtaattttttagtggaccagattatcctgtagagtacaaaagctagccgagcttttatccccaaggtgtatggagaggcattttcatctctcagggacatccctatcacctaaatagtcactaaaaaaaatatttgataacatagatcaatatatcactcacaaacatttaagaccacattcgacttcttcaagttgaaaaaaaaaacaaagtaaactgaaaatagttaacttacattatggattaattgcaatttcagttcgaaatttcggacccttccagcaagtgattatctcagccaaaattttaagttttcctaaaaattttgcgaatttggtcaaaatttaatcaaattcagttaaattatgctaaaatttcaaaaaaaaaaaaatcggtccaacaagtgccgaaaatctaatgagcgaaattttggacaaaatcgaaattgaaaatcctgacatacattagcaattacttttttttatttttctacagaataaattacacccacggtacaataacttgacaggtggatatgatgtagtgcaagaatttgagaattgaatgtctgaatgcaacaacttggtaagtgggtgcgttctagctagtattagaacttgacaatttagtattttggtgcatcaaacttggctaagcatgtgctaggtaaggtttttttcatgatgtcaatatgccatcacatggcaattctatggatattaccttataatattgaatttattctttaagaattacattgcacatccaatttacatcaccggttcggattttcgtttgcttcaccttctcaaatctcaaccgaaatacaatattttctacattgtaaagtttaattggcttttagttattagttattagaatagaaaatttaatatgtttatacaaatccgcgctagtatattgtcaaaataagtacttaaaaatttaatgtgtataacaagaaatgctcgaaataattaagttgtcgcatcacttcttaacttattgtaccaaaatcgctcccttgtacccgtacactcacatggagttcttagactaaattgcacccacctgccaggttattgctagaatactcatttctcaagtttttacaccaaattacacccaccttaagttgatgcacaatgaatacaatttacgcttttgttagaacttgtaaaagttgaatttgagtttgctttctgtagtgatatactcctttcatccacaagagttatatatattacctttatcaccaagatcaggaaaactcatcttgtatgtaataaagtttaaggagtatatgcatgaatacaatcaatgtattaaaatggttcctcaggtttcaattaaacatttaattttttctctctatttaagtcttagatacatgaaaactacaaatatgactaacttatttgaaaaaaattatagaataaatctaacatttgtggaaggatggagtatttcatatcaatctactttttaaaaaaaattaatagctatttgtggaacaatggatatccacgggagaaataaaaacactttttgctagggtgcatcgatccatcccctactctatcggttcacacataaatgctagtagtaacaagtttaatttagaaagcatgcacacttaatgacgttagctgtctagctgatactacctccatcccaaaatatttgacgccggtgactttttttaaaatgtttgaccgttcgtcttatttaaaaaatttaagtaattgttaattctttttctatcatttgatttattgttaaatatatttttatgtatacatatagttttacacatatcacaaaagtttttgaataaaacgaacggtcaaacatatttaaaaaagtcaacggtgtcaaacatttagggaaggagggagtatatgtttatatttttgtcatctgaaacactgtaacctttatactccatccgtttcaaaatgtttgacaccgttgactttttaagtacgtgtttgaccattcgtcttattaaaaaaatttaagtaattatttattcttttcatatcatttgattcattgttaaatatactttaatgtacacatatagttttacatattttacaatttttttttaataagacgaacggtcaaacatgtgctaaaaagtcaacagtgtcaaacattttgaaacggagggaatatatattttttgaaatatcataagaaaacaattaagtatcattatagagactgttgatgctgtaaacaacgtacggaggagggagtacgtaccgcagatgaaggcaggcatgcatggctgcgcccctgaaccatacatgcagaaactgataaactggccaagcaatcaattatccccgcattatgtttgatatacgatcgaaagcccagcccaggcaccccctgacttatattaatcgatcgccgcatgcacccatgtcagcaagtttcacagtttgacactcctcatttcgtcgtcggtcgcagccatcggccggtcatggtcacacgaacagactgcctaacattatacagggaaattgatttcatccgataccctctcgtttcgtatatgccacctgaatattcactaaaagaatacaaaagaagttagcaacatatattaatatgaaatatatcactccacaaatatgcaggtttaaattcagcttctacaagttgtaacaaaaataacaaatatagttgtgaatgtgcaataattattttcactttaatttgttatttttgttgcaacttgtagaagttaaatttggtcttgcgtgtttgtataatgatatatttcttattaatctatattatcaatttttttaattttttataactatttagatgatatgcaaacaacgaggatgccctctcgagtgatgaaaatccacatcccattatacaagactgtggtatttcctctgagtgtatatatgatgctattagaaaaaagaatagaatactagtacactaagaatcttttgtttcagtttgaacgacgtagtacctctgtaactatataatttcgtgccagatcgaaactatgtgatattggaaacgttatttcagttgatccttttattagcgggagtcgttgaaaatctatcccatcactctttcatattttccccccttctttttaatttacttctaaaacctcatggttgcatgcccatgggtagagactctactagtgagataatccaattcaattacttagagaaaaaaacggggtcacacggtcacaggcagccaccccgcttgcatccttccctctacctacctacctcacctcaacaccttacctcgtcttcctcctccatcttctcccctcacgactcctccaacgccctcctccccacgccacttcaccccctccctatatatacccacatccatctcctccatctcaccaaaccaacacaccaacctagctaactcactcactcactccttcttcttgcgacctagctatcgagctagagcttccaaaaccctagctagctagctgagacagttagtttcatctcgaactagttgttgatatgggcagcttggacaccaaccccacggccttctccgccttccccgccggcgagggtgaaaccttccagccgctcaacgccgatgatgtccggtcctacctccacaaggcggtggacttcatctcggactactacaagtccgtggagtccatgccggtgctgcccaatgtcaagccggggtacctgcaggacgagctcagggcctcgccgccgacgtactcggcgccgttcgacgtcaccatgaaggagctccggagctccgtcgtccccgggatgacgcactgggcgagccccaacttcttcgcgtttttcccctccacgaatagtgcggccgccattgccggcgacctcatcgcgtcggcgatgaacacggtcgggttcacgtggcaggcgtcgccggcggccaccgagatggaggtgctcgcgctggactggctcgcgcagatgctcaacctgccgacgagcttcatgaaccgcaccggcgaggggcgtggcaccggcggtggggttattctggggacgaccagcgaggcgatgctcgtcacgctcgttgccgcgcgcgacgccgcgctgcggcggagcggcagcgacggcgtggcgggactccaccggctcgccgtgtacgccgccgaccagacgcactccacgttcttcaaggcgtgccgcctcgccgggtttgatccggcgaacatccggtcgatccccaccggggccgagaccgactacggcctcgacccggcgaggctgctggaggcgatgcaggccgacgccgacgccgggctggtgcccacctacgtgtgcgccacggtgggcaccacgtcgtccaacgccgtcgacccggtgggcgccgtggccgacgtcgcggcgaggttcgccgcgtgggtgcacgtcgacgcggcgtacgccggcagcgcgtgcatctgcccggagttcaggcaccacctcgacggcgtggagcgcgtggactccaagca

SEQ ID NO: 77977 - DNA, 42553 bp, Oryza sativa
atcagcatgagccccacaaatggctgatgacctgcctcgactgcacctgcctctacgtgcgcgacacccacggcctcaccggctccctcgagaccaacccggagtacctcaagaacacgccagcgactccggcgaggtcaccgacctcaaggacatgcaggtcggcgtcggccgccgcttccgggggctcaagctctggatggtcatgcgcacctacggcgtcgccaagctgcaggagcacatccggagcgacgtcgccatggccaaggtgttcgaggacctcgtccgcggcgacgacaggttcgaggtcgtcgtgccgaggaacttcgctctcgtctgcttcaggatcagggccggcgccggcgccgccgccgcgacggaggaggacgccgacgaggcgaaccgcgagctgatggagcggctgaacaagaccggcaaggcgtacgtggcgcacacggtggtcggcggcaggttcgtgctgcgcttcgcggtgggctcgtcgctgcaggaagagcatcacgtgcggagcgcgtgggagctcatcaagaagacgaccaccgagatgatgaactaagtaaagagaagattacaaataaatacacatatttagaacacatatacgtttttgatttttttttttggggttttagatgcgaatctgttgattcattttgtgagctatttatacctatggatatatggatcaaaataaattattatttggttgtaatttttttaaaagatgaactgatactataccttacacaagaaatacaatatgataaaaatttatttattactttcccagaatattatttttttttgtgttcattaatgtgtatatatcggcattgtgctagctagctaggtaaacatccggtgactgattttttactgaactatataccgatcagtcacacaatttttagccgtcagatcgtgatcctaggtgtctcattgctccttacaactctaccttgtcagtaatcgctattaattaccccctctatatctcacttcaatggagcatgccggtgaatgagactctcgtctcttcgttttttccctagtagccgagggcgcacacgggaaaaggcaccggtgttggttattcttgccaccgaaagatgacgagagttgctagattcaatcgtattcttgctagcatgatcctcgatcttcacctgcttcatggtgtttgtagatttgtatccaaattaatcatctggctgatgctattcattttactaataggaacccacatatatatatatgtacggcggagatgcgtgtgtttttcaaacccgatgacttttctagtgccaatggttcaacatatactaataacgactaggttataccctgctctttgctacgaaattaattatggatgaatacacattaaatattatagaaatgatgaaaattgaaattaatccggtgagaactgggtgaaccggatgtcttttttcgctaaaaaccggtgaaccagactagtctgaaccagaccgtttttacatttctgccaacacgtgggctggcattgtaaggtccatcatgcacaaaaggcccatatatggtttgttcataatataaggatagttaaccatttgggaagggattcgaaactagcctggtgggtaccgtgaggtgtcccaacttgctatttactccctccgttttatattataagtcgctttcactttgattctactaaagtttatgttaagtttgatcaagtttgtaggaaaatatagcaacattttcaacacaaaacagacatattatcaaaatatattcaatactacatttattaaaactgatttgatgttgtagagatgttactatttttttttaacttagtctaacctaaaaaagtttgactaggataagagtcaaagtgacttatgatatgaaacagagtacttaactagctcaccatatcttagggaaaatgtatagggtaaatacatgctatgattagaagacgttttcacatctatagtccttacaagtcgaaagcatgtgaccaaagcaacaaaaaagaatatgttaagactagctatacacatcttcgatcttattggtaaaaaaaatgcaagattgagtgaaataattaattctaaaattaacttataaaattcaaacaagcacgccctttatagcttacaatacaattactttttacgtgactctcaaattgctgaataattaagacatgcatgtgcaacttattaattaattcagagctgcggttcttgccgggcatttccgaagatcaattcaaagattagtagtactacgtacgtgaactcatgcctactacgttcataagttggattatcacggcgtgtgtgtaaattcgttggatccagtagctattttccaatctcatgtgtactctttcctcgttaattaactgatatatacagatcacatatttaaaaacaagacgtacactggccacaaaatcccaaattaatcaaaggtggtgggggggtccattatatatattccttgtacatatatgcatataatcaatgagtgaatgaatgaattagctagccacaaagaaaacgacatatatatgattcgcatctaatcaataattgaaaacatgtagtattatttttaatcaattgtgacgccacggacaggttccgagatcgaccggtctagaataggacacggactaattgtgccatgtgcaattatctcgctaattagccagccccagcagctgacttgctgcgttcgtttggagttgttccaactcccccatctcgtttttcatgtgcatgtttttcaaactgctcaacgatgcgtttttttaaaagtttatatacgaaaatcgctaaaaaaatcatattaatatattttttaaaaaagctaaaacttaattaatcagtaaacgctgcttagttttacgtgccaggagctagcaactaattaagacgcaattaatattcttcgcagggtgtggtaggtagattagttgacaaacgtaatcgactacgtgatcaaaactaatttagtttgggatatgaattcgaccgatatcagctagctctcctagctagtgagagatcaaaagcaaaatgaattgcacttcctgcacgaaaccaaacacgaatatacgtacgtactttttgtgcgatgctttagtttgctcttcttggaccacacatcttctcccttctcagctttcatactacgtactgtgtcagtgtaaacgttttcagaatttatatgatttgctgttcacaagagaactcgatgatgcgatttggcatttacaagtgtgcgagttatataattaatttgccatcgaacaagcatttcttttcgtttttgccattgttgtttttttacattaattattctaattagtttaactttgttgattaacctgtatgggaagacccctactgtactccataaaaaataacatgcactaaaacaagccgagatcgatttagcttttttttttattttcactgacactgaaatagcagtagattgattaatgagccaatttcagtaaaccccatgatctatgaccgaagttgcgtaaaaccccaggtattatgaccagtgaaacataagagaatcttttgtggttcctaagtttaacaaattttaaagaaaaagtttaacaaatttaaaaccccatccctatacatacttggcaaatatttacttaatttttttaaaaaacatagaatgtacatgaaacttttagttgttgatttgttgattaaggttgtcagtttaacttttcactactttgaaaaatattatctcagatatactgaaatcaaataaaatttgaaccgggtgggattttttgaaacatttagaccataaaacatgtgcttatatgccacaaatcataatatatgtgattttttgaaattttgaccataaaacgacatagggatttataaaatttgctcttaattaattgaattatttgaaaatggcattgaaatagtagtagatattgcaaacctcccaaggcgtggtttttcggcatcgtaaaaaaaatgaaagattgataacggaggttaactatactaatggtaaaaatggtaaaataacacttgtatgatagtacatattattgtacctagaagttgtatatttttatcgatgacaaatcgtagaatctagcgcttgtcagtggcaaattattgtgcatgcatatatagttcttgcataaataggtcgtatataagcttctatttgcaatatatatacatatgagaaaattcagagagttcctttttaaagtacttgtagcaccaaaaataactcggtacctcgagatacttattattacatggagataccaagtttaacattagaaaatatggaatctcatggtatacctttttcttaaagatgataaaattattgtatacataaatcgtcattctcaatctttttcgctattgtaaagatgatgaatatataatgaatgtgtttatggatagacaatggattcacctgcggataatactagatccacctttattatctagtgttatattctctccgtcctaaaatataacaacttttagccattaggatttatcttaaaatataacaacttctccatcaacattttctttccaaccaatcacaaccctctatcattcatttttaccacctacctccactactcatccaatcgtaaccctcgaacactcatttctacctactttcttaataaccgtgtccaactctaaaacttcttactccctccgtcctattttaagtgcagccatggttttccgcgcccaactttgatcgtccatcttatttgaaaaaagttaaaaaaaatttaaaaacataagtcacgagtaaagtactattcatgttttatcatctcataacaaaaaaaatactaattataaaaaaaattcaaataagacggacgatcaaagttggacgcggaaactcgtggttacacttaaaatgggacggaggaagtatattctgggacggaaggagtagattgtatggtcagtcaactagtcttctatgctcaactataatttgtgtacttttactatacaaagtcaactctagcataattaatactcctgcaagctagcacaattatatatgcagcattcatctgtgttaattgtactacatgaattgatgctatagctagctaccaactaacttttgcaaggagtacagtggttctgctagctaggagagtatacgtgtatggatcatggacagttatcagttccatcaggatggagaagtaaattactaattgaaatgtgctttgactttcgatccaccgcatgcccatctgttactttcttgtttcagtattaacacgttatatctaaagccacacaagtcattgacgatatgatcgatcgatctacatgaaccttaatttgttgaagtttatatgtatggtgcctggtttggaggttaacgtaattgtcatgcttgcaaaggcatgaagttgatttatcaagaaggatcgtatgtgatgggtgtaaatataatggtctttaatttatagggagcgaaattaaaacatatatatacacctagttatatagacgcagagatcctctatagtactgctaatgcagtagtagaggctgacctgtgggtcaggcaatccccataagtcctatataggagtatatcctttctttttaaacttgagttaatttatttaatttgtggatatatgaaaccaatagccaaaggccttgcatgcattctctaggaaaacaatattccagacctgactatgtacggagactcaaccgtggtaggagtaccatgtataaccacatttaattaaataaataaataaatttgttggaatgatattgatcgctgcaataaatgcagaaggtagattgtctatgagttcgtttcatgctgggcatatttacaataaacaatgtagcaacgccatattgcaacaagtttaaagagtggttatataattaattaatatgacatctatacctttaaaagaaatttaagtatttcggtatctgtaagacgtctcaatgtcatggtcggtgaatctgacaatggagtattcccttcattttttttaaaaaaagctaattaacctaactagggatgagatattaatttcccattctttaagttttttttaatggatgaagaattagtatggaggagctagcgatcaaaattaaagcgacgatgggacaatgcaatgagaagcggtgtgttgtatgagtgggatgacaagaagcagtgattgttgtgatggcgcatcttatagtggggcatacaatagctaacaataatgggtgtggattttcgtccctcgagagaacatccttgttgtttgcatgtcatctaaataattattaaaaaattttaaaaaaattaacaacatagattaatataaaatatatcactttacaaacatgcaagaccaaatttaacttttacaagttgcaacaaaaagaacaaattaaactgaaaatagttatcatatgttcgcagctatatttgttatttttgttacaacttgtagaagttgaatttaaacttgcatgtttttggattgatatatttcatattaatatatgttaccaatttttttaaaaaaaatttatgactatttagttgttatgcacgaaacgaggggatatctcctcaaagtatgatctatcactttcccaacaataattagctaggctctgttcgctgctggaggttcccaaccaggaagagtgcgtacggaaaatggagcggtccattagcgtgtgattaattaagtattagttattttttaaaaaaataaatcaatatgattttttaagcaacttttatagagaaacagtttttaaaaaatgaaccgtttaacagtttgggaaacgtacgtataaaaaacgaggcgaggggggttgggaaggagctcttacgaacgagctggacatgacatggtgcagcttgcacaacatggcacttcaaggatcgatactgtgagaggcagagacagaagtactagcgcagcagtactacgtgaggcatctctcggatttttaatttatggccgagtttatttccgaactttttctttaaatttttaactttttcatcacatcaaaacttttctacacataaacttctaacttttccatcacatcattttaatttcaaccaaacttttaattttgacgggaactaaacacaccctataaagttattgaatttttaagatatgtttagcctttcggcttattaaaaaaattattttaattaatttgattcatcgtcaaatattcttataactatgatttaaacttttatattcgcacaaaagttttaaataagatgaaaggatccaacgtttgtaaataaaccaaatacgtcgtatattaaaaataggttgtaattggtatggcaggaggactgcaccttacgttaaggcccatcgatctaccatttgcggcggacatacggtttagaaaacatgaattctcagaagactctgaagttttttatataacagaaaatttattgaatcctcggactctatcacatgacacacgaactgtattgcaaagatacagtatatatatatatctccgtcttaaaataaataagtgtaattctgtatacaaattttgttctaaaataagtatattcctgtcatactagtacttgttacactaaccatatccaattcaaatttctctctatcttaccctcaactatcctcctacttaatctctacacctctcgtttaataattaatatgggtcacttaggtgatcttttcttccttttatttttctctttcacttttaaaagtacacttatatatgttgaaacaaagaaagtgtacttcctctgtctcacaaagactttatttttcagcttttggatataacatttaactcctcttatttaaaacttttctgtgattcaatatttttattgttattagatgataaaacataaataatactttatgcatgactaatttttttaaaaagattcagataagacaaatggttaaacgttgaatacagaaatccaaaaacagagtcttcatgaacggagaggagcctagtcatatagtactccataaaacttgagataagtagtgacatatactgtttagcagcttagtcctattccctccgtcctataaaaaaataggactaaatgtgacacattctaatatacgacgaatctaaaaaaaatatatttttaaatttatattagaatgattttttatgtgaccgatgaagtaatgcgtagggccacgagatcacgacatacatgccggtatcagggaatctaattactacaacgaactatagtagtattacgtagtacgtccgtgctgtttcgaggacctacaatttataatgggctgtcggccgttacagctgagctacctacctatagctagctgagctcgattcatccatccatcctctctccacaatactactgctacgtacgagttcgttttaaaatacatcaactagatgcttggacggagattttattaatgcatgattaattaagttttaattattataaatttattttatttttaaaactaacttctttatataaagttttcacataaaactcaccgtttagtggtatagacaaatttactacaggacattataactttgtggttttagctgtaggataccgcgaagtgacttttgggggaagacactctcaaatgttgatatttgctagtggacaccgctcattaaaataataattttcggttgaatagaagagataaatcgcgtgaaatataaaaatacccttgggcccacatgttagcactcctatctttcttcttttctctctcttcaaacatgcagggcgaggcagcgtgtggaggcccgttgctggcgcgacggccgtgcaggtggcactacgaggtgtgttggcgaacgaaggcccagcgcagggtaaccgcgaagcggacggcgtcgcgcctagcgacctcggtggtggcggggacatcgaacacgatgaggaacgccatctccggcgtccgctccaccgcgtccatgaaagttggtgtactagttcaccctcgagaacgccatcgccgtgtagccgccgttcgtgaggcaccaccacagcgacgtggcggcagagacgttcgcggtccaggcgagcaccgctgcgagcacaacatcgtcagcggcggcgaggagcgcggtgggggtgatgaaagcgcacacgagaatcgggtagggcgtctgatggaggccacggggcggacggaggaagacgagcgcgtagacggagaaggggagcatgaagaggagcgcatcgtggccgagcgagaaggccatgccgccggtgacccgtcactctggcgggcactcaacctgctccacaaccaccttgcgcacttaatgtcgtgggacgcgctgacggaggcactcgcgcgtctccacgacgacgtccgccgccgcacctgcacgacatttgtgccatctgcacgtccgccgtgccactgcacctcgccgtgccacccgcacggccgccgtgagccccagccagacgcaccccgcacggcgtcaccgcgagccaccgtcgccgccactacgcctcgccatgccgcccgcacagccttcacgcccgtgccggtcgtccgcacgctgcctctcctctcagagtgacgctggaaggaggaagatagagagagaaaagaagagagataggagagctgacatgtgagcccaagagtatttttgacattaatttcacgcgatttctctttcttcaaccggaaattgtccaccagtaaataggcaacatttgagagcgtcttcctccaaaaattacttcgtgcggtgtcctagaactaaaccatgaagtcgcgatgtcctgtagcaaaatttggcttgaaaatatgtgctaacaaaaatcgaggaagaacctaccccttcatcacaaacgaaatggagcctgaggactgaataacacgtcgtagtaatacaaatctatccctttaattagttgtaagttgctagtatatttcaagatggagttaatagtatattgcatcgatatattataataagcttaattagtagtggcatgcatgtaagctatggctcgataaacttgcagacgttcctcgacgtcctcgtgatgcaattaataattgttttgtctgcttctcgatcgatcaatttaaatatttggtagccatgcatgcgttgcaaaaaattggatcaacttgcatttggatcatcatacatttatatgctgttctagtcacagctagccctaccaagatatatatagtcagaatgaatacactgatggtaccaagctagcaagcaaagcgcgcagctctctgtatcgtaccttagctgagccatcaatttatcaaactcattcgtacatgttaatacaggcaagtagcacctagatatactccctccgtcccataaaaaagaatctaggatcggatgtgatatattctagaacgatgaatcatggcatgtgtatgtccagattcgtaatactataatgtttcacatctgatactatattgatttttgtgggacggagggagtgcgtattatctagcacaaataatgcatgattgtgacgccatatatattaattatctagatgattaccttatacttgaacaatgaatgtgggaaatgctagaatgacttatattgtgaaacggaggacgtactgggttttgatatctgtcggttcgctgattttttttactagctaaaaaacttttgacaggattttttttaaaagaacttttcaactttgaaatataactataagataattgtagtaaaattaacgccgttgtgtcgcgtcgtaagtttaactccctcacgtacgccacacgtgtgctcgattttttttttaattctcctcacgtacacgaatctcaacacatctcaatatggatcggacgatcaaaaattcaaaagtttctaactcatgttctccattgatggtagaatagtgttatgtctttttccttatttgctagtcaattaaacttgctaaatgaacaacattattagactaaacttgcagaaattgaatttagattacataatatattttcccatattaattagtaaaatctatactaaattatttttaataaatttaagtaagttactagaatatttgtcttatctgaacagcatgattgacatgcaagttgtcgaacattgattggcaagtgaaactaaatatatggccctatatcatcgacaatttaaaattttccgcttctcaaccataagtccataacttaaattcacacttgtacaactgtaaatgtatagtgttttttttttcagggaacagtacatatatagctcaacacaccaacaaccagcttactcaaaagtttgatatacaattaaggccaaacaaatcacctgttcctttttacccgtactacacatgacttatgacatgtttcttgctggtatacaagtaacaaaaaagaaaaagaaccttacccaaaaaaaagaagaagatgaaagcccaacatttatatgatggaccatagtaattttgaatgcacagtatgaatataatcacacacacacactgcctacgtggagagagtatttattattccacgcacctctcgttgtcgccattaattacttctaccaactgcgaccagtaaacaattaatcaatccatgtatcgaacggacacgacacagcaaataacagtggctttacactgtcgccgtcgagctcgatctacttgtcttctccggcgtcggcgacgatctcggtggtcgtcttcttgatgagctcccacgcgcttcgcacgtgccgctcctcctgcagcgacgaccccaccgcgaagcgcagcacgaacctgccgccgaccaccgtgtgcgccacgtaagcctttccggtcttgttcagccgctccatcagctcgcggttcgccttctcggcctccgcctcgccggcggcgatggcggcgccggatttcctcggcctgatcctgaagcagacgagcgcgaagttcctcggcaccacgacctcgaaccggtcgtcgccgcggacgaggtcctcgaacgtcttggccatggcgacgtcgctccggatgtgctcctgcagcttgccggcgccgtaggtgcgcatgaccatccagagcttgagcccccggaagcggcggccgacgccgacctgcatgtccttgaggtcggtgacctcgccggagtcgctggcgtggttcttgaggtactccgggttggtctcgagggagccggtgaggcggtgggtgtcgcggacgtagaggcaggtgcagtcgaggcaggtcatcagccacttgtgggggctcatgctgatggagtcgacacgctccacgccgtcgaggtggtgccggaactccgggcagatgcacgcgctgccggcgtacgccgcgtcgacgtgcacccacgccgcgaacctcgccgcgacgtcggccacggcgcccaccgggtcgacggcgttggacgacgtggttcccaccgtggcgcacacgtaggtgggcaccagcccggcgtcggcgtcggcctgcatcgcctccagcagcctcgccgggtcgaggccgtagtcggtctcggccccggtggggatcgaccggatgttcgccggatcgaacccggcgaggcggcacgccttgaagaacgtggagtgcgtctggtcggcggcgtacaccgtcagccgcgtgatgcccgccacgccattggacccgctccgccgcagcgcggcgtcgcgcgcggcgacgagcgtgacgagcatcgcctcgctggtggtccccagaatgacgcccccgccggtgccgcgcccaccggcgacggtgcggttcatgaaactcgccggcaacccgagcagctgcgcgagccaatccagcgcgagcacctccagctcggtcgccgccggcgccgcctgccacgtgaatccgacggtgttcatcgccgacgcgatgagctcaccggcgatcgcggcggcgctattcgtcgccggaaagaacgcgaagaaattcgggctcgcccagtgggtcatcccggggacaaccgcctccctgagctccttcatagcaatatcgaacggcgccgacgacgacggcggcgccgactgcagcagccgcaggaggtagcccggctcgacgccagggagcaccgggagcgactccaccgacttgtagtagtcgtagacgaagtcgacggccttgtggaggtaggagcggacgtcgtcggcgtcgagcgggcggaagggctcgacgtcggcggcgaacgcggcgtaggcggcggccgggttggcgtccaagctccccatgtgtcagtggaggatgacggtgaagctagcttagctttagcttagttggttagttcgagatgtggttgagctgagctaagctagctgatggagtggagatggtggtgggaggtgggaggggatagatggggtttatatagctgtgaaggaggaagaggaagggcgagaagcggcgtggcgaggcgggcgtttaagcggtgagagctgtggttggtaagtgagagggagagggagagaggggaggatgtcatggcgtggggcatgcatgtgtgcagcactgacgcgacagatgtaacgtacaacaaccggtgtgtttggttcacggtaaaattggaagtttaggtgaaattagaaccatgtgatggaaaagttggaagtttatgtgtgcagaaaagtttcgatgtaatggaaaagttgaaaatttgaagaaaaattttggaactaaactcggccgaaccacagcggctcgtggagctagaaaatttttcgaatacgaatctaaaatcgaatgtgacatattccagtattatgaataagtacgaatgcatgcttagattcgtagtactaactagaattaactagaatgtacttgtttgatttttttatgggatggagcgagtacgacgtcgtgcgattggtgggctaatatatattttgagtgagtttgttttgtacgctcttttttttacgtttttcgcacgcacatttttaaactatattgaacagtttgattttttttagcaagttctatatgaaaaatgcttgaaataatcatactaattcgatagcttagcacgtggtaactctacatcagcaataatatgctgattctattaataagcatgtgcgactagagatggtttttggagtgaaattaagtaggggtgggttttgtaacaaaataacttatagatattggaatgccaacctccaagtgacttatgtggtggtttttatagttttctatatatattactattgtcctaaatagcttctattaagcaaaatctattccctgtgtatgtgtaatgtacgaacaatgtgtactacaattactcctcgcatcgcatggatgcatcccttgatcaaggtagcgtgcattgtgaaaaaaaaaacttatctaattacaacacaagtgcatgcatgtgcaccctacatctactgccattagattagtttttaagacatccggccagtaggctaaattaaggtgcacaactgcacatgcatatatggcaagtcaacatatgcatgttcatatacgtacgtgttctagacgtgttgtacttaacatatgcatgtgctattgtgtccgtttgatgaatggtatagtctttttttttttttggttttgagaaaggaatatattgaagttgttcatggattggggagcatgcataagcatgtgtgagattaattgcatggattcatgagtgaatgactgatctgtctgcctttgcaatgaaatcaatagataatctgtctaccttttttttagtttttttaatatgtttcagttaccatgttcaggaaacgaggcaatggaccctcaggatattaaaacgcctgtatttaggggacatcaattctccatcatggtcaacggcgaagattcgatcaaccgctacggtaaagcatttctcactgcataggaaacaagtggcatatgtacatatgtactgtgtactgcttggttggtgaatgaagttaatttagatatatggtcccttcgatcccaaacatatgttgctctataggagtagtagtaactcctaaatatcatgtaaattgtttttactgtgtatgcattttttgaactatacactccctcggtttcaggttataatactaaattagtttcaccaaatcaataattgaatatattttcataataaatttgtcataggttgaaaatgttactacttttttccacaaactttatcaaacttaaagtagtttgactttgaccaaagtcaaaatatcttataatctgaaacagagagagtattacttttctattttccctaaataaatggttcacattaatgtatcagattgtaataaggttatgtttggatagagggaaaacaaagcatgtgaataaaaaatgtaggaaaagaaaacagaatgtaccctatattaaaattacaatattacatgtctaaaatggattaactggaaatcaaaagaaagtacatatatatattgattgcagtggtgaaaaatatggatggagggaaacatatcctatatatgcacacatgtggacacttcgtgcgccaactaattacaaattaatgtcaccggaaattatagaagaaaatatatataccttcattactattacatattacactttatgatagcttaaaactatcataatttttttatggaagttcttccttggttgcagcatgtgaaacgtgtgctttatatataattaattgattttcattaaatttccattttgatcaatctatatacttgatctcggattagaaaaaacaactagtaggactgtaaacaactggctcgttggtcgatcgctactcaagcacagccactagaataagcaaagcatcttggatcaaatataatttttcccttgtgtttaatttgctcaaggaaaatgaactggtcacatcaaagtataagtggcactctacagataaattcatggattaatttcttcttccagaataggaggacttttcccacacttttgttattatgaaatcagcatgagaagaggccaggaaacggtcaggaattgtttttcctttgggttaatcactagggagttattgtatgaaaattgagaggcaaaaattcattcacgtgcgatcgttaactgtcaggaaatagtttatgacaataatgtcctatttaatttcattgtaatatatggtttactcctaagttaattaatatgttaatttgtattctatccgaagagctgaactttttgtgaaacttaaattaccagcgtttatgtatattagctagttcatgcatataggattcgtataaacagtataaacatataatgcacagtttctatgtcttgccctactatacgagaatgcgcgtgtagatgactatacgtacaccaacctttcaattgtcagtactacaaaaaacattttagcatgcatgtaaacaaaatagatttttgcaggtggccaatcagaccgcctacgacttaaaagtcttaaaaaataatacattgtcatgagccgatagccagccacctgcaaaaattaattttgtgatgttcgtgggcgggtaagtcctgccatccgcctgtgtaaatattttcagtgctataaaaatccatagttgatgtcactccttggccagcaatggctttccgctaccaatcacagcctaatcgatccccatccagtccatagaaattcagaaacatcaattcccatcacagcctcaatcaatccccatccaacacatagaaattcctatatcaatagagcatcacaatttagcccattcacaaatctccaattgaatccattcacaaaatttccaaatgaatcaatccacggaacgcatagtcagcaccagaacaactaggggcagagaatggaggcaataacaatactgaacggtgctcactgccacccttaatttgctacctccagccggccggcctcctcccatctagcccccaccaaagctgtagtcaccgtcgacacaccgtccctttgcccctcggtggagagtgagggagggagagagggggaggtagctaagagagagtgattgagacataggctgtgtgccgctgtagctctcctcagctgtactgacattaacactgctcccacgttaattttgcaagcgaacctctttatatttacaagccacaacctataaaaatgagggtttttttttgtgggcggtcatatttttccaggagagattgtctagatcgcttggaaaaacgaaatataggtgttgggaaaaaaatgttctctagtagtgtgtgcttgtttttgaggaggctctcacatacttttatatatactcctccatcttaaaatgtatgacatcatttatttttcgtataacgttgataattatcatcttattcaagaattacataaaaattacttacttgttgtgacctttttattatctttcttatcttaacttatgcttttactgctaaacttttaaataagatgaatggttaaacattatataaaaagttaagagtgtcatatattttaagacgaaggaagtatatactccggatatactagagagagctaccgatcgagagatcgatgagaagatcagatataggaggactaacgaaaccggaggcatcagaagttcaaaacatggcgcgttcccatgggtcgtccgtcctacgtatatatatttcagtcagttaatttttttacatgtttgatttgcagcggccagcagcagcagaagatgcacgaaacctggtgagaaatctctctgaaagtccaaagtcttcacctaccaacaacactgattcagctgcatgactcgacttgcagtgcaacgtaagatatcgagcgaatcaacagatcgacaggttgactgcctgactgactcagagaaaggagaagatcagttttaccatggttataatctataattaaccaattaatccactagttaattaacctagtcattatcgatcatatcacgcgtggtgcacacgtacacatacctcaatagcaagaaaaccaagctaaagctacccctccatttgaaaaatatttttcaagcaatttatgctagcttgatcttaaccaaattaagaagcacttccaaatgtaattagttataatacaattagaaatgaaacttatgcacatttatatatatagacacatgacaacaaatatttgaatggtatatatgtaaacgtaattcaacttaattaattatcgaatttctgcctgggtttgagtcccaaactcgatcgatacggtgtctgctcgtgctagatgatcgagtctacgccttcaatcttatttagacgtgtgttaggtgtgtgtgaaatgttaaaatataattcaacttaattaattcatgtacatacaactaaattgatggcatactagacggcttacaagttattaactaatttacagtttttaccattgaattgatcaagcaacgatcggttctacgtactgtactacatatatttacagatgaatgcatataaaggaaaccactgtaactttaggtgaatgtgaactatctagtccaatattgacctagttaatctcatttatttatttgctgatcccaagctagggcatatacttgtcacacaagaatataacccttattgaggtatcacacacacaagttcatgcatactactctgttaaaaagaaaaaaaagagacaaatcctagctacgaatctggacacacatatgtccaagttcataggtaggattacgttttttttttggatgaaaggggtatgcatctgggacaacgttgcccttttttttaaaaaaaaaagagaggaagttttcaaaaaaataggacaacgttggcacagttgcggcgtttgactcttttgacatgggacataagtatatagatgcataaggccaaatcgttctcatattatttatctcttggtgtactgttaccacaattcctaataagaatctgatcttgcgtgagtagctggtcaaaggcttagatttgatggagaagtgtacaattagtactaccacatcttagaggaatgaactgtactttctgtcatttttttcttgctatgaaaagtgaaatggtctacggtaataacttatgttcaattccattgaaaaattttttagcacgcatgcatgccggctagagctagagatttcctggtagttgcaacttgaaagcatatgccccgaattgcaggacactcgtgctcttggaaaccgtctgctagctagtgtatgcggcgtgtcaacaaatgcatatactcttgatcaaagagtgtattgactaattgacttatgcacatgtcccgatgtgttttgaagaccatgtcgatattctctagacattgttttttttatttaaaactgttgctactagctagagggggtatatatgtgtgtgagtttctccaagaaaacatgtttgatttttcttttctttgttcagaaaaaaaatcttgtatatatatggccattatcgattattagcagctagtgcagttatttgctgatatatagaaagatagtgacagatgaatgactaaaagctagtatgtctagtatatagcagcttgtttgtgttctagttggctaggtagtgataggatatgttccaaacatatggatgcgactacatacatcttttgacaagtaactgctatttagtccacattttacatgaccagaagtatgtcatttagtaatattaggttgagtttggcatgcagctaagtgcttagatactacttctcacagaactatattgtctgctcttgtatattgttccaccacgagtattgcatgcttcaattcagtgttcaatagcctgttcatttgtctgctatatatcacgtgcattgtcatattagcactaatatatttctttcccatggatcgaacttaatgtttacaaaagcaattttacttccttttctcttctaaaaatgattaacattaactcatgattctattttaaaatagtcaatttaccggcagactttatggtaacaatattttgttgattttttttttcagatagactactgccttctatttgatgttgtgatgtaatgtttccttaactaaactcatcaacaatatgatttcgctgaagatatatatggtcatgactatagtaaatcgatcacttaaataatcaacgttgatctctggacctgtttggtttagtatggtagtcaaaagtgatttacagagaaccagttcaaagaaaccgtgatcgagaccagcgtgtggacagaacgtattattagatcgatcttagatttgcaagagttattattaactaataacaagatggtgaaagtagtttacattaaggactgaataaatttagaccttataaaatgcatgtgtagaaacatcatcagccagctaacctaataaatactcgcctctctaaaatatagatacttcttgaacttaaaaatttgtttcaaaatatttcgaaactgttacatgcctgactaaccacacccctcatttaatattcgccaaatttaaacaataaaaatattttcaatgtttgaactcttgaaaagcaaaaaaaaatattgatacttgagaaattgtcattaattaattatatactccctagaaacggttggcttagttaattaattaattcgtgtcacgtcacggacagcgacaaaccgatcaaaatcaccacaatttcgagtcgagacagctttcaaaatatattatataactccacgtgaaccaattaataattgacagcgtcgaattttgtcttgcagtcgcaatcaaattagaaattgttttttttgttgactcatctctatggccttgttcaacagataagttaaccaaatatacgtgtttaattagctttcaggggttaatgaccgatttgactggctgcatctgtacgaccttacaaaactagaaaacgtccagatgcatccgtctactagtatttatacaagcccttggactcagttagctaattcaatgttaattaatactagatgtttgtatttctgctaaattatgccatcaccaaaattgactactccatctcattggcgacagagtagaacttaaatttcctgacggttggaatgcatgctgtcatgaattgtttaatcagttatgtaaatttagatatcgtcattttatacacagtagatgaattaaacattaaaaaattaagctgaacaaaagcgttgacatatggagtgcgtagttgttgattcaagcttgtcacggattatatattcctgactaatcgaagcgtgaatataatactgttgctaattgaagtttcaacggcgagagtatatggtaagattaatttttttatgcatgcctcctcttcgaccagggagaggggaggtgctcgtcgatcgatgagaccaaggtgtcgaggaagcagcagccactactacaaaaacacacatacaaattggcacaatagatgctggaagagctaaaaccgatacctatagtgttttccccacctccacaggctggaaatacaaacaatcgacacctttaagtaattataagtgaaccggcacctatccagcaagccgagccgatcgagaaagaaaagccgggggcgcgaccgatcaaggggataaacacgtccttatatctttttcatctgctcttcttggcgacttagcatcgaagacgctgttgacgagccatgctgcatcactgtcgtcacgcgcactcctcaacctcgcttgtcgctattgctctgctggccgctgccctgcttctccaaggttgtttcaaaaagaaggcggagaagagagaatgagttaggatagagggaagaagagaaagaagatgacatgtgggcctcattttatttttttatttttttaataagagggctgccacgtggatggtagccaaatcagtcgaggaagggagccaggatgagtaaaataacttctcgaacaggctggtgaagggatcgaaaggagaaattgtgagtaaaaggctcccaaatcgattgagatttccattaccaaatcgaagcttctattgctacttaagacagacacttaattaggtgtgattttttcttcttgtgttgcaacagattttcttatagatcataaaaaagccactttatattgtagtaagtcaataggctcataacaaataaatatcactgtttaaatattgtccactatttggatccactctggatggctaaggttataaataccaattaatcgagagatcaataaactggtaaacagtaggtacgtaaagttgattactacttactctcgaactaatatatggattcaagattttgattgaaaaaacaattacatgaaactgacttgataccattgccaactgattttaatataattaaaatgtttttttattatactacttcttttaacatacccagattcaacaaccgaatctaccttccttctcccgtcctctgatcaaaccctagccaaattcactatcgtgcagcgattggggaacccagcaaagctaatgaccgagatcttcgaccttaattaagttcacctccaagttgctcaatgtgcgaggagatcgaagagcactcaaggtgaagaaggcgatcgagaagggaaacgagttaaataatttctttggatttaaagaatataattcgtttgaattaaatattttaaaaaagttttcaggtggggtcgacagataaaaactcatatccttaattctctcaacacattcattcttttaagttttaacctcatatatcttcggtcctatatagatctctactcactgagctgcacggcgagcggcggcgtgaatgcccacttgtatctctactctagcaacgaattaagcagcaaaatataaaccttgcgatgaagacgacctctcacgcagatggcattctatttccttgacttctctgctctggcaatggattgatgtgatttttgttattccttttctgggattattggtcagtgtacttctgatacttgtataaggcagtgatgattacctgattggttttttaattgatattttatctttttatttgtcagttgtgcgcgattaggattttggatcgatctccgatctctgagggcgctgctcggtcagacttatggacaaaaaaaaatgaaaagttactaaattttaaatagtcattaagataagataagataacatgcggacttgtataaggcaggcaacattaaggcagagaattaccaatctgacttgtataatatcagccacaatcttacaaaagctgcatcaaccatactaacaatatatatatagaaccagttcatgtgtttcacaacgtttgttatgaccatccgatgcctgacatgcaaactttctgctacattaccgaatcagcataaacaggcttccttgaaatgagcgaccaagctacactaactccaagcttacagaagcccatgtctagctcaccattgcttaaaccggctttcaatgctgtgaaaaccatctctgcttccacaacactgtcatcaactttccatgccctgacatgaactttcagctcgcccttatcttcaacagaaacaacacaccgtgaaagcacaatcttgccatcatcaccagtaacaactactttctgatcacctctagaatcaagcaggagaattctctcatcatcaacactggcaatgttcttttcacgggccaaatccttccaacgaacaccagtggtaaaggcagcaaattgaccatgaaaaccatcaggccatgacccacaaatgactcgcacgaatattgtggcctccacagatgacacgatgtagccaagtctgaactccagtgtgcttagcttgcttgtgtaagaaccagaattaagcagcatacgtgaataacgcttaccatgacataagagtggcacagctaggtagctcaagtgtttgtcctcagattcagttgtacccttcactttcagttcaacatcgatgatcacaggttccggcattgacaacacaatagcacgggtaaaagaagtagtaaatttcgttcctacaaatcatgaaactggagtaaaagaaggcataaacatgagcagcataatccgtactacagaaatcacatgagcataaaggccatggtaattttcaggaagcaattaattatatcagatcaccatgcatataacatcttcatgatatatagctgtgttaagcagcacagaaggaggcaattaaacagatcaatggaatgttaagtaaaaaagaggccagaaattaacctgttcagtgagggtttggcagttgtcccttgtgcggtggaagagaacattgcgattacgatcaacactatcgcgcatggtaactataccaaacacatcaagcggccactgtaagcccccacttgtcgctgcaaccttgacagagaagatctgtagagcatccaaggcataggcagtgaaattatctagcgcaggcttatgagtaaaacgcattgggggggatccttgctgcatgttcgaagttgtataagaatatattgaagtgagttaaagatcaaatccaattgcagcagcagcagcagcagcagcagtaacaacactagtgaatataactaactagcaagtccatgcactactagaaaacaaacaattaatagtattctggacagacacttgaaattttatagtttgattttgatgttgatttttgtggtttttcatcatggtttattttttagagccaaaatttgaattttgtgggttttctttcgtggtttattctatagtactccatctgtttctaaatatttgataccgttgactttttagcacatgtttgaccgttcgtcttattaaaaacttttatgaaatatgtgaaactatatatatacatataagtatatataacaataaatcaaataataggaaaagaatcaataattacttaaaattttttaataagacgaacggtcaaacatatttaaaaaaagttaatggcgtcaaatatttagaagcagaggaagtatttgctagataagcgtatgcataagagaatcaacagacatggagagaacacaattcatggtctggatatatcttgtagcaccaagccaccaattgtatggtgacacaaaatattacttaatttgaatgagactagctagtttacttaggaaggagggaggagatgaatatgattaatggaatggaaaacaaatgaactcactcactggcgtcttggaatgaaccatgatgagcggaatgcacatcgttccagaatttgcgatactggatagcctcccagttggattcatcctcgtcctgcgaccgcatcgtctctaggtatgccttgtcctgctcctcgatgctcttcctcaccctcgcctcccactcctccgcggtttccatcctcttcctgggtctcgacgccttcgatgcggcgtactcctccgcggtcttgccgatggattcgggaatccctcgctcttctcgatgtcggccatggtccaaaccctctccaccaccggcggcggcttgggctcttgcttctcctcctcctctaggtcggcttcttcttcctcgtcgggttggggcttgctcgtcgtcgtaggcgattccgcctccgtgtccatctccatctcgtgagggcgaagcttcggaaaccctagctctgttccgccgcccgccgctgctctttttttttttgttttttttttttttgagaataaaagtcggtaattttcattcaggagtaggtcagatttacatgcacatggagggttagcagcccacacatgaggcccaaaccgactgggtcgtgtatgatgcgagtcggcccaaactgattaagcctagcccacgctgcgcagcccaaaggagaaaaattggcccaccgttggtaacgcaaccggctgtagaataagtttatctgaggtctctttaacttgtcaacgaatccggttttcatcattcaaccagaaaaatacatcaggtcccttcactctcaaaaccgatacaaaataagtcctagttctcacgatggccacagtggtcgcggcggcggaggaggatcgccgcgacgccggagctccggggtcagctcaacagaggggagtctaaaatgggggagctgtatactagcgaggggctaatgcaaaatggtggtttggaactcaggtgatacatacattatatccaaaactataggtaacactaccctggtcaagtttaaaacaccggcaacttccattaacaaacgagcgtccactactaattcatccacagcggcaggcataagatgttctgttgctagtaacagagttcaatcatcggtgacaatccacacacaacaatctcaatattccaagttgaacacaggctttaggcctaccgatggggctttttagtaacacaacatcaataattagaataatggtatggtctgatattaaaagttttaacaattaagctaaagctaagacactaattccgtgactttaaataacacatccatatatatgcagtataattgtaatatcggccacaaatcttacaaaagctgcatcaaccatgctaacaattaatcaccagttcacgtttcacaaccattccgatgcctgaccatgcatattttccagtactacagaaccgatttagcaagaactggattctccgaaatgagcgaccaagctacactaacttcaagcagacagaagccaatgtctagctcaccattgctcaagccagcttctaatggtgtgaaaaccttcacttgttccacgacattgttatgatcaacgagctcccatgccctgacaagaaccttcagctttccaaccttctcaacagaaacaacacgccgtgaaagctcaatcgtgccatcaccactgacagttactacgttctgatcacctctagaatcaagcaggactattttctcaagttcaattccagctaggatgtcttcagaggccaaatgcctgaatctgacaccagtggtatatgcagcaaactgaccatgaaaaccatcaggccatgacccacgaatgacacgcacagatattgtggcctccacagatgacacgatgtagccaagtctgaactccagtgtgcttagcttgcttgtgtaagaaccagatttaagcacgtgtgagtaatacttaccagcacataagagtggcacagctagtaagctcaagcgcttgtcctcagattcagtggtgcccttcactttcatttcaacatcgatgatcagaggatccggcattgacaacacaacagcacgggtgggccctaccagcactaaatttcgttcctgcattgtatggaattaatgccacaaatgaataatcatggaactggagtaaaagaagacactaatatgagcagcataataaacagaaatcacacgtagcataaaggacatggtaattttcaggaagcaattatatctgatcaccatgcgtaacaggctattttccagagtgtcaataaatgaggccattgacagaattgaaaacgacaaggagaaactgtaggtacaaagactgcatgttatatgcatgcttgcacggttatgaaattaaattaggaagggcggacagctgcatgttggaggtaattaaacagatcaatggaatgttaagtaaagaaaaaggtcagaaacctgttcagtgagggtttggcagttgtcccttgtgcggtggaagacaacattgcgattacgatcaacactgtcacggatggaaactataccgaacacatcaagcggccactgtaaacctccactcgtcgctgctaccttgacagagaagatctgtagagtatccaaggcactggcagagtagtaacccagcgcaggcttatgagtgaaatgcattgggggatccttgctgcacgcaccgagttgtataagaattgaaatgagttaaaagattgaattaatccaattgcagcagtagcagcagcaatagcaataacaaaagtagtgaacataactaacaacaacaagtccatgtactagtagaaaacaaacaattaacagtattccggatccggacagacaaccccaccgcttccttatgtctataaaccatttgaatttttagaatttaattctgatattgattacgtggttcttcatcgtagtttattttatactccatccgtcccaaaatataagcatttttagcttccaatctagacaactgtttgtctagattcatagccaaaaattactatattttgtgacggagttagtagccaaaaattaaagttcaatatttaatttggattttgaaattgtttttttttcatcgtagtaattgcttgataagcataaacataaacagcgaaacgttgcacatcacatgaagagaaaacaattcatgataagcatatactctcttcgtctaagaaaaaacttaacgtagaagtaggaggacgaatttgaactcctacgagagtcacatcctcttctaggttgaattttttctcaatggaaaaacgaaaaaacctcactgacttcctcgaatgaaccacggctgccggaccatgtatcgttccaggaattgcgatacgcgatatagtcccagttggattcatcgtcgtcctgcgaccgcatcatctcttcgtatgctttgtcctgctcctcgatgttcttcctcaccctcgcctcccactcctccggggtctctatcctcctgggtctcgacgcgaaggccgccttcgatgcggcgtactcctccgcggtcttgccgatgaatctcaggaatccctcgctcttctcgaagtcggcgctggtccaaaccctctgcaccgacgccggcttgggctcttgtttctcctcctcctctagctcggcttcttcttcttcgtcctcgtcgtcgtcggcctggagccgccgcttcccgagcacccttcctcgactccgccgccgcgccgtcgcccccgacgacgaaaccttaccagtcgccgccatcttgccatcgctcttccggtcaacctccgccatctccatctcgccggccaccgcaacgctcacaacctcacctggggtctgggtggtgctcgccgccggcgagcttcgaaaaccctatatgatgcgaccgcgtgcttaaaagtcggcccagccacggtgcgaagcccaaaggtgaacgttgggcccaaagctgctcaccggatgttgggcccaccgagcaattaaacctctggaacagaaaaaagttattcctaagggtaaatttgataacgccatttataaatttgtcatgtgaaaaaaaatcccatcactgttcattaaatctgctgaaactcaaattgtgccattgccatcaggatttctgtcaacacctccgtattgaggagagaaaaatgaaaatattgcactttcatccacattatctccttcctctctcctcccttattatctgaagaagcatcccaacaactaatccaaatttgatcctccatatgcctatatagatggtaaaaaaaaaaccctccttcatattccttcccacttcaactgatcatccatattatattctccatatcacacctttctatattttagtaatatttaccaactaccgtgcacttatattatatttgaacgactatatttcatattttatctccttttctctgttattctctatcttctatgctcttttctctaatacaagtctgcagagcagtcgaggtggcccgtaggagcagaggtgcgcagacagcgacgacggatgctgaggtgggcaggcggcgcaagcggccgacgggcgtggaagtggccaagatggccggcgggagcggagccgcataggcaaaggcggtggatgctaaggcgggtgggcggggaagcggcggcggtgagcgacgggcgtgggtgtcgcgcaggagacaacgccggatgctgaggtgggtaggcggcgcatgtgggtggtgggatcggaagtggcagcgatgacgacagccggtaggcgcggcagcgacatcggcggccggtgggcgacgatgacgatggaggggaggttgatccagaacttcggatggggacgagagcgcggacgttgagatatggcgttgatgagagagaatcactatatttggccgaactctcttcgatttggcgtatcgtctatttttggaggcctcgatgccatatctactggagcaccgttttctcctccagtgcgctatgttttggatggagtaccggatgaggggtccgctggggatgctcttaggcggcacacatgagggggtggcttcaatccaactttgaactagaaagaagagcaccgacacactgggtgatgactcttagaatcctgtgtcgatcgtgcatgctcgaattcattgccggtaacctagcctcttgtcatgatagcctcgatgagatgatccgctctctactcatcaggaatgccgaagaagatgacaatattcttcggtgagatatggatggaatgggtttaggaagaagataacaaaaatcttggcgacaatggtatggttatacaactttacaaaattctagtagcatgcagtaggttttacgaatagttatgatatttttttaatatgataaatttgtaatggcatggccaaatttgcataattttaaagtaaccaaagttatattccctcaaaaaattttatctctgatgaggacttaggagtaagcatgcattaaaataatgtattcatattgacgggaccgaccgaggatcgctgtaattttgaatctatgtggcgaccactggtgatctggcaacaattactagtcggcatatcttagaagtttactactactccttaaagtcttaaaattttgatgaaataattatgcaactgtcgaatatttatgactgaagtatttatattggatataacgtgagaatacttttgtttaatttgtttaacatcccttattccaaaatattagaaatcttctgctctaaattatataaaatcatacaacttaaatcctgtggtagtatcagcagctggtttagctggcgccacatcctagtaaaaaaattatggtggggcctaatgtcaacaccatgcacacgaggtcaacgggagggggcgttggctcgtcgtctttgtcagaaacggacggcagctcgtcgacgatgatgccgccaccacccgagttcgacgcggggaacggcatgaatgccagtgccgaggtagatggagtaggaggttctggagctggcgccgatgccctctccactggcgctgacaaccatgacgccgtcaacctcggctcggcgagacgttaggcatgcatgcgggtcgacaccagtcgcggtcatagcctcaccgtccatcatcttcttcatcttcacccgcggaccaactcgaagaggccaactaagaacatcgattcctgcatcaccaatccacacaagctttgcagcttcctggagaggggagggagatctcctctcttctcttgttctgtttcttggactggtccactgtttttgggtggcagtgccattgatctggtgaatatgcagaggctggtctcttgatctgatgatggcgagcacgacatcgacgacgaccgcggtgagcggcgcgtgcacgagggtcaatacctgcggacagaggcggtcaagtgtggtgcggtgcgatggcagcgggggcgttcgccgccgctttcaccgtgaagactcgggtggggttggtggtggctgtgtgtagccgtgcacaaggcgtggttccgggtgcgaaaaagagaagaggaacatgtgagtcccaccatatattatttattgttttttatgttagctgattaggatgccacgtcagctaaaccagctatcgatactttcatgggtgggtcctatgttgcacggttggttttgtatagttcagggatgtcaattaaacaaaactcgactacagttgagggacagaaagtggacttcttcccgacttgtagatgaccactcatggtccaccgacttaagttggttgggccttggcactgttttttgggcctaaccggaccgggcacagactcattgcttatctatctacccctaatcatccgacttgcaccggcggcagaagaggcggagcggaggggatctagggtttccgagggtcgccggcggcgaggaccaccaccgcctaggtgagtcgagttttgcggtggccgtgccctcgcgagaccgacatggaggccgagcggaggagcgaccgcgaaggggactacggtggctggatggcggcgggctcgtcgtcgggggcgatggtgcggcgggagacgaggaggtcggaggtggggttggagaagtcatcgtcgttgccgccgcctttgcccaaggaggcagtcaagattgacaagaagaagacgaagaagaggagtgactacagtatcgaggatattctgaagattcttgatatgagcgaggaggagttggctgtagtgaaggaggagtgggctgaaatggaggcgaaggaaaaggaagaggcaccaaaggtgaaggaaaccatggtggagtgggaggcgagggtcaagaagaggattgaggaggagaacaaagcatatcgagagatgatgcggtcgcaggacgacgatgaatcctcctgggacgctatccagtatcgcaaatcctggaacgctagatggtccggcacccgtggttccttcgaggacaccagtgagtttgttttgttttccattcatcgatcctctgttcctcctgcctttgtagtattaacctagcttcagattgaccaagcatttttatagccattgctgttgtctgttacttcctcaatttcatattatataaattgttgctttgatttttttcctagtcaaatatttttaagtttgaccatatttagagaaaaacatagtggtaatatctccaacacaaaacatacatatcatcaaaatatattaaatgttagttttgacaaaactaatttaatgttcttgattatgtaattttttttataaatttggtcaaatttaaagaactttgactaaaagaaaagtcaaagccttataatatagtatgaaatggaggagtacttcctagtatcatgcaagaattgtttgttttctccatcgacaatagttctaattgctactccatattttgttttctccattcacaacatggttgttaaggctaaaaggcgtcctaaggcgaccccggactgccatagcggtaaggcgtaaggcgaggcgacgccttaggcactccataccaattagatgacaaataaaataatctaatatgatagcaaatcaaagatgcattttaagagcagtacaacacacacacacatatatatatatagatggttgtaataattacttaaccagatatcaatttattaactaaaagagcaccatcttataaatacagagtgagggtgcatgggggaagagcaaacagggtaaatatgtgctaagtactaactacaatacagagtgagggtgcatgggggaagagcaaacagggtaaatatgtgctaagtactaactacaatacagagtgagggtgcatgggggaagagcaaacagggtaaatatgtgctaagtactaactactaatagggagtcagggatgtaggggaggggcaggcaataaaacagagcagtagagggaggagtatagtatatgagatgtagaggagagggaggaaaaccacaacatagcagcaaatgaggaagcagagtagataggatgtagaagaggggggaggaaacaccaaaacaagcagcagaggaaggataagaacagggtagaggaaggagcaaagcaggatcacgtagagcagagaaagaaacagaggaaagtagagggtggaggaaagaggagaaagaagagcgtgcctgcttagtttttgtgtcaatggtgaggaccaggatcatcgcgcaggtgcagaggaccaggatgatggtgcagccacaggatagccgcaggcaacaactgggatcgccgccagggatggagatgtcgcgagggatggatcaccacagcctcagactccagcgaccctctttctgttgttttctccttgatttggtgggatatggcgcgtggggaccttttcaccccaataattggcgcttctgttagttctgtttcgcgcccagggcccatggcgccaatttttttgggcccttcaaccatgccctcaacttcctgtggcgtcgcctttagccattgtagcgcctaaggatgcaatatcgacaccgtagcgacaccttgggcataaagcggacgccataagcaatatggtaaggcgggccagacgccctgactcctggcagcgccttaccgctatagcgacgctatggcgacgccttgacaaccatgattgacaatactgacaattgctactttgttagttgttatgattttataaactgcagttatctgcctgaggtgtgcaatagcgcacttgctagttgtttattgtcactgttgttgttactgcttttattgctactgctgctgcaaaaattgggttaggtcttttaactcatttccaccattttacaactttgtgcagcgagaataccccccatgcgtttcacccacaagcctgcactggattacagtgccgctgccacgcctactctgcaggtcttcttcgtcaaggttgcagtggcaaagggggccttacagtggccacttgatgtgtttggtattgttgccatgcgcgatgttcttgaccgtaatcgcaacattgtcttccaccgcacaagggacaactgccagaccctcactgaagaggtatgtgtccttttctttatgaaacattcagtggcttgcttgtctcctgctgtgctgccatatgctcttcctaattttcataaccgtgcaggcatgagtactgttaattaccatgtagtctttacacccgtagtttagtttctccacaaccattgaattgtgtaacaactttatggaaaagagctcgtcaggcttggtgatcagatatcattgcttcctgaaaattactatggttcacatgcttttagatttacatgccttttgcatgcagtggaaatgtggaatcatgtacatagacagctcaacatatgtgtaaacaagcaatgagaaggcatatgataatgtctgtgtttcatcagagaaatagccatttcctagtacaacacaagtcaggctaaaaaaactaataattaattcaaactctcacacttgtgtttgagtcaactattactgaatcagtacattgaatgaagtttcttaaattaactgttaccttcataatatcatttggataaaatatctagtattaagtgatcctagggaagatggctggttctcttttcaactgtctcacactgtccctacaaattctgggtactttatcatgtacttaccacaatgcattgatatacctctttagtccacaatgcatatattctgaactgttgttctataatgactgtttgatagtttttggtgctttattgttctgaattcagccctaagaatgtttcagcttcgattgcaaggtgttgttctgagtaaagccactttattgactctcgaatattgattgtttgcacataacaaacatcttgttcgttttgccactagtacattgtgctaatatgtttctctcagattttgtgttatgcatgccacatttatgctatgtggtttttgttcgttatactgtgttgtatggattatgctcctcatatatacctcttctttcactccagttttctgattgttcatttgtggttttgcgttaatgcaggaccggaatttggtactggtaggccctacccgtgctgttgcgctgtggatgccggaacctgtgatcatcgatgtggaactaaaagtgaagggcactactgaatctgaggataaaggcttgagcaatctagctgtgccgctcttatgcgatgatacgagttattcgtacactagcaagctaagcacactggagtttagacttggctatattacgtcctctgttgaggccacaatattcatacgagtcattcaggggtcatggcctgatggtttgagtgctcaatttgctgcctttaccactggtttctatggcaagggtatggcctgtcgagacagcaatatgagtattgatgatgagagaattgtcctgcttgattctagaggtgagaaagtagttgttactagtgatggcaatatcaagctttcacggcgtgttgtttctgttgagagtaacacagagctgaaagtttctgtcaaggcatggaaagctgacaacaatgtcgtcgaaaatgagaatgttttcacagcattagaagctggtgtaagctatgctacacttgacattgccttttgtaagctggaaatcagtgttgcctggtcactcatttcgcagtatcctgtttctgccaactcggtactgtagccactggttccgaaaggttcattatagatattagtaatatacccgtgctaacgctatgataatatttagtaatacaacatatcttttaccaatcaaatattaaataagatatatttatgatttaaaaggtagagaggtctccaccaacgtcgcaccaagctgacacgcacaaagctaacaagattacacccaaacggcacaacgtcacaggttggattcaattcaaccaaacatacctatgaaattggacttggatttctaccatgttcgccggctgcctatgccacctgcgtggttcggatgagagagcggatggataggcagatagcgcgggctggaccgtcgattggacaccttcggtcatcgatctgtacagaaaactaattactacatctgttccaaaatataagcatttttagctacaaatctgaacaactatgtatccagatttatagctaaaagttgttatattttgggacggatgtagtatatgaaaatgagatagactcaattttttgacaagtgcatattttatacatatgaaaaaagcatttcgttaatacggatggagtcatccatatatacagagaactaactatatcttgtttcaaccaagtagaagctttttttttaacaaggatgtactactttttaataatagaaatgctatctaacaggatcccatcccaaccgtgatggatgggatagggcagcaaccaaccaatccatcgattctatctccttctaccgtatccattctaccacatctctctcaaagcatgcttactgctgcatgagctccggcgcggcatggggtgtagatggcggaggacgcggtcactagcgacaagctctggcgtggccgccggcgtcgagctcccggcgtggcatggctgtggatggaggacgcagcccctccggcgacgagctccggcgtggtgcggcgcgtggacagcggaggacatggccgccggcgacgagcctggtgaggggcgtggcggcagaggacgcgaccgccagcaacaagcctggtgtggggcgtggcagcaaaggacaaggccatcggcaacaagctccgacgtggggcgtggacgacggaggatgcagccgtcggcgacgacctccgacatgaggcgtggacaacgaaggacgcggctgccggcgatgacccccgacatagggcgtggagggtggggccactggcaatgacgcatcggtgctcagctcctgatacctagtaggaatcacctgatatctggtaggtatcatctgatacctcatgagtatcacctaatacgtggtaggaatcgtatgatacttgataggtatcatttgataccggttaggtttcaggacatgatacctcagagaggtatcaaaacatgatacctaatcggtattatcacgttcgaaaacaagattccgttgtatagcagccctcttaaataatccattgaaatgctaagtacttcatccgtcccataatataatagcctagtaacctcatgtactaggttgtatattatggacggagggtgcagtaaagataaagaaattgcactttggtccatatttctttacccttctttcaatttggactagggtaaagcaatcttttcattttggaccacctaaatttacatgttgtttcacctcccaagttgttgggaggtcaagctcaagcttgagttggagtatgacaaaaatggaactcgatgtaggctgagcatggctcaaagctgaagattgtgcctgcgggaagttgatcaggctgaacgcgacatcgaggctaacagcaatgtagtgtggcaccaacagagcttgaggttgaaacgacaaaggttaaggtcaagcgtgggcactggctaggctcgaggtcgaggttctgtgcggtgcctgtgcctgcgaggtccgaggttagacattacttggctttggtgatattgagaagggatggggtggagagaagagagagggagctagaggtggaagaagagacccaaaaggaaaaaacgtataatttatgtagtacaaagcgagaaaaggttgttctaactcctgcccctagtttaagttgaaactatggtaaaaaagatggaccaatatgcaatattttttcttaaaaaacaaaattcttgtagtgctagtgtactacccaacagccacgtaggcactaaatgacacgaaggccaagcaaaaaaagtcatataggagaggtactttgcacagatttgatagttgtggagaggtactcaatttgcattgattttgatagttgcagagaggtattcaatttgcactgatttactcggtttgtggttgggggacacgaataaaacttgacccatagttgagggacgctaatgaactttactaaaggtaaggtccaatttctgttttgcgcttcgcacggtggatgggcctattttatttgggctgattttagtttagagaatttttacccaaaccagtcgccacgttttcctccaccaccgccaccgcccgcatctgcagcctagccgccgccacccgcgtctgccgccgccgtcgctgcatctgcctccaccgctgccgtcgcccacgtctgtagccgagccgtcgctgccgcccgcgtctgctcccttcctctgccttcctttgtctgtgtcaagaggacggagaagatacttatgtagatgacatgtggggttcactcgcaaggggagaagctttttcaaaagccacttgagtgtaaccaaacaagcttttggcttcttcacagctacttttccaaagctacttttaaaaaagtcacagcccacagctggttttttaaaagccatagcccaaccaaacacaccctaagttcacttggtggcactcaaaagtgattgaaatctaatccgtgaccctaaactataaaaccggaaatattgaacccccaactcttaaaaccggtacaatttgactctctcagcggttttggatggcggtcttgctgatgtggtgtctacatggcatcccagtcataaaaaagttaaaaaaataaagtgggcccacctatcatcttcctctctctactaacctatctcacttctcatccggtcatgacgagcagcgccgggatgatgatgatgggcggtgatggggctctcctcacaccccggctctttccaccccgtcgctggtggcggagtggtcggatatgcggcttcctcgccggaagtcgttgatgggccgcggcagcaaaagggggttgaggcgggtggatagcttgccaaggtcgcccatggtgctggcgtcgagggcgtcgctggccaagaccaagtcggtagtcgacacgcaggagctcggtgctatggacaggatgtcggctactcatcgccgctgcaaggacgtcaggatgagggggcggcgcaggcggcgtgccccgcgcgcggaggcggtcctcgaggggcctcgagcacggcgcagaggcgagcggccacggccgaggcgacggtccatgtggtgggcccgtggcatggccgcctcgcgcatcctgatccggggtggcggtggtgctcggcaatggcccagccatctgctgccgcacctgcgtcgcctaggagcacgtttgcacccagccatctaggctcctgtcctcccgactgccaccgccactgccgccgctccggctcttgcgcacccgtcgccgctgccgttccatcgcccatcctctcccgcgcgaacaactcctccgccttggtcctcgtgatggagttgagtatccgcaacaccatggcgtcgtcgtcgctaccctcctcgtcggcgctgaacggcgcgagtggacggaacgacagccggaggtggcctcgaccccgctggtgcagttgaaggagatgtggtccagcgactcgcgagtcgtcggagaccacgcaggtaactgcgagggcgaggatgacgagcagcaacgcgggccgccgccgccgttcccctcatcctcccactaccgccagcctccatggccgagctgccgaccgccgccccctattccgctgtgccttgatgccaccagctgccgccgctgccaacaaagagagagaatataggagggtgtcaatgataagcgggccccactttattattttaatttatttgacgactgggatactacgtaagcatcacgtatccggttttgtgatttagcgttacggattagatttcgatttcgattacttttaaagatcacgaagtgcacttattcctaccactttttaataatacacatggtttttctgctaggatccatgtcgccgagttttttccagtccgatctggtagttttacacatagtttatctgttttattttaataatacacatggtttttctgctacgatccaggtcaccgagttttttccggtccgatctggtagtttttgtccgggtcactagtgaacggtttttttttcgatgtgggcttttggttgtgctgccagttggttgttttttctggtccaaattggttttatacgtgtctaacacagatggcagatgaaaattaaggtttaatttttataatagataaagatgaatattaggtaactctatttgggattcaatcctttcgtgtgcaccaagaaaaaaataatcggaaacagcgatggaaaaaacgggcccacaaaaaaccgcaacacataaaatcgtgacccacccagaaaaaaatcggacaaagaaaaccgggcccaaataaaaactggagaaaaaaccaagacggaaaaccggaaaaaaaaccgcattgcggaagtaaaaaacgacggacaaaaaatttttacggaatccttacatattttttaattaggtatagatatatatatatacaccatgttcagtactagtactctttttttaagaacttgtttaatactccgtattgtaagacttttatctcagtactccctccgtctctaaatatttgacgccgttgactttttagcacatgtttaaccattcgtcttattaaaaacttttgtgaaatatgtaaaactatatgtatacataaaaatatatttaacaataaatcaaatgataggaaaagaattaatgattacttaaattttttaaataagatgaacggctaaacatatttaaaaaaatcaacggcctcagtcagacaaagagggagcatatgggaatggagggggtactgtgagatagtaaccagccaaaaagttagtattccatgtgttactttttggctggtgtatagtgctgcaaaaggtactaaacctgaaattacaaacattaaatttatcacgatgcaagtatgcaatctggcaggttcttctactctcgatagaaacagatatgctctaactttgtgcagtctatagttgtaccactgacacgtgggtctcaatttggtatggtctatatgtcagtggcacaaactgcacaaagtcagtgactctcatcccctttggatcttcatattgctcgcacttcggggttacatcacgtccttgtcactgtccctgttatctacatatttcatctgtcctattttaagtgcaactgcaagttttcacgatattctgttttatttgaaatttctttgtggttagtatttttattgttattagatgataaaatatgaatagtactttaggcgtgacttatactttttaattattttataatattttaaataaggcgaacggtcaaacattagacatagaaactcacgactacacttaaaatgagacggagagattatatagtctcgaagagggggaatcagtgtcatgagcttgacttgggcctggcgaagggcagcccgacccgagagatggggagagagggccgtcggctcattactttttattaattatttttgtctgactaagatgttgatcccattgagatttttttaataaaaaactcttctagtgccatccaagcgccacgtagccattaaatgggatgaaaaccaagttaacatataatgtaggatgctttgtacctaatcctatcttactataaacttatcctcgactaacttcttaagcttaacatgcaaagatgcc

SEQ ID NO: 77978 - DNA, 11747 bp, Oryza sativa
ctgtactctattctttgtcatggttctctcattttcccctatgagtttttacatgacaaagtttttaacgaggcagcatgtatcattgtatcctgtgatgatatgaacatcaataaaggtcattactatttttaacaaattcttttgcaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattacttttttttaaacattttatttccatttttaattttttttccttatacatttcctttgtttttttttttaaaaaaaacactgtgcactgcaggctggcggcctgccttcacgggccgccgtgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctataaattgaagtgctcgtctcagctgttttgtacttttttgttgttatatcatactaggattatgttgatttagtactggcaagaaaacacatcctctgcactattgtgttctgattttaagtggttgctacgtactccctccgtcccaaaaaaaaaaaagacaaaccctggtttccgtgtccaacgtttgaccgtccgtcttatttgaaaaaattatgaaaaaaattaaaaagataagtcacgcatgaagtattaatcatgttttatcatctaataataatgaaaatataaattataaaaaaatttcatataagacggtcagtcaaacgttggcacgaaaacctagggtttgtctttttttttggacggagggagtaggtcacacatttattatgctcacatgccagaggatccctccgtctcaaaaaaaaaagataaatccaggtccggatgtgacatattatattacagcgaatctgaacagaggtatgtccagatttatagtactatgatgtgtctattactgtgttggttttttaatgagaccgaggcgtctcaaaatataagtatttttaaactccgacacgatctctgagatgttatttaactaagaatatatataaaactaagatgttgtaaatacaaagagttacatatcatgatagtttatttaatgataaatctagtaatatcaattttacatgattaatcttttttttctattaatagttaaacttaaaaatgtttgactcgtcagtcgtcactatgctaaaaatatttatattttataatagagtattaaatactctcccttcacttgtctagagttcaaaatttgaatagagatcaaacacgtcatggcaaatctttaaatgatgttacaccgtatataaaagatatttacgaatgtttcatcactcgatgaaataatgttttagtaaaattattataaatgtatcattactcaatgaaaaatgtttcatcacttagtggacaatgcttcaaatagatgcaacattggaaaaaaaaaacagctacttgcaacatcaaaacatttatatgtatcaaataaaatacatcgctcgtcgtatgcaatatctaatcaaaaagtcaaaagaggatgaaacactcaaatacaccagaagtgcaacaatgttactatccaccttcttcctttgctccaatgactggatccactttctttctctattatggtggctggatctatcttcctcctctaatccgatgatcggatccatcaaagatcaccatttcttccaaaacataggccgagtttagttccaaaccttttctttaaacttctaacttttccatcacatcaaaacttccaattttttcatcacatcaaaacttttctacacacaaacttttaactttttcgtcacatcgttccaatttcaacccaacttccaattttagcgtgaaacacacccatacccccactccccccccctacccccacatttagatatatatatgctagattggtttccattatcaaaaatgcagaccaacgctagcatagatgttggactagggtgcattcctttggccaagtaggataaggttttcagtcccacacaaaacaagaaagcttattaatgcacgattaattatatactaactaatataaatttaaaaaaatgagtttatttgattttttgaagaacttttatatagaatagtttgtagggaacgaaccattatattgcttcgttgattcgattccgctgaaaaaaactcaaccatttccattagagtatctgtctacaaatataaagaattttagaatactacttgtcgatagttgtttcactagatgtgatcttgtgatatttctagatcgagtaaactcaagtagtaatctcaaattaaccttaaacttttcttaaataaaaccagcaattcctcatatttgtgaaactaaaaaaccctgaatctttgcacggttttcaaaactaatgtttaactattaattttacacggtacaaggtttgtagtaacaaaatcatatagtcataggagagcaaattcaagaggcaatcaaataacattgttttcatcgaatagaatttaatttatatttgactaattgttggtcaaatgtttcaaaatctaaagagtttttggaagcaagttaatcccagcaccagctagtcctcccgctcccagaaatggcagatttcatgcaccttctcagattcttacaggagatgatgcctcgatcacaaccgggaaagaaaaccacaaagcaggcttatacatttcatgattcaaacacctgcttcgtctcaaaaccagacacctctacaaacaacatttttttctttagctgaagcaaaagcagcacgactaaaaaaaaaaagatcaaacgcatagcagcatcggctttttctacatttcgccgatgacgaggttgctatattttctgatgatatgtgcagacattgctgaatttcctactactccactacgatctcaggcagcttcactatgctgtggctgcagcaactcctgctgggcctggagcatttcacatagctcctgcagcaccggctggcctggctggtatgatgatccctgtgcaagctcgagcaaatgtctttacctttgctggtattgctgcaacagtttctgctgatgcagtcagttggaggtggagcacaatctttcggcttcggatgatgtccgcaatcttcggctttgtgttcttcgttgtggtgatgctcatggtggtctgatgattcttcgatcgagatcgagtgctcctggactggatgagtatcattcttgacctgatcatgaggttcatggcagcaatggttgtggtggtgaggtggttcagcatggcagtcctttacttcctcgacctccaggttgtcatggtcatggtcatggcaggggtgcaaatctgcggtgtgcggagtttgctgttcatcacagcaatgatgctcatgaacctgttcatggtcatggcaagcatgcttatcagcgcaatgcgagccgattggctcgtcacagtggatatgctcatgctcatgctcatggcaagcatgttcgccggtagagtgcagagcaacgggttcttcacagtggctatgttcatggccatggcaagcatggtcattggtgggaggcaaagcgttgagttcttctttgcaggtgctatgctcatggccatggcagtcatgcttcttggtgtcgtgcagattgctcgtatctgcgcagtggttatgaccatcatggcaagcatgcttgtttgtaatcagctggttgcttggctctttgcagttgctatggccatggctgtgatcatggcaaccatgctggttcgaagaatgcttgtgggctggctcttcgtgatggttatgctcatggtggtgatcatgacaagcattctttgcaactgatgattctttgcaactgaccattgatttgcacggaccatccgaacaatggtgggaaacgccatgatttttctttgcatgagatccatgatgagaagaagaacagcacttctttggagatccgtgatgagaagcagcacatttcttcgcctttcgactgtccttctctctcagcaacagcatgctgtacatgatcaccagcaagcatgtgccaacatctgcaaggacggctgcccagataagtggatgtccggcaaatgcaagcccaacgattgcaagcttcgtaatcaccgagaatatgatgttcacgatgattgtccgatgcgtcctccttgccagccggacagcctttggaatcctgcggatgtcatttgacatcagagcaacgtggcttgtctccattgcaacagctgaaccagatacacccatagagactccaacatcagctttagccaatgccggggcatcattcatgccatcaccaaccatcagcgtagggccatctttttccttgagttcaccaacaattctcactttgtcctctggaagaagttcagcatgaacctcagcaaggatatttcccagctgccagaaaagaaaaacaagagcaaaattagatgctgtaatatgcaaaaccgaacaacagtaaaaacagccactcacactgaaaattattttacctgattctgtgcatatgtggcagcagcgctactatcacctgtaagcatcactgacttaatgcccagtgatctcagttccttgatggcctcagctgatccagttcggcaggcatccgatagagtgaatactccaatcaattcattgttacatgccacatatccaatggtaactcctttcatatctttcatgtccggaactacaaaaaaaaaaaattaaaaagataaacatgagagttacaaaaacgcaagactgttcaacaggatatctcaaagatcatgttttggtcaaaagaaagtgaagcaaaacctctattcacaattactagttctacttaatattcctgaggcagaacaattttatttactgttggagtgatatttttcttatttaacaacaaattcaacagtgactaaccgtaaactatcaacagtgttctaccacatttaggaagccttttaatttcaccaacctgtttcgcatgaagctcttgacaaaattcttttgttcccaatatatatgcctgctccgtcgatttcaccataaatcccctcaccaggatatatttggaattcactaacattctctgattttggttccacagactttgattgagcataatcaaccaggacagatgccatggggtgacttgatctgctctcaacgctcgagaccctgtgatatccatataattaaatgcaatacacaagaagaaattttaagtgaaagtttcgacgagtctcaccagtaaagaagttgttgcaatgaaacacgttcaccaactggctggaactcctcaacactgaactctcctctagtaattgtaccagttttgtcaaaagctgcaactttgatgctagccaaggattccaggacatctcctcctttgatgagcagccctgtccttgcggcccttagtagcgcgcagaaggtggcaatgggtgtggacagtaccagtgcacatggacaagcactcactagaagaactagagccaattggaaccagtgcttaaggttatgtgctttcgctattgcaggaattgctgctactgatcctgccatgacaacgaccgctgcaggtgcaaacaacgtaaacagtaagaaacccacctgatccaagtttttggtgtctaaatttttactaaaagcctagtctcttttatttagcttaccaggtgtgtaatacttagcacacgtgtcgatcagcctctgtgtactggatctgctgttttgtgcttcttcaaccaaccttgccattttggccaccgcggagttgtcagccatagcagtcgtcctcacagcaatgtaacctgatacatcaccagtacagaattgatacagaatcaatagcacaccttgaaattttaggcatatcagggacatcaaatcaactgacagttcatcatatattaccgtcaatgttgagtgtgccagcccagacctgggagtctggctgcttggacactgggaaggactcccccgtgagggtgctctcgtcgacctcactacgtccatcaacaacaacaccgtcgattggaatgacttcccctgccttgacagcaattactgtattgaccttcacatcccgggctgcaaccacctccccggtctctgccagaatagccttttgtggtgccatgctcattagagctgacatcccagcggtggcctacatgccaaaggaacatttaattacagagattaagtaaagagaacaaatataactaataccaatatacacatgtgtgctgactattattgccttttgaagactattgttttagtagattcaccttgctttcctagatcatgctttatatacgcattatgagtgtagatgcatgtttgagtccactagatacaaaagtttatttgtctttcccttgacaattttggggtgggggtatatgctaaaatgatgataaactgataactgatgatatatgagtaacatgggcctgattctggtccaaccagttcatcagtccaccaatcagtggggctagtgcacatccaaatctataggcccagtatgctgcattagcatgaatttgtgcccataaatgtgacacgtcataaacaatagatccttctcggttagtggcctgatcatgacctcagcaatcaaacatgaatagtgaggcaaaataaaatagctaaaagagatggaaatagaccttgtggctggccctagtctcaagccattcagctgtagtgaagaggaagacgatgaacccagcctcagaatagtccttgagagctattgctccagcaactgcaccaaacaaaaaaagtaagtacagacatacaaaactctgggttttgtgttgtcatccatctcctaccaaaattgcctggatttaatggcatgtagaaagtaatctacccataggtgctggcaagatagcatgggtcatccaagataagaagatagtgccaaaaaggatatagaaatcacccggcgaaaaaaggatatagaaatcatggttcatgataatatttgttaaaatataagatattcacatatacaatttgccttcttcttagtagtaccaataaaaccccactttttcacttcacttccgtgtcaaataaaacattatatacagaaatcatttgatatattcacctaactaagaaaaccagaaatgttgtcaacatacgacaaagaaaatttgcactttccttttttttttaccaaatcttccaaatctttttttctttttgaaacaaggtatttcttgtttcttttgatgattctttcatgtatcccatattcccatatgcatatcacaatagagctatctcaatgccacgatattagtctagaaagaattattcgaaatatgtgtagcttcttgataagaaatatgttgcttgttctaaaaggaatctgatgccctatctgaggtgacatcgccacatggaggaaaagaagcagaattgttcatctagcacgtatattagcatcacagcaacatatccttttgatgtgatggaaagtgagggaccctctagaaaagaaaagaaagcaaaagtttatgcaagtgagacataaacttttgagagatggatttctgcttctgctctcccactaatcacccaccatattggtcctcgtgaagaaacttgcttttgtctctttttttttcacaacccattgtcacactggtagaacaggtatcaataatacccacaacttcaatccgtagttgaatatttacccaaagtggtgttgtatttgtgtcttctacacacaagagaatactatggtaaaaaaaggaacaagtatactgttgcccttttaatacagaaaaaaaagcttcaaacccatggcatcaacgttaaaactcaatgctctactactaagctgtgtcaataatttgttttcttatttcaaatgagactattcaattggaggatatccttaatggcagatgtgtttgctaccattcgatactatttaaacgttcatttcttttcaaaaagtatggtgggacctctgcttttcatttcattaaagagagaaagtaggttttggtacaagccaaaatgcatgcattaggccaccagatgaaggaagcctatttaaaattttataattcagttatctcctaaagatcaaagggtcttcgatcgtcggaggtgatggtcagggccatcctccaacaaaagggagcttctttttttttcaaggtaccaataacaggaaacatcattaatgtcacaggtgaattataggctgttcttaccagcaatcagcatgagtatgttgacatccagggtgagtctccggatggccgcaatgctcctcagcacgatcggcggcaagccggcggccgcagccaccagcgcgaaccacttgagcgggtgccagaaatgctcgaacagcgacacgaccagaagaagtccgcagaggagaacatacgggctcggccatttgttggtgatcttctcactgccgttcccataagcccgaaccgacgcctccaaccttgcctgattcagcgccttgactgaaaacagcaaatatcaaaatcaaatcaagctttcaagagttttgtcatgctaaaatcgtgattgattttactgtccatctgtcataattggtatacctcctcaaggacagtaacatttatctaaaattatgtaatgactgtttcaagaaccaaagatgaaaaactggcggtttcattgagtgtgacagtattgtacagtaatcaagttccttaattctcgtgacagaaactgcaaaattagcaggatttcgggggtgctgaggtcagaattaacgagtcaagagatatgtccaatcgtatcagtaattgctccctgcgtcatgaacaatagcgaccactgccaagacggttcacttgtcgctagcaaacatcccattttagtagagttggagtatgaaattttgcacttattttctgacatggtaagtggtccccagcctcgagccatgaaaacaaacgaacacatgacaccacctttgcttggctggctagttattgaatcaagcaacgattagaaatgaaatttattgtgaacaaacaaacaaacaaacaaaaaaaaaatacagatactggaacaactcatgaacagcaagaacagaatgagaaacgcaagcaactttgcgtgatgctttccatcgctcaacacgctatatatatgttaagatccaatttttcttgcgataattaaagtaagattctgattaaactagcaagaacagaaataaaatcatcgaaaatccaatgaacaaacaagcagccatgacaaagaaaataaaaaagatcgttttcttcaaattactgagactctggtctggtctagtctcgtgtgacttcttgacccacccaaaaactccacaaatcccacaagatggctcagtcaccggttgcatgattggtatcattcattgatcacaggacaatgataagtgacaagtcaagatggaaggagagatcgatcttaatcacgaaagggagatgaatcaatccactcggaaagcaaaaaagaaaaaaggggggctctcaccgatttgggattgggagatggcgtcgacgtcgtggacgacgatgaccgtcctggagggaacgatcacggtgaccttctggacgccctccagcggctgcagaagcttctcgacgaggggaacctccgacgggcagcaaatccccagcacgtcgaagtagctcttctgacacctccctccctccgccgccatctctcctcactctctccctctttgcgtgcctttgccctctctctctctacaaacctgaagaagcaagaacaagaacaagagtgagaaggacacagcagcaaaagcaatcttggcgtgtcgaccaacctgtcctttggttggtttcaggttcaggaatttttacttcttgtcagaccaaaaaaaaaaggaaagaaaatgagttcagtgaattcagttctccatctcacttaccccccaccacaacacacacttcttccaacctccaaaacctcgatcaatcgatccacccaactcccaagaagaacaagacgcaggtaaaacaacgcaagaatctctctaccaagaatcgtcgtcggcggcggcggctggaggaggaggaggaggaagcaagaagagattggctgtgcgaatcggggataggaggagacgaaggtggcgaggaggagtatttattaaggattcggtgacactcggcagtcggcagcacgcatcaacgagatgtggacgatgacgaagacaagcatcaccgccaccgctaatggcaatgccgagtgattaatcacctataaatctataattaccagtgattaatcccaaaaggaggtagaagaagaagaagaggggagattaatttgcattgatgattttgggggaggggattaataagggaggaggatatggattatggttaactactactactagttggtgtacacgcgtgtttttgcaactgctcgatcgcctcatcaccgtccacgtgtctaatctctagctagcacgacgcacacgtctccaacttattagcactaataataatcttttacctttaatttttctttttgggcagaatccagggagataaaaccgcagatacagcatcgcggatctctgtccacctacattgaccaaaaatgagttcaaggttttaacactataatccagggagataataccgcgttgacggtgttgtagttgtggttttcgctcagtttttctaattaattagacactagggtttggttacgttttctaattagtgggacactttttttctttgtataaaacatcggcaacagtctaaccgttcagaaaaacagtataatcacaaattgacatatattacccttcccttaaaaccttttttaaaactttttaaaatagggataacacgtgagtatgaaaaaatgggttttatgtttgtctaacagatgttttcgcgcaattttacgtggagcttcattttgaaaaatagaaagacatttatatacaaatcatatacatttatggcttatggtcgatgtttttgtcttcttccgcttttttttcttcaacctccccactactagatatggttccttgtttgggtaaaatcataaaccaatttagtatttattgcagtaagcattgcggtaatgtttaaattatgatacccacgaatgcacttcttctagaatttcagaagaatcaaaatcatatttcagaacaatgtagattatattacaagaaaagacgaataaacatctcaacgtagactccatgcctcgtgatactttagatacaacaatacatgaacaaaaagcgaaatcattgtttggttcgataattatgttttagaaacctatagggaaaaactttgctagacaaaaaaatgatctacatattggtgaaagatgtgttttccaaattaaattaaaaaaacaattagatcgtttctatctatctacctacat

SEQ ID NO: 77979 - DNA, 554 bp, Oryza sativa
ctaaaagttgctatattttaggacggatggagtatatggtggtcttcagaaaaaaaatcatttaggatgtactttcattgttactaaacacactataccagaactacttattttatttttctaaataaaaaaacaagctgagtactttcttagctcaacatatatcaactgcaaatctgaaagtaaaagacaatggaaataggaagccaataactgaacctacctgtgtgccgtaccctgagttatagcagtccataacaggttgagaggctagaccagtttcttgaaagcaagattgccacgcgttccatttttgagtcagcgctaaatgctcaatgcaattaatgaaagggaaatgctgttcctgcattcagaagaacagatactggtggcacttcagtgcattgtctcaaattctatcgatgtgagcaatagatgagcttggcagatctaccatatgctcattcatacagtacatcatactactactatatagatggattaaatgccagcatgttttgtcacataattacactacaggacactgaactatt

SEQ ID NO: 77980 - DNA, 6342 bp, Oryza sativa
atagattttttttttaaaaaagaaaacattgtaggggaatcccccacagtaaatgaatttatataaagatcaaaagaataaatttacaataggcttaaccaatccgaaagaaaattcctatctcctagaggtaatctataaataaggatataaaggtccttcttaaagaaacccctccaagaagaaacagatggaatcacaccatcaaagataagcccatttctctgattccaaatatttcaaaccacatagagaattttttcaacaaagtgccaagaccgataagtttgttttgcttaaagcaacatttgctcaaaagcaagagatacatcccagactattccaaattgagcccaacactgagagctgaaaggacattggaagaaacgatgcatgaaggtttctctaattccataagaacacaaaacacaagttaaatcactgttcacaggtgcacaatgctttctatctagcatatctcgggtatttaatctgtcaattagaagcagccatcgaaaaaccttaactttcatagtgcatttacttttccagatccaattcagataaccaggagcttgaatatacataaaatggattgcatatacttttcaagaagagaaagaagagttttcccaaacataactccgtaagtctctatcatctgaaagttgacacaaaggatcattagctgacattaccaaatattcctgaaaagcctgttctgacgttggaagcatgaagagttgtgacagccccttagtagaactcataaaaacagattcctttgtatttttagcgaaagagtaagctcttggataaatgactgatctaatcttgttgttccacagatcatcccagaataagcaggattttccatcacccactttacatgaagaaatccctctaaaaatgtctgcaaactacatcacatccctccaccaaaaagagcctctctgggaaacgtcatgaggtactttatcaatatagtaagaaaaccaaaccagcttaacccatggaacagggtgcttattatagaatttatgcagatttttcattaacaaagcattgttctgaagcctgagatcaattacccctaacctcctcttttctttggctgacaaaccgtctctcaaagtaccaaagaatttttagtagagtttatatgagagcctctccataagcaatgccttctagctcccatgaaattccatgtatgtacataaaattttatgggttgactgtgatatatttcttatatagaaaagtataggcatacgaatcttaatttgtttgtttagttataaatagagcaatagttatattagaaatcaaatgtgtagcatgtagcttaatcatttcaaaattataattattaattatttctcttttcgctggatagctaaataatatgaatggggagaggaatgaagagcgccagttcaagctagtgggaggagcagacagtgatacgcatgtgaggggacggggagggggagatgaagaatccttattttctttgagatatatgtattgggttcataggtggaggcgaaagtagatggaattgtttgcaaatgaatgtggtgttcaataattgttaatactatttggtgagaaaaggcataatacggtttaagtgtgataaattgttaattaaaatattgttaatatgtgatgtaataattttttcttttattatagataagatagatgtgctatgttttaaataaccatattgatcgtttgtttttctcgatgataggtgcctatgtacgtacgtgccctctttttttttatctactgtgtgtttgcttttttcttttttgcattttcttctcctgggatatgtacgtacataagtttttcttccttttttctggtgaatgtgtacatatttaattatactagcataatacacgtgcgttgcaacggattctaaataatattcattgacataaattaaaatccaaaaccatatattatagttgggcataaatgatgaaggaaatataaacgtataaataacaacatcaaactacaaataactttgttgggaatgataattcaatattaggaaaattatatgacttaatcctattttcaaatttagctataaataatttaatatagagaaaactataagttacaataatttttagtggatcaaatagtgctaaatctaataatgtaaatgaaaaaacaacttaaattagttagaaattgaaaaaaacttcttttagcccacgtatgaaaatctgattcattaattctgaacgggtgcttgtttcattgatataaattagaatttttcatgttctattcatactccatttgtcttaatattatgtgagtagtctaggatcatggttggatagactaagaaagaataatgcccaacataagctgttcattgttttccctagctcaaggcgagaaacaaaagaggagggaagatgggtgtcggtgctccggcgaccaaacgatggtaaggaaagtggtaggatgtatcccacgatgtgactcgttcataaacggtggaggttggcaatgaagaaaccagaacaagagggatgcaggggggcaaagagggagaaacgacaacgacgagctctagtggtgaacacaactggatgagtgtgtcaaaactagttcccggacgagaggattctgttttccttgaacacgcaggagaaaccaagtaatattatttatcgtcttccctaaccaacacaataaacaaaagagaagagaagaagggcaacggtgctccaacgaccaaacggcggtgagtatggtggtcgagtgtgttccacaatatgactcatccaaagatagtggtggttggcaacgaagaaaaccagaacaatgggcatgaggtagtcaacaacatggtcccgatagagagaaacaacaacggtgatctcttgtggtgaacatgactgagtgagtatgtcaaaacatgtttccaaacgaggaggttccgtttttcttgaatgcgcaagagagagggaatgaaggggatgttggtgatccttaaatgataatatttgaccgtcaatacctgcagataatgaaataaaatgtggtatccaactagtggtagggattattactaatcaattccactagtgttggtgaaatatgtgtatgcaggtattttaaggagaaaacacacccggcatacaaggaaacacacctctggccaatcagacacaagcacacggattggagggcccacaagtcaggtgaaactgccatggaacaagacataactgccataaccaccatcagggcccaccaatcagtgaccccgccaaaggagaggccaggaggtggggcccacggttcggccgaaccaccacaaactcccctcatcctggccttccacgtgtacattcctgacgaagtcccaatgatggttgagggcattttggacatttcccatagctataaccgttatatagaggctataaatagagctcctctccctcacttcaagacacacaactttgagctgaattacaagaggctctattgtatcttttgtacattagaaatagatggagagtgaggggaagctccgggggagtacccaaatacccatgcattgcaacggattactgagatagtaaaattaagtccttgttgaacaaatatatttttaattggttgaaacaagacctttcatcctaaaaacaaacaatatgccatgcctagaaaattaaagagctgagtctacaaagtacaaattcacccaaatcctaatatcattgcccacatgtcaatcatgtggcggggggcaaactcaccaacagcactactatcttttaataagtgctataaatatgatttctaatgtattggatttactatctcaattggcaaatagttggcagggaaactattcatctttcaattttggacacctatcagtttcgcataataaattataaatacttaaaaagtggccacattatcaaagtatgttgcatcctagatataagaatcaaactatcattcatcataaagtaaccattcaaaaaatattgagggtccaagaaaaataataaaagtcaatagtgccaaatatgtgtaacatgagggaggtagtactagttgtctgtcctagcactgctctaccaccggccttcttgaaccatgatctttagagctaataaaaaatgactgacatttgacacaacacatataatcataaatgtaattaataaaaagaagatatttcaacaatggcaaatttccaccagcagctgcactatgaatagctctagaatcacacgacatgtctgtcacctcagtttttgatagtaagccctcttatccactgaaacagcaacctttgcaaagtgaccaccaatagaatcactaatccaatatacatacctgtaaaagagggaaggctgcacatgtaggcattattaaggagctcatttactagggatgggtctgcaaacaaaggataaaatttagtctgcaaatatacccgttgtaatctaagtactgaagataagcaatttcaggtttaatcaaacttacagcagtttcataacccattattttaaccaaccatttcagcgtaagagaatttttcaaaaaaatttgacatcttcctgaaattgatagacattcctcgtatcccacatcttactatttgttgtgttccactgaatttagaatgataataataaggctaaaatggtcttttcatttgaaaattttctcctgattctcgtttggatttgagacttcgttcgaacaaaattttgaaacgtaacaagcaccttgtcgagttccttgggattctcccacttgtgtccctcggcgagcaccttcttgaaaatgtcgccgtacttgcagatgtccttgacactagcctaggaaagcagctcgacgtcaaaccgcagcatggcgttgggcgggatcgccggcggcgggccgacctcaccgaaggccagctccgttttcggaggaattggcggcttgcttgccgacgacggagatggcttttctgctgacattgttgtcacttgccgtttcccactgggcatgccaaaagcgtgttgatgcgaaaaacacacactggcctggaagatctgcttaacttcaatgcaggtccaaaatcttgcctttaggttcgtgagcgtgccagttgatttgatcctgcaatcaacaagaaataaagacaaaagaaacctcgggtaaattcataaacgatagctgatcggccagtcgtcgatgacatatcatttatcttcaagccgatgtcatatgtgaatcgatcggcagctataaataagcaagataagactaaatctactcgatcggctgtagatattaacgctatataatccttctgtcgatgtatatttaaaccaagtgattgggatagatcagacgccatgccgagacagtataaatcacttagattgaaatatatattaacataaagattataaacacttatagcatagccgatcagatatatctaacatgtatcggctagtactccgataccactctgcgttaagatattaaaacagaaaatatatcaaacagaagcctaatatactttattacgataagatcttaatataaagggcagatttagcatatcaatcaaacatataagacatgaagctaaatcaggtaagatcggctgaaaccctgatactaactctctcgatgatcataaaacaagccagatatcataattataaataccacttaatagatcgaactcaatcgatgtagcattaagcataaagacaagtatgagatctaagcaagatgatgaaaatctataagagatggtagatacatgatacaatctagattaataacaaaaacataattctaccgattgtttcctaacgataagaaccagtcaataacaagttatatagcgtaactagcatagattgcaacatgtatatgataactcgacggattacataaaccaggttaaagtaccataaagatggaagcattaaccctgagaacgcaagccgccataacaagttttacctctagttgaagatcgaatcgatgcagctcaacccgaaagcaagaactcgtcaaaataaacgaaagtaaaaagggtggctatgcgccaagattgtattgaacgattattaattgatttcttgggttctggtcatatttatacccaagatacaaaatatgtccttgccggacacgacacttaactctaacaaactctaagataccataagtctttgcggcagatttttgcccaaacatatctctaaggaaattacatgaaatatcctaattaatagatacaattgccttatccgaaagctt

SEQ ID NO: 77981 - DNA, 1744 bp, Oryza sativa
taggatttaaattctacgttttgtatcggtgcccacgaatttaaggcatgtatttagtgggtatgcatgcgcccgcactatggggggtgtttggtacctccaacagatttaaatcatgtcaagaggatgtgcatgtgtgtgtggcctaagtgtaatgtgtgttgagtgtccaacaaactatctcaaaaacaagaatgaaacaactcgatgctagcaaagttagaattctcaacataaagcaacggatattggcaaacattcaaaagagcacatgtaagtatataggattatgtttcgtaatcagaaatgatttgatttcaggtgagattataaccttaactactagtactataccatattgaaaggaaagaagtcttcttacaaaaagtgaagaagaatagggaattccgcttggagaggaacgactagggaagtattggactaaagtcaagatctactaaagaatgaaaagagcacctaatacacctatgtggattagactaattcttggaacttcttcaaacaatttgtgtttgccagttttgaggcaaggagatttttttagataatggaagtttttattgaactcaaccaatataccaaggtgacacaaaagcattgagcacattcccgagatgaggcaaggggattgctttcacaaatgtctacctcttcaatgtcttgaatgcaataaggtatttaaatcccctatgcaaactcttgttcagtttctcacaaccattttcatgtaaactctttgccattttagttgaatcttcatctcttttcaccagtagtccatgattattgattaatcccctcccccctctcatatcctttcctttatccataagctgacattcatatttaccctaccatatacatttcttatattaaatctaacattcatttaaccatgtaattgttcataatcttgatggggtgacctttcattattgtttggatgatcttatcctttatgaaggttgtatcctacaagaaaatgattcaaataatgcatgttcttttctttgattatcccttgactagataaatgaaatagttcaaccaagtattaattacccaaaggttgtcataatgtcatcgacatatatcgatttatcccattcctatcttggcttctttttaattcctcaaataacttttttctagaatttatctggagatggttcacaattatgaatgcctattttcaagtggtataagtcaaaactacctctaataagtaccatactagagatggctttatgaattggtcgtgtttgctcaccctttaattaccatccgagtcattaattggtctctaacaatatttcaacattcccgcccatgaaatttgaatttctctcttgaccgatcaaaaacttctttaaaattaccggcccaaatatcctcatctcctcacctatcctctcctctctccccctcctccacccgcctcttgtgatgtcatccttctcctccactcctcttatcctcctctcctcttcttctccgctccttcaagggaatgatgagtgcatggatcccaatgaccttcaccaggtaacccctccttgcctttccccccttgttcatgatatgctttggatctctagatttttgtttaggtgatataatgtactagactttggatgtttaaaattagagatagattttggtatggctatggacacatgaatgttcggaaggagtagatcaagagtgattctactccattctg

SEQ ID NO: 77982 - DNA, 5629 bp, Oryza sativa
agatccggtcgcctgtcaccaacgcatgccgccgaatctgcaaaggaggggaggagagccgccggatcgtcacggggagggaagggagggagtgcgcgccgccgcgcgtcgccggatcagccgccccctcccccggatctgcaaggggaataaggggagggggcgggcaccgccggatccgccgcctccaagcccccctccgccggatctgctaggggaaggaggggagggggcgtgcaccgccaccgctgtcgcccgtggcggccaccgccgcctgctctcctcccgccgccgtgcgccgtgctgtcgctgtggaggggagagagaggcagggagagagaggagaggagaggagaggagtagagtgggagagtggttggtggagcgggcggtgggaggtgggttaaatggtgggcccgtgcggggtgtgcggttggcttaggacgcccgcacgggaaaatcaattttcccgtgcgggcgacaccccaccgccagttctctatttttctatgcggttccacttacgaaccacatggaaacaaaaaggggggcgtccaggaaaatcaatcgtttagtagtggttaattagcctttattgggaagtaaggaagtctaatgatgcaggctcgagacaataaccatgtgtttcttcatcaggttcagaatacaaagatatattagaaactaaatcttctagcattaggtacatctcttctctctctggatgattcctatcttccacaaggaaaggaatacatgaacaatatccttcacctcaatccaactacaccctggctccttttttgcattgatactcaatcttgttcttgtttacacttaaatttggcacctgtggacgaaataggggaaaattgccaaagtttgaaaagtgacggatttccttcatagggacggtcagaccacaggtgtgtgggcggtttgaccggctaatagggccggtctgaccgcaggtatgtgggcagtcagaccgtcagggtccgagtccgagtctgttttcgtcgggtctcggatttccttactcgggaaggcatgtttcgtgtttcctttagtttctatctcgagttggacgtggagaagggcctgtagagggtaagaccaacccctatttaagggacaaggcaggtttattgtaaaacccccgaatacaatctacttgaatcgttcttttactatgttttctattttaccctagttttagtccatctttgtcggtttgtgccgtaaaccgtccgccgccgctgcgagagtgtgacacctctttgtaggtttgtcctgaaaaccttccgttttacccacgagacgggtaattatcctcatatcgatctaaatcagcatagaggctgattttgatctctaaatcggctccgctagccggtttatcttttctttttacaaaacccatcttgatttggccctttggcttgatcgaggtggttggcgactccatatcaccgcaaggcgtttaggtgttgcgatcgtacttgtcgacttgtcaaaaaagttgccaacacaatttttggcgactccactagggaacgatctaatcggcatatcagggccgaatttcgtttaatctaataattactgttcatcaaatcaggagtttcggctaaatagctgaaatcaatctacactgtaattgctatcgctacgcactggttcttttcgccgaattaatccgttcggcggcgaagttaattatctggtcgtcactgaatccatctgaatacttgccgtccagcacgccgcgtataccgaggatcatcgtcaggaggcagaagccggctcgacggcctcgtttctttgtgtttcatacggcaacagagaaaagatcaggctactagagccgatctaccgagcaacagcagcaagaacattgtttccttttattgctacacactgttaccgagaagaaataggaaacagagcagccgatcttatttcagatcggttaattttgtatagtttgctacagtaccgaagttactgttacgtccagaaaaatcaacaaaggctagttttaataaaattggctaaacacaataacatatcaagaccgtatattaatctattcggtcagcgatttcggctatgatctgtatgaccagatttaatcaagaaatttcttcattaactataacgagcgggaacgagctcaacaatgttactacacaatacattaggaccgatcaaggcgtcgtgaaaggaaacgtcccgctacctcaagttgtagtttcaccgaaggtaacctccgattcatccaacccatactttgctattcaaaaggttaatgatcattatgtagatgcatatgctatttctagttttgctcctatacaatatgcttataatgctatgggggggcgtcaatgggtgattatacagccgattacacaggaatcggctatatgcaaaacctagctaacggtatgaccggtcatgacactggtctaaccgcatcctatgccgttcagaccgtacctaccatagccggtcagaccgtccatagccggtcagaccgtgccctatttagccagatcggacctcctgtggccggtctgaccgcaccactgatcaccggtcagacagggccatgggccggtcagaccggtttcctgggagtttctccaggtttttataccacgactagcagtactgattttaattattattcatcacctgttaatactgttagtcatactattccacgtatccctaatgcctacaatgatattaataggggatatcctcccgatactaggtatggccaatataacaatattgtgccgcaacaaccaccttttaggccaccaagtccaccaccagatccaccaaagcctgaaactgcggaggattggtttagaaatactatcagagagaatttcgcaaagctaaggaatcgtgctagggagtaccaaaagccgtatcctgatttttatgatattaggcagcatatcctgtgcacacgggagtaaagctgcactcgtgtacacatgcgtccggatccgttcgatcgacatcctacggccaagtctcctagcgtggcaattttacgaatacacgcccgcctcctccacttctgttttgcataacagcccatctggtaccgcctcttcagctgatctcgttaatcacggcgctgatatgctacgcctcttcagctcctcttgtggttccatgcgcggcgcgccgccggcaaaatatttcatcgagacgaaggggatcgttgttttactctcagatgtcttctgttcatccgaatctggtgactacttcgaatcattctacaccatcaagagacgaatcattctactacttcgaacctgatgctacggtatttttagtttctctcattcatatcgtcatatacaggctagttagggatagctggtgctggcgtgcggctgctccaaattgcatacatcaagagacaagattagattgcactaattttcgttcagactagctacagatttccataacctgacaagtacactgtattgttgttacttctccgcttcccttacacgtctagctcgaccaacaagatcaaccgcacacatataatgctccacagtttgaactactccatagctttccactagtgaacgtgcacgtgcaaggcacgttttcgtaatatatattattgctgatcatatatatactgatacattattaaagaatcgtcatagacactggtaaaaataaaattattacattggtcattcatgaaataaacctaatttgttattttattacatagcaatggaatggaaaaaatgtacaggacaaaaatgtgaaccgattccatcacacatccaatcaataccattcaaaatcatagctagtcagttagtggccaagttcagtttgtggaagtccacatataaagattcaaagtgtagacctagaaggtgtattaatcagtgaccaactgctatagttacatcacaatatatcccagaaaggtactgtaaattataggacaacaagagattatatgaactgatgcaaacatattgctgcagaaacctcagctccctgtcggcatttccttagacaacaagagattatatgaacagtaaattgtaggcatttccttttttttttcctggggttgccatcatctccttgtctatggtgctttactttttgcaaaacctcagctcctcaagtgcacctgaaattgagaaaacatgtaatgttatactgtatcaagatgcaatgcagtagataaaatttagggacatctctcttatacagtcaaataaaatttaactggacaataaatctctaggatgtaccaggcgctagttgaagacccaaagttcatgacatagccgaaaaaatatactgtaacatgcagagataaagatatattaagaagatgataaatcccaatgctttcatggtagttttgcagtaagtatatatatagatacatacatattacagattgtgaagtatcccacctccacaagggtcatttacagtaagtttaataatcgtcagttataccatgttccatagtccataatataattgagttgtcaaactaatacataatatatactgtagatatgaccatgcatattaatgatagaaagcaaatagtctgaaacactaataaaggtcttcagataagttgaaatgatagcatgctagcatattgctggttaaaaatggctaggaatagagagcacaataaacatatcccaccatgatcaagcaccaacttcaatcagatcggtcaaccttgttttttcattattttacctcttgtgaaactctaggcactctgcgcacagcacgggcgcaggtggcggaggggcacagggctgccggcggcggcgcacggcgggctgggcgcaggtggcggcggggcaaggcacaggcgcaggcgacggctggtggcacaggagcggatttctttccctctcgttcccttcttcccaacctatccagaatattcttgaccgtttgctctcttttactgagcctcttttacacgctgcatccaacggcaggggctgaattttggttgcatccaacggctcatataaaacatatgacgtggcttaatattatttgagaaagcttgttgctttcacatatttagatatattgtccatcaagcaagctgctgacagcttgagagtaaggatgaatgacaacacacagctcatacaggagaactgagaaagcatcacctatagaaacaacaccatgcctgaaattgcacgttactcatcctcgctctggctacagttttttataagaaaaagtacgaatgacaccccccgaactatcgtgttcgtccgaattaccctcctgaaccacaaaaccggacattcttcacctcaaactatgcaaaccggatgaattacccccctcgacccaatccgcggtggttttggactacatggcgtacacgtggcagttcaatcagcattttatttataaaaaaaaagtgggacccacatgtcactctctctctcctatctctctctcacacacacactctctctcctctcggcaatggcggagtcagcaagcgcggggaggcgaggcgagccggcggcggcaaggcagtggaggaggctagcgg

SEQ ID NO: 77983 - DNA, 2469 bp, Oryza sativa
gcctccccgccgccgctcgcctcgcctcgcctccgcgctcgttgcctccgctgtcgcctcaccgccgccgctcgcctcacttccgcgctcgctgcctccgccgccgcctcgcctcggctccccgcactcgctgcctccgccattgccgagatgagagagagagaaagtgtgagagagatagaagagatagaagagagagagtatgacatgtgggtcccacattttttaaataaatagaatgctgactggactgccacgtgtacgccacgttgtccaaaaccaccacggattgggtcgaagggggtaattcgtccggtttgcatagttaggggtgaagtgtccggttttgtggttcaggggggtaattcggacgaccgcgatagttcagggaggtaattcgtactttttccttttttatatgaacctgacaggtggcattccactattcataactaagaggtcaacaacgtaaggcaacattgcaaagcaatactgtttaatgattcatacaggtctcctatgtaactacctgagccaaaactacaaaaaagaagggggcaagaatttttatctgggtcatgaaagaactggttcataatgacctataaaatcatataactctacacagatgctgtaaattcacaagcaaacaaataggcactgtgaaagatatttcgaaaaaaaaaaggtcaggaagaggcaccctacccttcatcaaacctcaaagcctcgagctacaataatcatattgccatccatccatgtacaatctgagcaaaagacagggcagtgaataagtgaacagtgtgacaaccaacaattgcacacaccatgttcaaatcaatccacaatgtagtaaaatacttttcagattattttttctcaaatacacatttcagattatgtatcataaaaatagtttcaatatagtaaaaggcataggtagtactgaggaggtttcatacatctaaaatattcacacatagatctaaaagaggtttgaattatcaaatagaaatcgccactcacaaccatcaacttgaaagtcccaactcctaaaagccaaaatctatagaattcaatattagttcgattgccaggtttctgaaattgtaatctctacttctgtcagtcagtcccagtaacaccaagttgaaaatgtattaatgaggcggcagtgaattaaaagcaagtccaagccaacagaacatcatgtatatagaagtgattccttgcgtaagttgaagtctacatgagcaatgaacaaatataattgatgtttgcatgactcagatattaagcaagataggggaattatggaagagttgagcaccttctttttctgttacaagaatttttcactcagacaaaattcttctttgataacacttttactgaacccagtccatatatatatatattttttgaccaaacagtagacacgttagatgtaaaatgacccaaatcggtcccccaaaaaaaagagcagtaccgctgcttcaagaacagccacattatctgtggctgtgataagagatctcgcttgagactgcggagatagcggccgtcggagtacagttggtcgtcgtcgcctcgtcgcccggctgcgatcctctgctggctggccgttaatgtggcggggtcgatggtatatgctgcggtgtgagcagaccccagctctctttcctctccgtcgcggcgcgagcagggaagcagggcagctccagcgggaggcggcggcggcaggctggaaaagctaacgcgcacgtacgcgttggcggcgagcgtttccgattgtttagcctaattaattaagtgattagtagataatgacggtaattaagatatgattttttttttccggaagatttttcatactaaccgattgaaaactttcaagttagatttgaaaacttttgaagtcaaattttaaaaactttcaaaactcaatttgaaaattttcaaatcaaaatttaaatgtgtaatacaaattttgaaaactttcaactcatatttaaaaactttcaactcatatttgaaaactttcaactcgagatttgaaaactttcaagtacagatttgaaaatttttaagttaagatttgaaaaaatatgaaaactttcaacttgagatttgaaaactttcgactcagattcgaaaactttcgactccaattcgaaaactttcgactcagatttgaaaactttcgactcgagatttgaaaactttcagcccaaattcaaaaactttcaactcgagatttgaatactttcaaatcggatttaaaaattttcaagttaagatttaaaaactttcaactcaaaacattttgaaaaaaataagtgtgctaaagattaaaaaaaagtaatcagaaaaaacgaaaaaaaaccggaaaaaaatcgcaaaagaaaaaggaaaaaacaaatcgcgaaaaaaaaagaaaaatgggctaatgggcccggaggcccg

SEQ ID NO: 77984 - DNA, 7164 bp, Oryza sativa
agatcagggcttgctacagcatgaagagctcgggtatgggggctcgcacaccggtgctgtttggtgggcaacggagacgacggcctccttcctttcttctgtagaggctgtttttctttttccttttttcatgttcaaaatgcttgtatgctgtgttcacttccatgcatgttaattgaatctagtgaactctgaataagcatttgaatcgatgctcgaaaatttggatgtggatttgaatctgtacatgctgtgaaaatctgattttggggatatttttggtgtaatttttatcgcaggcggctagctatggttgcggttccattttgattatttttcttcgaaattattttcgctggcgggtgtcattacctaccgccagtgaaaccaaatttttgctggcggccgcccaccgccagcgaaaacgaggaatcgctagcgaaaatatgttttcgctggcggtccacataaggcagccgccagcgattcgctggcggctgccttatatggaccgctagcgaaaattgaaattctctagtggtttttcgccaccagcacagatgattcattttcactggcttttgctttgtggcggctccaaataccaccagcaaaaacctaaaatggccgccacgaaagatagatttcgtagtagtgagcatcactagaatgctaggttcatagaacgaagtttgggatcataaaattagcggcacaggctgcaattgtcatctcttgtttcctcctgatgcttctcattctcaacctctcctacaatcagttctatctttctcctagtagtcaatgggatttgtgatagcttatttcagttgttgttgcctgagttggctctcttactgacgtagttttttattggtagagatctgaggtatgggtcagtgaacatggaagtaactatacgtagggtgtgtttagttcacgtcaaaattagaagtacggttaaaattagaataatatacgtgtcgaatataatagtcctatttggttacggttagacttggagttggaatagatgtaggatagagttagaattgaactctctcataggctctctcttaaatagagaagggggcaccacaatgtaaccatggcgactataatatagcgtagacatgcagggagagatggcggcgtggccatgaacttgtagtggctaggagctatattggttggggaggagcgcccataatcagagccccggggatgtaggcttcggctgaacatcgttaacaaatattgtgtgttcctgtgccgtcatctggcatgtcttcggtgatcaatgactgaagcgatcgggaaggttagtcgtcgttccactatatcgactaagttttataacacgatgtaacggaaaagttagaagtttatgtgtgtaggaaagttttgatgtgatgtaaaagttagaagtttgaagaaaaagttaggaactaaacaaggccgtagtacatttggattaaatggttgtatagctataggcgtgtcccatggtttggttggtggcattgagggtcaatatataaaccacatgttttctagacatagttatatgcagcaaaaatgcaaatgcaaaagttgttatgcataaacaggccctcttccaaaaaaaaaggtacatgtcatgtattttagaagccaaattaagcttcacatatatgtatgttatatgaagataaaacagaatgcacgtgcatgttatacttttgggcccctagcatatactctactagggtattatattgcaaatttattggttccttatcttatggctatgattaggctgcgtttgtttgcaggggttccaaactcctccctctcattttccgcggctacgctttttaaactactaaacggtatttttttgcaaaaattttcaatagacaagttgctttaaaaaaatcatattaatccatgtttcaagttagttttagctaataattaattaataatatactaatgtgtttctctgttttctgtgctggaaaagaaggttccaaaccagcacaaacgaatatagcattagttacttattggttgcactctgcttactggtagcagtgcttggaatagtccgagagatgatgatttagagttcaatccatttcatacctttctaatgcaattcaattgaattcggttcaaagtttgggcatcttcagaccttgagatggtaggactggatgttgttggtgtgccacgccttttaccgttaatttatagtaggagtatacggtacaaaaagttgctcctggttcattgtgaatctgtgccatgcaattggaatgtcgctatgtatagaggaacactttcagaaactgatgagaatcaagttccttgatctttacttcctactccctcagtttcacaatgtaagtcattctagtatttcttacattcatattaatattaattaatctagataatatatatgtctagattcattaacatcaatatgaatgtgggaaatgctaaaatgacttatattgtgaaacggaggaagtaataggttaggagacatgggaaatctggtaacttgcttatgaattaatgagcagaatgttttagagagagaccttgctggggtgttcacatctgcatttctcgcacactgggttgcttcgaggaaattgcagatttggagaaatgtaatgtcaataagaagatgcatcaaccgcgattcggtagaatttcaattgaagatctgctgcgcattttgttattttacttatctactttgaccattccctaaaatttcaaccaagaagtatttgagttatgctaaaattttcaataaaggaactacactaggggatccatatattcatgtagtggtacatcatgtgttaaatgatgttttatgaagagctcacagtaaatgtgggaatccgtgagaggattttatgggagttaaaactaccattaaatatcaatcttttaagtttttatgtagttccttcacagaaaagtaatcgctgctaaagataacttggctaaaagaaattggaggggagacaagcaatgttgttttttaatatgtaagagactattcaacatctatttttttattgccacgttgcatgttttgctttgcaatgagtcttttttactttcaacatccccttccttgtaatgctaaaaatatttttggtaattggctaaacggagtgtcaaaatcaattaaaaaactggcaagtgttttacgctggtcattctggtgttgccgaaatgatatagtttttcttaaaaaaaaagtctaatacaatgcaggttattgcagaacaccctgaacagttcacgaatgctataacagatcacagccattacacggttgtattgtgcttatgattagcgcaatgctacacttctaaaaaaccatcataaggatcggcactataggtgctggttcatttaaaatcggcacatactgtcttttccctcctctatgggctaaaaacaaataaaacaaatacctttaaataactataggtaccggttctataggaaaacagacacctacaccttaggtgcctttttttaaaaggaccgacacctataatttattaccggtatcgattaattaaaaccgatacctataataaactattggtgtcggcgcctatagcaaactgagccgagcggagctctcacgctggccttatccattccagatggcctttatctctctctcggatgcgcttctctcgaactctctcttgcctcggcagatcggggcgggtgagtgcctccactagcagatcggggagggggagggctgcagccggcggatccgggcgggggagggctgccgccggtggatcgggggaggggggagggcacgcaacagccggaggatccgagcggggagggccgccgccatcagattagggcaggggagtgctgaccccggcagattggggcgggggagggcggcagcgggcagatctgagcaggggagggccgatgccgtcgcccatgccagcccccgccgtggccctctgccgccggagtccgcgttgcgggcggcagcgcccactcctaacgccttttcgtcggccgcgcccgctgcccggtacctcccgccctgccctagcccttgcatgccgccgccgccgccagagtcagcgttgtgggccgctcctggcgcgtcctcgtcggccgcactgcccaccgtccgctgcccagcgcctcccgctcgggcagagaaagacagagaggagaggaagagaaagagatggagaggagagaatgagagagagatagaggtgaaggaagagaggggggggggaattattagacgggagagagagagaggagaggataagaagtgaaaaattttgaagtggtgaggagggaaaaaactgtaataaagaaaagatatttttgcatgcggaccctcaagagatccgcatgcaaaaatatattttcgcacacggatctttaggaggtccgcatgtgaaaataggctcatttttaaatgcggccccttaagaggccatatgcgaacatagagggcaaattttgtagacgccgccagttacactccatctacaatctaaaggggtcctcgtatagaaagttcatttttttatagtgaaataaaaattaataagacaaatgatcattttttcctgtcaaataacttttagaggagtttgttgggacaaccatgtgcctatgtttgaaaagttactgaaggataaaatatattctcttcagcctgatgctggtcaatttaaagggaacgaagcggctgaggttttcatggttgcatccttggaatggacatgtaactaaactgttacatgttcatatgtctctgaggacagttgaacaaagtaattcgttcacaactcggtgctatgcgcttaccagggcttgagaggcattaggaatggtgaaaccacattggcgagtggaaggacgtacgcaccctgttgtacgtgaaatccctgagcggaggagcaaccagatccgacgcccccctccgtcgcaccgaaggtccccgccggaacagcaccgcctcagccttcctcgcagccgctcggcacgacggcggtctgctcgggtgtcagcaagaaaatggagtgaggagacgagaagccgagtgacgacacgagaagtccgcggcgttccacggttaataaccttctgactttgaattgtttgattgtgaatacacgttaactgggctgtagtcgaattcggccttctttacactggtggagaaaccatctttggtcggtcggccgaaatctacaataatctcagttccactaaaaacccgtctttagttccggttcaaaaggttaaagctactttttgatggcaggtggtgtcagacccctcctttatctttagtcacggttggtgacaccaaccgggactaaagatctatttttagtcccggttggtgttaccaaccgggaaaaaagatcgacatgcgcggtgcgagatcgagaggactgaggcgcatgagaggatcagttaataagttatgaccttttatctcctcatcccctcactcaccccatgtcttcctcttcctcctcccatgtcttcctcttcctcctcaggatccgcctccttccctctcctccccactccgccccctcccgtctcctccccacttctcaggcggcggcggtggccaggcagccgcgaaggcggcctcgcgtggccgggaagcgcggaggcgccctcacgcagcggccgggcggcgacggaggtggcctcgcgcgccctcgcgcggcggccgggcggcgacggagttggcctcgggcgccctcacgcggtggctgagcggcgaggaatagcgcgcggcgggcagtggggcagcacgcagcgtgggcggcgaggccgcgcacggagcggcagcgcgtcggctcttctttcttttttttttataatttgtgattgagagatgtgtaatttcttttttagaatttgtgattcattgcatggatctgagatgtataatcgatttgtgatgcatttgatttgtgtgtaatttttctaagatttgtgatgtatttgatttgtgtgtaagtaacttagtatttgtatttgtgatgtgaatgatttgtgatgttactttgaatttggggatttggagtttgatttaggtatatgcatgacactcgatttggggatttgttgtttgttctgggtttatacatcccacttgatttgagacaaaataaaaagaaaatggaccaaccagaactgcccctatcctctctttaatcccggttggtagcattaaccaggactaaagatcgatctttcctcccggttatttcacccaggactaaagatagcgatctttagttccagattcgtagtcccggttggaaaactgggactacagggggttataaaccgggagtaaagatggtttctccaccagtgttagttccaaagtttttcttcaaacttttaacttttccattatatcgaaacttttctacacacataaacttccaatttttccatcacatcgttccaattttaaccaaacttccaattttgacatgaactaaacacaccttttaaaaaaatttcgtacaaaagtcaattaatgggacaaagaatcggcgtcatatagaaaataaatgaagaacaaagaatatcttacagttaacacttttacagcatggtatctatctattttatactaaaagtccatcaaacttcctacaaacgctctcaagccgccacgtgagactcctataaacgcttttaagtcgccacatggctctctaataattcaaataaaattataataaaaagaaaaacatctaactgtaagtttttatttaaagtggtggacccaataatattaatcgttggatcaaaactaaatatcttctcaccctttctctccggacccacaagtacgtacgtacgaacttatgcttctattagctcgatgccatcaactctggattctccctctctttttttttactaattacaaaatacatgtgcatcataatttgtgatcattttcatggagactgatctgcctcggtgagctcgattgatgccatccagatcctaattctcctttttttttccaaattacatgatacatgtacaccataatttattatcataaattattagttcggtttttttcatagagag

SEQ ID NO: 77985 - DNA, 6826 bp, Oryza sativa
ataggccgaattcgagctcggtacccctctataactgcacttgtattcaactgtggttttgttgtttagcaataagatcttatgcgtgacatgtgcgaaaatttctttatagtaattttttctcttcatgcacaaatctcaaggcaatccgatggctacaaatctaaaagtttcgaggacaaaaacttgtgaaagttttctagcaattccgttttgacaattttatgaaacctcaacattttggtaattttaattatgaaaattaaatactattttttaaaaaaatataaactacctccattttttaatatttgatgttattgactttttaagaaaggtttgataattcatcttattcaattctttttataaatataacattttacgataaattaagtcccaataaaataaatgataattacataattttttttgaataaaacgaatgattaaacgtatatagaaaagtttatggtgtcatacattagaaaacgaagggagtatataataacttcgagcaagcactgcacgtgacaaaaacaataaacaaaccctaaaaaaatactgtagtactacttagttaatatgccggcggtgaaagttagggtgtgtttagtttacgccaaaactagaagtttggttgaaattaaaacgatgtgatggaaaagttggaagtttatgtgtgtagaaaaattttgatatgatggaaaagttggaagtttgaagaaaaagtttggaactaacaaggccttagttgagagaactactccgattgtaatatgatgatatggatgcatcattgaaacattgatgttgatgaaaattactggtaatgtttggcaaccgtcaatgagatgaaacgacagactttcgtggagctgaaaaattcgatgaggtgatctgagtgaatgtctggcaacgcgttccccgggtcaatggcctcttccctccctcagatgcctattttttcttgtctctgttcaatattctgctcatgctagtgagagaaagataaagagattatactagtaataatacagagagagacattgactcgtagcagactcatgccctcactatcctttgtttgcacctctgaatctgaatgtttttctgttccatgatttttgcaccatcttcaagtattagtagtacttattttcgtatgtttgcaattgcatgtgccgttcttcgtagactgggccgaaatttgttttacttgtaatgccaagttaattaaccctcctcgtggaacaattcctacttgatatattaaaacagctcagtcataagcaaggacattaccattgaccacagaaaatcttccctcagaaacattttaatcccatgagtaccttgttatctgaagttaggagacgacttagcttctctcaacatttttaattagcagagttcatctgttcctccgagattcttgccatggcacatctattgtaattgaaggacaaaccatttcaaggtaggaatttactgctcaaaacaaaatccaaggtatggaattcgaacaggaccatgcagagtgctgaacattttaattgccttgttatctgaagttagcagacgacttatctgaacatttttaattagcagagttcatctgtccctccgacattcctgccattgcacctgctgtaataacttcaggagaagccatttcaaggtacaatttattgctcagaaaaaaattcagagcaaggaatttgagtaggcccttgtttaggcctggtttagttcctaactttttctttaaactttcaatttttttatcacatcaaaactttcctacacacgtaaacttccaattttttttaaaactttcaattttgacgtggaactaaacacagccttagttcccaactttttcttcaaacttctaactttttcatcacatcgaaactttcctacacacgtaaactttcaatttttttctttaaactttgaattttagtcaaacttctaattttaacatgaaactaaacacaccctaggagtcctaaaacttgtgagctatcacgagcagactccatttctacattccatttgaggagaagccatatcaatgtctgtctcactacattccagtagagaaggcagccaaagcagccacgcccgtgtttaaaactgatgaagatgaatatagatgaatattaaattgacttacgtaaaaaaaactattagcacattattaattaagttgtaattcttacaaatttaacaaacgaatatatttgatattttaaagtaacttttatatataaagttttcacacgaaacacactgtttagtaatttaaaaaacatgctaacagaaaaatcgagataaaatatgtatctcaacgagaaaagagctgagggcctgaggcatcttcttggctccgggaagaagaacacggctcgtgactcgtgattgaccggatcagtgtcaccatgcttgtcgctagcaaccttagcatagagacgatcagtgatgatatatgtatgcgaaaatgcaaagacaaaagagagaaaaagaatagtccctatcacattggatgtttggatactaattataaatattaaacatagactattaataaaaccatccataatcttaaactaattcgcgagacgaatctattgagcctaattaatacatgattagcctatgtgatgctacagtaaacattctctaattatgaattaattaggcttaaaaaatttgtctcgtaaattagctttcatttatgtaattagttttgtaagtagtctatatttaatactctaaattagtatctaaatataggaactaaagttaattgccctcgatccaaacaccacctgagcagcagctgacaagagctcgctcgaaatgtatgcgaaattgtccctgtcgatccgacgtgcctcgcaagctctgccattgacttctccagcgctcttgtagcacaccaccactgtaccctgccccttcttctgcagcgttttgttccatcttgattattggattctactgccaggccctacatatttcctccttagaatcttttaagatttttaagatttttcttctttgtagaaaattccagtgtttgattggttggtccacggttgataagctctataataatgatgaagtaaccaaaacaaaattggtagtaaaaatatgtattcttatattatcattagcggtttaaaactcaatgaaaaacaaactaagacaaacaaaaacctaaattttaaaataagttattaaatataaatgttagctacggttgataagcaacaagctgatagggagagtgatgttcctcggagctcagtggtgttcacctggttagattatctaatcctaacttgatttataccatgttagttggtagtcagtcaacaattagattatgtattgaacttatggtaaattttgttctggttcgaacttatgggttttctttctttcatcctacgaaactctgtaccttactactccgtgaatattttagcagtagccgtgaatgttcttaccattataattaaatatattattattgtaattagtacgtgacatttaatttaagaggtggttaattaatggataatgagcttgatggatgtccaaagattagtaaagcacactagcactctgcttaaccatttcaaccaatatccactaaaagtgacagtactttgcctaaggcactaacttaaaatatttgagaatattttacttttaattgagatatcctttttaagtcaacagagtcaactgccttgaaaaagtcattagtaaaaggcaaaagcgcgtgtccaagtcaatccatacatatccatcatctttaattttgtgcttagtgttagaccatagttttaggccatcgttatagctcatatcaaccctacctaggtagctagtaatccattctcccattaattaatttctatgtgcaaaatttatacccagaagtagttattgttcctagagtttactaaagataatgacctcattcatctaatgatgattataaaccttattaccaatgaaaaaaataataatttgtaagtaaatcatatatgcttgtgtccttaacaatccaaaattctgaaaatcaattgtaagaaataaagtttgatgaaaaaataaaattaactttaaaatacagttttaaaatgtaaattttgatgatggtttataagttgtagccttataggacgaatgatgggagtataaatcatcaggacaatcaaccatagcatccaactaactaaaacaacgggaggttctactactaaactagccactaataatgcaatcatgacaaaccagcaaaggaataaacttattactaccagattcatcaaaccaaaccttggacgagtttaccttcatcccatgataagcggtaaccatgagatttgttgtggtttcaaaactaaaaaattaccacacgtaatatataactgtaataaccacacaataatcacacggtttcgcaaatgagtaagtagtcccttcatctcagtatataaataatttgaattagatgagatatatcctagtattataaatggacaaagttagtactataatttatcacatacaactaaagtcatttatattttggcacgaagagtacctgtattagggttttttcgggaagcttaaaattctgagaagttagctagtgagaaagaagctgaaaaactcagcttatgacttctagtttatttttcagattctacagttatatattctcatcctctaaataaaaagactataggagcttccgtcaagtagcgagcttccgtcaagtagcgattaaacaggccctatgaagattagcgagggaaggagtgtggtgggccccaccaagcaggagaggggggtgtggggcccaccatgcagggccactcactccaccaccacaataagagaagacgaattgacaattccaccgccgcccgcactttgctttgcttccggtctccggtctcctcctccaaactccggtcggtctccggcgcggcgcagccgagcccccaccatacgacgcggggaggcagacgacggggcgccgctgctgctgcccggggagccaccgccggtcgccgccgcagcagcagcagcagcgtgttcagaggagaagggggcagcaggtaccttggggctctgccgcatgccgctgtgggggacaggctcgtccgcggcgtccgcggcggcggagggcagcgcggccggaggggatggggcggcccgctcgtcgtccggcggcgccgcggtgatccggtcgatgctccccacccgccgccgcctccgcctcgacccgccatccaagctcttcttcccttgtacgttcttcttcttcttcttcttgctctggtttcatggcggttgctctgtccaaggatttggttagtttcaatcctttgttacagttttggttggattaattggagagtctcctttgctgcgcgactgcaattgtgttcttgatttgcttggctcggacttagtcagaggcgctgtgtctttgtttctcttcgcatactgatttgtggttaagaatagtctctgctttgtggcgacataaaattctcacttgttcttctgtttccgctaagaaaattggcttcttgtttttttttctctttcaaaaacctgcgaaactcgaaaaaaaattgaaacgaattgcctatgattagtatgttgctcgtaaacggaatagattgaatcagcacggttgatggatacagactctttgcttgtgtctgattttgccggaattgatactgattgctacagatgagcctgggaagcaagtccggagtgctgtcaagatcaagaacatcagcaagtctcatgtagcatttaaggtaaattaacacaactcctctctgatggcttcttcatcaaactagatgctataccagtggttttgcaaatgatagtagttaccagtaactcagtaagtagtagcctagcagtccagctgctgttatttttaaaggtgcagctcagattaatgatgaaatcaatactctcaacaactcatatttgaaggtgagctatattttaggatttaatcaatactctcaacaactcatattgaaggtgagctatattttaggatcatctgttaatttaaagatgctcatatttttaacagatggctatgtattgatctccaccataaaaatctattggttcagtccccacttacacagtagctactaataaatcactaatttgatgcattccttttgttctagttccaaacaacagcaccgaagagttgcttcatgaggcctccaggtggtatacttgctccaggagagagcatcatagctacaggtaatgcagagtggacgttcacctttgatgtgcattcctgttttttttttccttcgccttcctcactccttgcttatgtaatggtagtgttcaagtttgtggagcatcctgagaataatgagaagccattagatcagaagtgcaaggttaagttcaagattgtcagtctgaaggtcaaaggacctatggagtatgtcccagaactggtatgttttcttttaatctttagcttgttcaaaagttttaattttgatgcttaatgcgttctcagttttgaaagacaaggacttatagaattacatcccacaccctcactagtaattcattcatattacctgaagttttagtgaccttgatattaatatcaattttttttcacctgtaacacaaaataatacagttcgtttgttatgaacctccacatattttgtccattttagcagtgcatggtctaaagtgttacccttatgttacagtttga

SEQ ID NO: 77986 - DNA, 3538 bp, Oryza sativa
acgttcttcttcttcttcttcttgctctggtttcatggcggttgctctgtccaaggatttggttagtttcaatcctttgttacagtttgggtggattaattggagagtctcctttgctgcgcgactgcaattgtgttcttgatttgcttggctcggacttagtcagaggcgctgtgtctttgtttctcttcgcatactgatttgtggttaagaatagtctctgctttgtggcgacataaaattctcacttgttcttctgtttccgctaagaaaattggcttcttgtttttttttctctttcaaaaacctgcgaaactcgaaaaaaaattgaaacgaattgcctatgattagtatgttgctcgtaaacggaatagattgaatcagcacggttgatggatacagactctttgcttgtgtctgattttgccggaattgatactgattgctacagatgagcctgggaagcaagtccggagtgctgtcaagatcaagaacatcagcaagtctcatgtagcatttaaggtaaattaacacaactcctctctgatggcttcttcatcaaactagatgctataccagtggttttgcaaatgatagtagttaccagtaactcagtaagtagtagcctagcagtccagctgctgttaattttaaaggtgcagctcagattaatgatgaaatcaatactctcaacaactcatattgaaggtgagctatattttaggatttaatcaatactctcaacaactcatattgaaggtgagctatattttaggatcatctgttaatttaaagatgctcatatttttaacagatggctatgtattgatctccaccataaaaatctattggttcagtccccacttacacagtagctactaataaatcactaatttgatgcattccttttgttctagttccaaacaacagcaccgaagagttgcttcatgaggcctccaggtggtatacttgctccaggagagagcatcatagctacaggtaatgcagagtggacgttcacctttgatgtgcattcctgttttttttttccttcgccttcctcactccttgcttatgtaatggtagtgttcaagtttgtggagcatcctgagaataatgagaagccattagatcagaagtgcaaggttaagttcaagattgtcagtctgaaggtcaaaggacctatggagtatgtcccagaactggtatgttttcttttaatctttagcttgttcaaaagttttaattttgatgcttaatgcgttctcagttttgaaagacaaggacttatagaattacatcccacaccctcactagtaattcattcatattacctgaagttttagtgaccttgatattaatatcaattttttttcacctgtaacacaaaataatacagttcgtttgttatgaacctccacatattttgtccattttagcagtgcatggtctaaagtgttacccttatgttacagtttgatgagcagaaaaaccaggtagcagttgagcaaattctgcgtgttgtattcttggacgctgagcgtcaaaccccagtaagtttcagcaattgcttttactcttaatgcaacacagttgtgaataatagaaagtttaccacaaatttgcactttctgcagcaaatggacaagctcaagcgccagcttgctgaagcagaggcagcacttgaagcacgcaagaaacctccagaggacaccggcccccgcattgttggtgaaggccttgtaattgatgaatgggtaagatcagggcacagaattcttaatgacagttgtctggtcttttactattgtgttagtggctgtctcatgtgaccatataacatttccttatttccccttatttcagaaggagcgaagagagagataccttgctcgtcagcagattgaaggggttgattcagcgtagacacggcaccatgaactgtaaaccattggttgcttgaacatatcgttttatcgtcgccacacatccttctgtccatggttttttcagtttttacaaaggttctgcttggaacaagagtgaggctttgtgtaattaggatttgagcttcatgctgcacttcattcctgggtctacatgtagatagccagtcactgcttgataataatattttctatgctagatcatgtacttggggttgtggacttagacgtgtggatgcgatacatttcttaggtgatgttcccatcaatattgaatgtaatgttgtctgaacgtgctcttcaaagtgataaaatgaaagctctcctatcatgttactctatttcttagatctacatgcttctgttgcacatattgtagctaagtttccttctaaataatatattaactagccagcctagtgccaattatccagggaatcatctatgaaaagttattcaagggtagtaccatcttggaatttattttttgtaatattgtgtgtgagttatgtactgacaggtcttttgaggagatgaaacattctgggctcagcatctggttctcatgttcttttgttcttttatttgcctgtgtgacctgtactgatataattgttcttgttcctttgttcatatgatctgtactaataaaactgttgagctggaagaattaggtacaaatacacctatacctaaccaactaaaccattaggggaataataatggaatatagttaatagtttagtcctttggggtttggacaacctgttgctttctttgaattcatacttgatgatttgttaagaatttatttccatttcatagccagatagatgcaatcagacatgcttgacttttaaagctgaaaaggtgcaacttgcagcttcttatcttctatttaggattctttcattgtcattgagacaaagatgtattctctagaatatatattttttatgtaatgtcacccggtcaccccttccttttcttcttctcactttttctttctttctttatttcttcttttttttttcgtgaagagtggtaatcctttggcctaactcaaaaactaaatatttggccctagtagatgcaggtgatgattctatttggattgctcaatgtattattttacattatggaatgtctgaaaattcagctagaggtcgtatacctttctattcttttggtcgagttgctttcagattggattattacctcatgaaaaataagcagcacgaattaacaatgtagcagatggacattatcagcattgttttttttttctttaacatgggatgtgaattgtaagtaaagtgtatcctccctgattttcttcaacatgttgcaccaaactatataaggcctgcatcttcttccctaactttggatgcatctcttgaatttgccataaaaactgtacctcttgcccttagtttgagggaactgtctgccccactattggttctttatgtctcagcatgcccagaaacccatcaataaggtaatgaatagtgagaacgacctaaacggttgcacctaaattagcattttccaggaaaatgttttgaactcagagattgttcatgtta

SEQ ID NO: 77987 - DNA, 5021 bp, Oryza sativa
accccctaaattagcattttccaggaagatgttttgaactcagagattgttcatgttaaattcaagaactatgaactgcaaagacaaactattggtctacatcttaattaggcaacaatttttccaactaaccatacataacaggggtacagaccacaagcacatgctactgaaacatgttcaatcatagaactacagttctccaaaaacagaatgagcatcaactacagccagcataactgtttggcatgttgccacttaatgatgaatattggcagttcatataccatcatttcaacataaaccaaacgagacatttcagataatccactgggctgctgccatggaaagataacagaactcatttaaacaagatttgacagtaacaaaaagaggtcaggtccaaagtggttttcttttgcttatcttttaaggtaaagaaactactaaagaatctgcaggtttgctcatgccgcaaaagtacaacactcttcaaaagaaaggtacaaagggaatttttcctccgtggtgcactatgtaagaaaaaaaaaagggtaacttttattctttcctaaccaaaaagaatatatatttgcagaaacaaactcgagtgggaggcaggcactactgatgcacttagcttctgatgaatatgtcacaacaaaatattttccttcttgactatatgcaacttgagtccctaccgaagataaagcgacggctccagtcagagatcaccagtgccctcgtgcgccagcttatttgtttactgaattcagagaaaaaagagcattagacaccagcatagatgaaccaaaatgggggcacaggagtgatagcaacataacctttgtcactctgaaatggaagagaacacttacgttgcgtagacagaataccagagccactgtgtgctgtggccaatggagatccaatcaccagggagctgtgcagcagtctgctcacctcctagtggggcaaattggcctaaatgcctgtacctggatgaatcagcaaagctatcgtatcagatgcctgtgaaaaggaacttctagaattatgcagacatggacagattaacgcggagcgcaatctactgctacatacttctgtctttgggtttgggaagcttactgttcaatgacacttttagttgggtaattataacaggcattgtgtttcattcaactggtttctggataatgtcaaatggtaatacttctagcagcataataagcagagaataggaacctgaaagggcggaaacgatggcgtccttctccccttatacggatggggccttcagggttttcttcagcatccttcatcttattgaagcacctagccaaatattgtccctgctgtgaagcaacctgacaaaaaaaacagactagttaacacttggcagtgatgcacttccatgaattttcgctttgaaactgtcaaaccagtgaaaattccaaggaggaatagaaagcgacctgagcagttgcaggcagatttttgacttgcgaatcaacaagagaaagagctttcttaaattcttcaatgttcagttctacagattccttttcagcatcacctttggcagtccttactaaatcagcgattccattcatttgcctgctcttcagatagagctctacctggggatatctcacgtagatatcatccaagacatcttggatttctttcactgtcaaggttccagagttatctttatctgctactctgaatatttccgagatatcatcctgcattacagatcaagaatataaagccatatatattgacataacagaaacaaaatcttttacattcatcgacttatagcttgtattgcaggaacaaaggatagttgaaacaccccctcactcaaaggtaatttgtcaatgcaggtatactgcttccattatatgctagtacaagtcaaatgagctaccatttccactaccacttaataaaatccaggagcattccaagttagcaaagatagatgacaggagtctcaaggaagctaaaaaacaatgtcaagtatgcaagaagatgaacagaaaagaagtcttatcttcatagaagaacgtacacaaagatcaagtcccattacttaccattactctccgctggtttatcgtagcacaatctcctacagcataaacaccatcacattcacggacccttagccattcatcagtggctagtacacgccgtttgccctgcaaatgtagacggagaattagatggataactcagctagctacaaagagtcgagctgagtttcttgctaggtacctgcccaatttgtttcatgaactctgaaatgaagggccgggtaccaataccagtggaccaaacagccattccataaggaaccgcgatatctccagtggctggattttgcatggtaattgcatccttagcaaccttcacaactttgtatccagttttcacatcaatgccatcccttccaaacttatcctcagcaaattcagtaatcctcttgtcaaacctataggaagcacatgtaatcaaagttaaatttacaagggagggtaagcttgcgttgccgcatccttccatcatagctaatcatggtaatgagaaaaaggtgaatcactagtcataacttcatatgaatcaaatgcaacagaaatccagtatggccttacatagtcagtatgtgatctgcagcttcaatcagtgatatcttgacaaggtgctgaatagaaggatacagcttggatagatcttcggtaacaaaatcgtgcaactctgcggcaaattccacgcctgtaggtccaccacctacaacaacaaagtgaaggttcttcttcctctcttcttcatccaggtaaggaagacttgctctctcgaagcagtccatcacattccttcggatcttttgggcatcctctacttcctgtgattcagtaatgacagtatgaacatagaatgtatgattatagcacagaaacaatgaaaatgtagtatatgaattttttattttaaaaaataatataaacttttccgtttgaaaataagtgcaaattgtgtatattacacaatggagcacttatatgagtcatattctatgtcagatatccgtacaccaataccgggtagtgatgaatttcatagtacaagtaagtcatttcatttcatagtgcaagcttaccttcaaaaagaagcaattctcctcaacacctggagtgttaaatgtattagacctagctccaactgctatcacaagatagtcgtagtcaaccaagaattcgccatttccatcaagatttgtccctatattggaccggcaatggatcttcttgtttgatgaatcaatcttaaagcattctgcttcccagaatttgatatctccacctttctgcaagggaattccagaaaacaatgttaatgcattttgctcagaattaaccatctagttgagcttccctacgaaatcaaaacttagtgcatgtaagaaacttaagctagttttttagaggtcaagaaattcattaaaccattgaaaaacagaccagtctgtttctcagtgtattaacaggttgttaaaaatgggaataaacaagtattatattgctttgatacgcaaagccatcaactctacattaagcccaaataacaaataagttgtccaaattgctctgataaagacaaggcggtgacagaagtataaatatagaaaaaaacagagcaatctgtggaaatttctgagaatcatcataccttctccaaaatcctacgaatcggctcaacaacgctccttggctcaactgtcccacaagtgacacttgggagcaggggcgtgaatgcgaaataattccgaggtgaaatgacctgaacatcatacagtctgctgtcaagattcctcaggaacgtggtgccaccccaaccggtgccaagaacaacgattttcttctttggaggtccctggggcttcccaacaacatcatctgaattggaatccgcatatgctactagtcctccactactgcaaatttgataagcaacagatgagcaacatgcttagaaacatatgacaatgcaaaaatatttaagagttcacataattcttcattgtaaactagtctgaatgcatcatatggacgcatagatcagctcaagaacccaatcatccaacagtgacgtttccaaacattcacacgtctccttctacaaatagcttggaatgtccctatttacaaaccccgttaacatcagtaggcataattactgcgatggactagtcggatcaggagttgaatttcttcttgctctcgcatcttctcaaatagataggcatattgcctaacaaaatatataaagttattcaagaatttgatgagaaaatgcagtaaccaaatgttactgtcaaaacagttaggcaagaaaggtctagttgtgatttgtgaaagaaacggaacttcgcaagttcagaaatgaatggcaattatgcacatggcaccgacttctcacctacctttgtactaaccatcatgtgttgtgttcacgttcttgttagtagtagtattaaattaaacttttgaatatcataagtacaagagatctcaaagcacagctggactttttttttaaaaaaaaagatgagaagaaaaatgcttatagaatggagagatggatggaggaggagaatttttcttgttgatctcatggaccacgaatatatggtggaatattcatgtgtggacacgtcggcgccaacgatgtggccatgtggcgaaggaggagcaaatctctcggggggttctttttttccccttcccttttccttttctgttctcttgtgacatccggaattaatttcacaatacaagaaaactaatcttttttaaataaataaataaaatgctaaatatatacggagtggaatggaaaaaaaatggtgaggtaaaaaagaaatccttgctctagatatgaagagttaaaatcagagttgatgtcgagcagataaattggtaagctgagaggagaaacgatgcgat

SEQ ID NO: 77988 - DNA, 14959 bp, Oryza sativa
cacacgcgggatggaagaggaagaagagccatgggcatttccgtccgggatggcattttggcgaagacactctggttgaggatggtattctagcgaagcctgtttttataatggtattctagcgaagccattcttataggatggtagatatgcaattttctcagggacaagggatgcatgaaaaatacttaatttccactggtcgatatatacacgcactgttggtgtgtatcttaattaattaaatacggagaccgaatgcataagtttttttttaaaaaaaatacaaacacggacgctcacacttcgcgcacactcaacattataaacacacgtacaccttataactatgaacatctccggaagataattaattaaatacggagaccgaatgcataagttttttttttaaaaaatacaaacacggacactcacacttcgcgcacactcaacattataaacacacacgtacaccttataactgtgaacatctccggaagactagactgacatatcttgaaattgatgaaatcattacggacgccttactctcacgagtatgtcatctaccactaaaagaataattagttataaatataagcattcatgtcaagtttagaacttgaattcagatgagctgatttcacaacaaaaatctaaccaattaaactactctcaccttataacaaaagttatttattataattaaataagtcaaatgtttcaattggttatatgtatgaaaaaagaaatcggtcactgaaacactggaaaaataaatatatggtgaaacatctttgagaagtgaagtacaacataaaaaataaataaaaaggagaaatatggtcgaatatcaaataaaacactttaacccacatatgaaacattgaattttaacagttggaacatcaaataaattttcttaaaaatcaaaaactggttaataggaaacacttgaaatattttactctcatgcacgaaacattttgctctcattcatgatatgttgaatgtcaagtattgaaacataaaagtagtaatatactctcaatggtctcaagaaaaattaaattcaataaagcaagaaatgcaaggaactaacttaagggagtgaagaaccgatattgcagtatccataacttcatccattagggtttaaattttagtgctcatgaatatattatgtatacgtaaatagcttttgataaaaaaaatagcgatgtcagtaatatatgtctgccgttaatttttatttctttaaatatatgttagggaacatattcgtctgcacgcgtgtgtgcgtacattttaactgcgattttgtttttaaagaaatggggtagctcttcttaatttttgttgctaggtggcctagcttttttatttttttaagaactatgtggcctggcttgcgtgatgcatgcttccatccatccttgtggcacaatatcacgtcaggtccgatcgatcgactcctccagatgcatgaatacggtgtgggcacgatggagagaagaatactttattactcatatgacactttacaatacaacaaatccggatatgtttattgtccagatttattgtactataaagtgtcccatccagtcctagatttctatattatgggacggaggagtcaatttggatgattaaactgatacttttatatatactatgtagaacatacttctaatcttactcccttacatcctaaaaaattcaacctacgaagagacatgacccattctatgtcatcttctaaaacaacaaatctgaacaaaggatagtccaaatttattgtattaggaagggatttgatcctttgttaagtttatttgggatggagggattacttcctctaaaaaacgaatctagaaatatatcacatccagtattagtttggtttttatgggacgaagggaacacgtcatacatgcatgcaaaggccgtataggcaagtacaacgcgtggccggcaaagtggttgaagttcaccgggttccggtgaaaagctgtaccggccgccgccgcgtgtgcgccgtcgtgtcaccggcgggatggccggagccaaggtcgacgatcagagagacaaattcaagccgaatttttcatcgcctagctgatgagattttccggcggcggccgaccattgctgtaggaatttaatctagtatgcatggaccgacgactcactagtcaatgtcgatggattgatcggacagatcttaactactccctccgcgttgactcttttaaatatatttaattgtatattttatttaaaatttttatgaaatatataaaactatatttatatatacaaatatatttaacaataaattaaataataaaaaaataattaataattacttaaaattttaaataagatgaacggttaaatatacttaaaaaaaaatcaacggtgtagagacggctgaggtactattattccgacagatagtagcatgaagtatttcatgctgaccattgaccatccacgtcaggtacctgcatgcatgctacttctcgatctgctggagtactacgtcctttccaaaatggacttctcctccattgttttatataatacttcatccttcttattttaaatacaatcatatatttctatatccaatatttgatcattcttttgtagaaatattctttctattcagcaaaatatttctcaaacttctaaagcagtacaatttttcatgaaaactttctatataaaaaacttttagaaaactaactgttttaaatctttttctactttatatatgttatttatttaacttgtttatattcttaaataattatcacaaatcattccgctattcagattttccccccaattcgggttataattaacacacggtatatagctagctattcaactgatctccatatatctgttctgacgtactgttactgtcagcaggtagcatcttttagtttggactacaagtactcaagtagtacaatcttggtcttacttggtgtgcaaacgatcgatgtatcatgtatgcatatatatgagagaacacatatatgcatgttactgtcatctcctatcagtatcagtatatatagttcagccatgtcgttgttagataagatgcatgcatgcatatactccttctgtttctaaatatttgacgccgttgactcttttaaatatatttgaccattcatcttattaaactttttttaagtaattattaattctttttctattatttgattcattgttaaatatacttatatgtgtacatatatttttacatatttcataaaagtttttgaataagataaatggtcaaacatgtgctataaagtcaacggtatcaaatatttagaaacggagagagtatatgcgactacttgtacttggaagatctaccgatcgtcgacgatcgttgtctagctcctcgtcctatgaatttcaattattggatagccctgtactgcatgtactgatttgatgattctttagacaaattaatggagaaagaataaattgaattaattgatagtagctagtagcttgtactgttgtcgttgtcaagaaaaacttgagcgttttttctttttgtcggaatagaccagcactcgctcattcgtgcgtgcatggtagtgatttctttgataactaatggataacccggccgtcaaccagcaatgatcatatatatatctcggattaatcgagaattaagtcaaccattttatgttcagataaattactataactacatgtatgcatatgatcgatcgataaaagaattaagcacgcatcagttgatcgagctcgccctcctatacactcctcttcgtcctggtgatctttgggatgtttggagttgagatgagttgcacggctgtggttcctttgtcagatcggaatatgtaattacgcctagcggttgtcgattcggtgctaaatttcttctttgatatcagcgtgtgcgtctttctattaattaattataatcttttgggttataatgttttttacttaacttttgggttataatgttgtatttttttcatattatatcaatataaaatgtttttaaaaaaatgctaccaatgtttgtccgatgctcctatatgtactccagtcttccatttaacactgtacacatgtatgcttgttcgaaataattacagaagacttccccaagttcttttgcatgcatgcattttgggcagtttcagccaaatgcaagtggccaactggacagacaggctactcgacccgaatttaattaatttgcagcctgtcagttttgaccagagctaggtacacgcatgacgatagctatagtatagatccatccttgcacgccccaaactttatttttcatcgattgacatatcaatcaatttacctctctctactgctctctcaatctcataatattagacaaaacatttgaccaacaattattataataaaaattaaattttattttctaaaattaacattattgaattgacatttaaatttacttgaagatggttataattttgttgcaataaaccttatagcatatgagaattatgagtcaaagattagttttgaaaactgtgctaagtttaaccatgtcttatattatgggatagaggaagtatgtagaagtactaatctacacatcatcagcctaatattaatcatgttataattttctcttgatcgagtcttgtgtatctatgtcctgccacgttgcattatcataaagaaatttctaggtctgaatagagaatattatctaactacttttttttaatttttggccattgggacttactagctagccgcattaatttttgcaagaattagttctcaaatgtgcaagtcgtaacagcattgatttgaccaagaagagaagatagccatcaccatacatatacaagatgcttgcagtaatttttttttcaatatctatatatcggctcaaactttttttattaatcggctcagtctttcaaaagtgctcgatatatatatatatatatatatatatatatatatatatatatatatatatatatatatatatacatatatatatatatatatacatatatatacacatatacatatatacatatacatatacatatacatatacatatacatatacatatacatatacatatacatatacatatatgcatttataaagatatgagcgtgttatatttaagaaagaatataaatatacctgctcagttgctctcaattaacctccatttttcttaagaaagacatgctcctaattaatctcactaacaacgtaattaagcatatatataatacaaatctgtatcacacatatatggaggagaccgtctccaacttgggctctgcgcccttcccgttggcacacgtgccgtccaaacacatatattcgcacgtgggagaaaagtaaagctgaccgtcggatcaatcaatctggacggactccggtcgtgtcccatgccttgctgcgatggttcccagctctttcacgtttcactattctcttgtcctcgtgcgaatgttgcatgcatggtcaatgtcctattatgccatcccaagtaggcaaagctgtagggcacatgcctcctttactttcgggcccaccaaaatgaggttcttgtgttcaaaaaaggccaccggtttttgggtgaaaaaggagggcgcataaggctagaaacaacactgtgaagcgagtagcgtcggagcgaggggcgctagcggtcgtgggggacaggtagggcgtgtcgccgcagcgccgcccgctccgaggtcgtcccgtgccgccagatccgcgtcgccggcctggggaggagggcagcgcggcggcgaccacggtggcggtgacaaagccacggccacggccatccacgtgccgcgccggacgagccatcgccgctggatctggcgagctgccacaccgtacgtcgtcgagactcgtcgctgccacgccgctccctaacgagccacgacgcgcgaggaagacgcggacgaggcggcgggggcacgcgagaggaggggaggccaagaagttcgccgccgtcgagcgccaagcccgccgccgccgtcatccccagatccaccgacactccgcccggtcaccccggcaccgtctctgctcgtcgctgctccgcccggccccatcgccgtcgaggccgccgctccgctcgaccgccctagcgtcgtctccgctcgagcgtgagaggagagatagggaaggcgtgagagaggggaagaagacaatgttgggctcgaggaaaaggggggagagagcggaaaaggtggagaaaaaaaaggaaaactatatttttgtggaccccacttgaggatactgcattgtaaagcttgtgtctatcaatgttcctcagcccatgtggcacctcaggtccagcatattacgtgacgcattgctattgccttttatgctcgtgtcatttttcttccccgtcatatctcacctccttgtcgtcatcgtcctccttctctttaaacaattgagatatccgtgtctaatttaaaaaatttatgaattttttttaaaaaatagtcacccataaatcactgttcatgttttatcatctaataacaataaaaatattaattatatttttttttcaaataagacgaacagttaagcgttggacatgaacaattgcaaaactgcacttattttgagatggagggagtattatatagcagtatgtggtacttctcgatacagagaacctgcgctcctctctaaagtcattactccctccttcccaaattgatcattatataatataatctaaaaaattgcagtagccagctagagaagatgcatgggaaatataagcgatgatgtgggaagggcttattcctggattgcacacagttcttttattaattatggttgtattgcaaattgaaaatgaattagttgaaagtcaatatgttgtttcattttttaagaaaacaattaatttgttctctgagtgtaatgtatatgatttttgtgaagttgatacattttacctcaacgaatctaaatgagtggatatcctccaattgaaatgttattgcgttggattgagagtacaaaatcacttgcactgcaagtcaatgtacaaaatcgatcccttgaaagttttaaaaaggataaaaacaagttgtggtaactaataatgcatggttatatgtcggcatatcttccttatagtaaaacgaagggaaaaggactgtacaaacaacgatggacagtggcatatcttaattatattatctttcacggaaaaggacggttactgttaaaaaattgactatagaaacaccaaaataaagtatcaggtcatttcacgtcgtgcatggcttttaagtgaaagctcactaataaatatattaaatttcaccataatactctaatatatatttaggaaatactcttgtctaataaatatcagttggtgtatataaggggtctcttcggcatcctggctgcggctgcggctgcgccgtgtgtgtgtggcactgttggtgctggttacgccgcaaccacgaaacagacagccgaacagacccaacatcacttggtttagccatgtgtcggccctaataagtaaggcttgcgaaatcgatatccatatgactaactttagaggtggcgaagggcattgatcacgagcctttaggtctataatttatatattaacttaactctagctctgtatgaaattacgaaaatccattatacccgcgtgataaatcttttatacttaaaaggttatagagatgtgaaatttgtgacacatagctaaaacttctttttgtcaaaatatatgtgaatatactcatgtataaatctgggttccacatattgcttctatctcagaataaatcaacctaaaatatgatgagatataacataataaatctaaatttagataggacgggtattatcctatcccatcctaaatttgattattttgggacaatagagtatatatgtgcatctccggtttatctccacggattctgccaacagcaaaagaaaaaataaaaaagaaaaggatggggttagtaaagttcgagatatgctgtgtgctttgagatgacacgtggacaatgagatgggcagatggaagaacacgcgtgaactaacagccaatgcaaaattctcttccttaatcagtatataaatctctcctagcgtaatccctcttccactttgctaactgagcacgcatttatcttgctaatcactcggcattaaattagccattagggtcggtgctaatgtacatgggagtgtcactagcagttgttaatttagcagatatactaagatggtgtttggatccagggacttaactttagtccctgtatttagacactaatttaaagtattaaatatagactacttacaaaactaattatataaatggaagctaatttgcgagacaaattttttaagtctaactaatcaataattagagaatgtctactgtagcatcacataggctaattatggattaattagactcaatagattcgtctcgcaaattagtccaagattatggatgggttttattaatagtctacgtttaatatttataattattgtctaaacatctgatgtgatagggacttaaaagtttgtagtcccatttaaacaaggcctaaggtttaaaaaagatttattttcattcgtttaagtgattagattttcattacttaggttcatctctcaaacacccgattgcttgaaatatttctatgtgttagaatcaatgtgctcttgaaatatttaaattacggtataaatttaaaatttaaaagttgttatattttaaaacaaagagtgtaataaatactacccctgaagcccaaggagaaccagctaccagccattcttcttcctcttcttcccttcactttctcctctggccgtcgccaccgattttgagcaatgtctctgatcaattaatgaaccttaattgaaagaaaaccaccactagtagtaaataatcaaatcttcttaattaatcatatactcagatacttgaattcatctggtcttatttaaagaaaaagttatatgaaaatgggatgcatgtgtatgcacagatcatatatggagagtatctcctggccaactgctctcaacttgcatgtctgcaactaaccatatcgtctcatactctctgatctgattgtccacgtgcacacgattatatatgctgcactagtgtataatgatgttgattttaaaatattttattgacaacttatcttaatacaaaattatgtaactattatttattttataataatttgtcttatcagtaaaggtattttacgcatgactcatactttcacatattcatataaaattttctaaataaacatgaatctaaaagttaatgatatcatgtatacatggaaaacgatgaggtactgaagctagctaggtagccagctttggatagttagttggatattaattaattaagtattgtcaggccggcagtttaactaattaaattagcacaacactactccatgtagtatgaacgaatctctttgattatatgattctctttgacgcttaatttattcctcggacagaacgatcaagggaataatatctctgtcgagatatgtgaaaaatgagcacttttttcgtccatcgaattcaactggttgatgcatgcaattgttagagtagatcatagtagcacatacatatatcctttctctgtaaaaaaaaataatgcaattttatgtgtctagattcatttctaaattgaatttttttaaggaacagataaagtaaacattatatttttcgatgatcgacagataagagagaaattaaagcaagaaaagaaatgcaaggaactgacaattaatttagtcaggtttctggccgaatccttcaaatgcatatatacgtgtggacacgaacaatttagtcaataaattaattataagttaattaattaatagttcatatatagacgatcatgccttccagcacaaagaggttctccacagagggacctgtcacgaaaataaagaaggtaacgacaggaatccagaaacgtctctcgaagctcatctcttagatttacatttttatagttttctcgttcaatttttttttatagttttcgtttctacatgtactccctccgtcctaaaataagtgcagccatggttttcagcgcccaactttgaccattcgtcttatttgaaaaaaattttaaaaaaattaaaaacataagtcacgagtaaagtactattcatattttatcatcttataataacaaaattgctaagtataaaaaaatttcaaataagacggacgatcaaagttgggcgcggaaactcatggcttcacttattttgggacggaggtagtacaaaccagtgtttacgattctgatgaaatccgaccggatttcatgaaattttgacgttttgatgaggctcgaaagtaaaaaccatatgaaatttcgagaagtttcatccatatttaaatttgaattgataaaaaaagaaaacaatcaaataaaatcttataaatactatgataccatagaacctattgagatataaagtttcaaaaaaatgatgtatcgtgtatatgtactgaaacttacatcaggaaagaaaagaataaagaatttaaaaaatggaaaacatttacatgggccaaaaccgactggtattaaaaaaaggaaaacacttactgatcgaaatttcgtaatttcgccaaaaccgaccggttttcaagaacttgttggaaaactcagggaatttgtatccaaattttggtttatgaaatttgttcgaaatttaccggttttctaccagatttcacgaaattccgaattccgccagtgctcgaaacggaagggcctgtcggaatcgtaaaccctggtacaaactatatatttactcatgttttctctatactattttaaatgatattagtgattatgtcgagtctgcctccaacatcacaaactgacattactttgaatatatcaattaactatgcctaaacaattaactatgctataatttattcaataaaattgacacatctaatatcggttccttaaaaaaatccatgtcatatgcatgcaaggttgccggtgtgtaagtacgtggccgcacaaagttggcagttttcagtgaaaggttacatcaatcgcagtggcgtgtacaatgttgtcgtgttaacatgatcttattaattactttatccattttaaaatataaaattttttatgtgacataacatattcagattcataggtatgttttcatccaaccaaaatcttttatattttagatcggagggagtactcagcttttcaaccccagctcatcaatctgtggcaattcaccccaaatttcgatcgtcaaattatgcatttgcacaaatgactacatacatattttgttcgagaataattaaacacagggcattatattcgtgcagctaattaatataacgatgtaaaaaaaaaaactaaagtccaagaggcagacatgcagcagtcaaattaggctttgaaattaaaccatgcagctagcaattgctatagctcgcaaaactgaaaacaacaaagagagaaaattgaacacaacttcgttagagtaacgcaaagactttcttataagaggaattctccgttttgccatatatataatagatccttaattcgtcttctggggctgatcacaacgacactgccagattcttcaaacaactgagcaacgacagaaatagatcttagtatagccatcgaaccttgaccaggtttttggattttcatctgaatatatatatagagtggttcatacatattgggaaacttgcagtgactaattagcaaatagttaattattccgattaattaagcattgttgatgttacggtaattaactggagtatgtataatgtatagtatatatatccttatcttgatgaataattaagcattgttgtcagatatttcttcatgcagcatgcatacatgcacaataaatcaattggaggatcctcccaattaacttgcatgcatgacttttgacatattttcgactaatcattttatttaagataatatgtaatgattattatttattttgttgtgatatgtttcagcattaaatatatattgagtaccttttatatttatataaaatttttaaacaagataaatagtcaaacatttatctaaaaagcgtatacaggcgatcgtacatgcatgactgaagcacgctagctcatccgatacagatagatatatgtatctctaccatctagatcacatcaacctattattgataatcatccgtccccaaataactatcattctagaggtcaaggggtaaattaagaaaaagataaaatgacctatatatatgtcccttattaattaaatgataggagaatagttgggggtatggagacaaatttaaatgagatgagatttaagtgaacaactagtacttaggattacactatttgaaggtaaatttgtattaggaaatccttattattttgggacggaggcacggaggtagtaattttctcccttgatcgagtactatatatgtatatatccacccatatcctgccacgttatattaacgggaaggaatttttaagtttgagaaaatgatataacaacactgttaacttagggcaggccggtgcgactttaattaattgccttgccagtatatttttttatcagaattaactcacaaacgtccacatcgtgtaattaagattaatttggtaaaggagaagatatacaatcaccacctcacatactccaaatgaaccagattatctggaataaaagtatatgttattatcctgttctgctcaacttctaagcgtacttactccatccaaaaataaaacataatattttagatttaataaaacataatatggtatggatatagagatataagatattcattgtactatgttatatccaatcctattttagatttaattattttaaatgaaagggagtggatcgatcgcatatatatcgatccatcgtactcctgttatgtcctttatgtacgttttttttaatttccttgtctcatctttcatcgagccacactcatagatgaaggccacacacagacggtgcaatgtactataatatgtcatatctagttatagatttatttgtttgggacgaaggaagtacatggacaattagcgagtgatgagtacaacttgtagagaccggatcgatgtgtccaaattataccacattagctaaataacgaatattgaatataatatgcagctcttttttcttccgtttatatatatacaattgtactttgtaaaagattatcaatttacaacattagaatttggtcatgccctatcatctagctgcatagattttattttttttccacttcaataatgtggtaatttggtctagtggcggacccagaaaaattacactggggtgtgcccattctagttatcactccaccgtatatttttttaaaaagaaaacacccaattccgatggaagaatttttgcagattttggtcggatttttcaaaattctattgtaatgtggtccataattcatgtatattgggaaacttgcagtgactatatgtactctcagatatattaatcgaagtcatcgtttgatgttaaggtaattaactggactatgtataatgtactagctgaatgcccttgcattgcaacgggttattcaaaataggaaaaacataaaaaaaaatcttgttgaaagaaatagcttctacttggttgaaacaagattcttcatcttaaaaaaacaaaaataaaaatacaataattaagactatatttctcaatgtgagatataaaccaatgtgattttcagtacttaaatatagattgatggctacatctgtgttaacgaaatgtctatttcatatggtaatgtaatatgtacttattaataaattgtgttgtataactcatttaaaattacaatagaagccataagatgagaagaagcaaagcaatagaaatttagagagaaattaaattaaacaacattgccagagtaacgcaaagatcaactttcttataagagaaactctccgttttgccatatatataatagatccttaatttgtcttgtgggattgacaacgatattgccagattcttcaaacaattggagcaacgacagatcagagatagataatagtatctcgccatcgaagcttgaccggtttttggacttccatctaaatatatggactagttcatgcatattggggaaacatatccctatccagattcattgtataagttatgttttattttattctatatttgaaatattttgaaatgaagggagtacatgatacatcgcataccgatccattgtactcttgtcgtgtccttcacctgtgtttcctttccttatctcatcttccacctttatcgtcatcattgttctcctcgagccactcttatggttgaaggccacacaaccgatgcaatgtactcttttgtgtcgatctttcattggagtactatggttacattacatacatgtgcgtgttaacggttactgtttctaggtttgtcgacctcttatatgtgtcttggtcatctctaagccactttttagggaggaaggtcaactgtgtttcacttttatcgtacgtacgtggacaattagtgagtgatgagtacaattggatgtgtccaaattatcacactagttagttaaatatctctaggattgaatgtaatatacaactcttttcttccgtttgtgtatatacaattgtactttgtatgtaattaattatcgctatcaatttacaccattacaatttggtcatactgtgatctatctatatagaattcattttgttttc

SEQ ID NO: 77989 - DNA, 19356 bp, Oryza sativa
ttaaaatggacagattggaaaccctttctcttcggcatgtaaaatggagtggcagattggcacataattagttaattattagcaacagttttaaaaatggattattttaaaagcattttttctatataacttttttgaaaaaacataccatttagtagttctgaaaattcacatgcggaaaatgagggatagaagttgtgaaagggaagaaaagaacacacccttaagatgcattgtttcctttacaccaaaacaaatactcaaagaaaagtcatagctaaaattatttgttgaaaaatttatatgtttggtttatcatgtgggcaactattttggtatatatagaatagttttgcaattaatataggtaaattttgagttgtaatccaactggtaagggcatatttttgtttgtgcttctgccacattttcaattccactattccatagctgtgtaaatacaaattcttgaataaaaaagttgtagctgtacagctttcttcgtgtttgctgcttttatgttccactctttgggtttcggatattttacaacaatttgtgtatgatacgggagcaaatccgagttaaaatccaacatttcaacaaggagagatctgattcgcttatagaaagctgtgttgcaatctagatagtactacaatttaatggtattatatgagagtaagcatgttctataataatttacaatttttgcacttttttaaatgaacagttttagaactttttgtgtagacaaggtgggtctaagatttggagacaagtttattggtattatatgagagtgagtataattccagcttgcaacttgtagccttctctttttcttgaataaacagttttagaactttgtgtagacaggatgggtctagatttggagataatataaagtccaaagctttatagaaaagaaaaggttcagttttgttcttgtcatctgacgtcaagtgacaaggacatttcaaggcatcttggttgcttcaatactaagtgttcagtacaagcatcctacgtaacttcagttattttacattaaaatgacttggctgtaaataacggctactgtaaaaatttacacttaggattgataattgcttaattggtgaagcagttagctccttatttatcacttgggagaccaacgaatagtatcagcttatcacatatatggccacctaatgtggattattttcaactgaacattttggttgcagatgatgtaaaccagggatgatttgttcatgcaatgcttccctggctagtagttcaactctagctgttcaaccttgttgaacttgaacccgcggattctgatctcttccttctccgaggtgtccttgtgatcgacgtgctggatagtccagcctttattctctatatgacctgtaacattgaactgaaaacgggtgtcgtatgaataatccatcagtcaaatatgactaaattgtttgcgttttcggtattcatgtcatttacgagttggtaattcgaatgcgtttgtatttttattaccttggcttcatctttggcatttacgataagagtgccatccaaggagaggccttgaatggtgatgttcttgccattgatgaccaaggctgacctctgagaaactgaagagttgctatggactttggctttgacatccttgaatataagaccccaccttgggatccaggttatgcgtggccaaacctctacctcttggccattgaaagtatcaattacagggtcagctatctgtgcaccagcctggaaaaggtgtaagagagcttgtgttaagctggagcacaaacaatttcctatccaaaaagaatatttctaaagtgatcacctttcttaaaataaggctgtttgccctgtaaattgccatctctcctgaagtagcactatggtaaggattaccttttggaacctgcagaaggcatattagaagatagaagaccacatgcgcagtacagtattagactggaaacgaaaagggaagctgatgtaaagcaactgaaccaaagcagttggtataaaactacaaactgatgcataacctcttaacgtcatcaaaacacagatcaggtatgtagctagtatcttcagaagtatggatgaaatgtagttttcaatgaatcacaaagaagggcaagttgaatctgacaacaggcctattgatttataggaacaacttttaacctgaatcataattcattgacaccggcataaaattcagagcaaggccagttctcacgatgcataacttcatatgcgagcataaatatttaatgattataatataaattttcagtctcgaaaggcagtgaaatcatactttagcagaatcttcaggattattctttacaggagcataagtaagccacgcatccatcacctagcattcaaggaaaaaagaagagcaaagtgagaacagacagattaattatcggaaaaattctcgctcaatatgaactttgcattcccataccgtaaatccaacttttgcagagggaggtagtgtttttggatagtcctgcatcatgcactcaagacgagtggacgatttaaatgctgtcttggtagaatcagtatacctaaattgaaaaaatgataacagattggggttaaacatttgaaaacaaaagtattttaggaacttattcacaaaatcttgaagtgccctgacttgtatctaacaaaattcaaaacaagacttatctactccgttgactatacgaaatatttgcaggtttgctgcaaacttgttctgaagtttactttgtcagtgcactagctcagagtaccttaatggtactataggaataccttgtcgcatagtaactaagaacaacttccatgatcaatagtacaagaattggtgataccactgggaagataagatgattatcagcacatcgattggaactgactagctgacattagtgaggggaaatattttcacaacaaatgtagcagcagtatgaagtgaaaatggaaaagaagtgtgcacaaagaaatcagaggcatacaaacaagagagaagttttgcttccttaaaaacccactattggaataaaatgggagtcagaagcagtgtgcaatagtttcactggagtaagtaggcagaaaaattacttagggtttacaaattccgaaatggcaccgtgtgttttctggagctcctccatatatggtccaatctccagtatcaactgcagaagtgtaacgcacagaatcagtagaacaaaaatcagtggtcccaacaaaacatgcatggctaacagaagagtgttgtttatttctaatcaatatgcacatcgacaagtaaatagatttatcagaaaatcatatttgatcaacatctcatgttaagcaccatgtttttaaaatgtcttgaaactttcaagtcggggtttggatggtcagttggcagaaagtacctggtttatatttccagggtatggagagtaccctgtttcacaatttgcatctccatcaggatgtccggttgcacgaaggagtggatcaagctgattgtactcgacattgatgaccattgttctacctatgcataagaatggttctatgtcaatttttgacaaatgcaaaacagcaatataagtggaaaaagaaagtgaaaaaaaaaacattgttaaatttgatgtgattagatgccactatggatcgatcaattatattttttctatttacaatgttgatcccagaacgatgaatccactgcttaatccatgagtaggtggtagtaaaatttaccatcgacatgagtaagttttgttattcctccaatggcttcttttgccttccgtggaactgcaagagaattaacattataacctttggtggcgctgacacctaatgctgatggtattgcctgtaaatacagtgggaagatctatatcaatttaacagataccatatgtcaactcattccagcatttgtctaaaaaacaagctctcaattgtaagacagtagggaagcaagagtacaaacattgaagagcaatccatttgtgtcctggaaaaagagaacccatttccgccctgtgctcttcctacaaaaaagtagtataaaacacacaagatcgacatgcattgatttgaacttagcataattattttagcaatttaattcatgtacattacttctaatcttcttcaaactggcaaaaagcgactaactacgaatgttgaattaatttaccattgctcaagcaagccgcttgaataaagaagagcgtggacatctccatgcccatgtggctttgtctgtcaaatcacaaaaatgaaattaagaaacctccaggaaaagaaaaggtaacaataggtgacatatatttaaatcttaattatagagatctcgtatcaaaattagcaacctggattttgtacttgtcatttgggtctaatgcaagccttgcatcattatcagctaaacatgccactttttcctgaaaaaataataagcattagcattaaatagcgaaactaacttttgtgcctactgaagaatatattttaactaagaaatacatggaagagatagcaagatagaagactacctgcttaagaatgtgcacttgtgatggttccattccaaaataggagtttgactccaaaagtttgacggttagtgcatttgtgtcatcagaagtcataataacaaatgggatctttgtattgcattcacctgcaagctcaaggaacaaaatcaatcagaaccaaatcaacatctgaatcgtctttgagtctttccatccaaagaacgtctaaatagtgggaaacacatatcgagcaaccattcacaacaaccacaagcagttcaaagggaaataactaaaggctaacacaggcaatacctaccagaaataccacagcgatattagaaagaaaaatactttgataagattagtttatcaaaacaagaagtatcatccctgctgttagtcatgagttcattgcacatataatgtagtccacataccctctaccaatttgcagctcgcctcctgcaaagctagaatagattctatgtaatgttgaagaaagcattttccagtagttgtttccctgggaagtgcaacctgcgcaatgatattacccatgaatgcttgatatcaaggtgaatttagcacaacaatataatgtccagagggaaattacatgatcccatttctggatttgctaacaatcatatcaaaataaatgcctgatggacagtctagtttgtaagcacacaagatcaacttgactacctgtacactttgacttgctaaaacatttgctatcctatccaatttccaagctcactgaaatttgctggaactgtggagatgtaatcactttcttcctttttttcattaacatcttagttttcatatacgaattgtggtgcatgatgttgtgataggacgattcagcaattaatgtgaatatatcttagcaaaataagaggcatggaggtgaaatgtttcaaccaaacagcacaatcatactacatcctcatgactgcaaaacactagttctactaccacagcatctactttggaattgtaataaatatatgcccttttgtttgctagaacttgggtcggatatcacaacatgtcataactgggaatctttaactggagttaccagtcaagaagctagctattttcatgctttgttgcaagaatggtatttccaactggggtcacattaccttaattcctttgtaaccaagtctttcaccaagcccaccagctacaagaacaaatgctgcatggcgggcttcttttaccccagcttcttcaagcgaaacaaagttgtcatcaccaaaggtcaatacttcccctgaaggaacctgtaattatggtacctctgtgaacaccatgtagtcatttcagattgtagaaaaatgcacatgcaagtgcacacggattcagactagaaaagggaagaattaacatcattcagatttgacaatagtgagctatacaccatatattagaaagattatgcagtaggagttatgacaccacgaatccaattcatggaaaaacagcacacatcaagacttacagaaggtgagaagccatcatatggattttttcctgcctttgaatctgctaaaagctttcttgcattctggatgtacgatgccagcccaccaggatagcttgaattaaggcggcagacctgaacaatgacaattttagcagaaattcaaaataataataacaatttggttatttaagcgcctcttcagctttcttggcctatagatgatatcaacaatggtaagaggacatggtgcttcttagagtaagccgacaaaaaaaaagaaggtttataggtgcctcatatgaggcaatcccaacaagaaagcaagaagaaagtattttagcctttgtgttagtatcagtaaaattctataaaaaatattgttgttttgtgaataagggacaaacctggtcaaagaagttccttttcttgtcatcatcaacacctggttccggccagtgttcaaacaaatgtgactgtccttcactcagcagcaattttgcaagcttaacctacaatcaccaccaggcaggaagcattatggaaaacacaactcaaatatggtaagtaaacaatacattacccattccgagtaaacagttgtaagcacaaatttcaggaattttttttccaatactttgtactgtgttcccgtagaacttactagtagggtggggactgaattgatatgaaaattgcaggagtagaagcaaagtagttaagactacgttgtcgaacaaaatcccaacgaaacagaggtagttattcgttctagcgtcaaatcatctggtactggacctaaacttacgactcgtaatcacccaaaaaaaaatcaaatttgcagccgcaaggccacgcaacgcgattctagcagaaaactgcaatctatccatccgacatctaacgcaggacgtcgcaggttgcaagccaaaaaatcacctcgtggggcgcgagcagcgggagattccgccgcagcggcggcgcccagtcgtcgcccccgccgccggagatccccagcgccgccaccgccgcggcgccgtcgccgtcggaagccatcgcgcgggcgtggcgtggcgtgtggagtcagaagtgggggagcaacaaaaccgtctcccaaatcgctcacaaagtcgcggtttttatatttttttttgcggaggaatcggtggataaactgaatcccaaatcaattaggagtagtaactgcaactcatcccgatcgatccgtgaagatgatggtggtggtgggcgcggcgcggggcccacatccaccacctcggcgacgagacgagcatccgaacaacgggtgacgcggtggcaatggcattccccggctttcacgtgagcgctcgcggcggcgggtgggcccgcccccacggcgccgggtgtcggtggtggccgccgccgataagccccgtaagacttcaaacttccaaaaattattccgtccgatcaaatgtttgggcatatacacgaagcactaaatgtgaatgaaaaaaatcaattataaattatacagattgcatataaaattacaagatgaatcttttaaatctaatttcaccatgatttaacaatgtgatgctacggtaaatatttactaatgacgaattaattagacttaataaattcgtctcgccatttacatacggaatctgtaatttgttttgttattggtctacgtttttaatatttcaaatatgtgttggtatactttaaaaaaaattggcctcacgaactaaacacggccgtactagattttatctagcatgttttactgtattttggtgagctagtagattttagagcaccttttttaaactgttactccctccgggttgataatacttgtcgttttggacaagggcacggtctccaaaaaacaactttgaccattattttctattataatatatataaagtgttaacaaatatataaattttattaaagtacttttcaagactaatctatatatgtagttaccatatttgaaagataaatattttaaaaatgattcataatcaaagattctaaagtttgacctcacccttgtctaaaacgacaagtattatcagcccagagggagtaaacaatgttatatcttttggaaaaacaatatgtaaaagttcttttaagatataaataaatacattttttttaggattattgtaattaaaacttaactgatcattatctttcacgttttgcaagcgctgagttcatcctcatctagattcagacatctgtcgcagactcacgggttctaatctggaatctcaaatcatttacaacagcatattcgaattttccaacatggcatcacttggcacctcacagttgcaaatgtaaacaggaaaaatgaaacaaaaatcttgtatacatgtataatttggagtatatatgacgaagccacatccaaatggcataaatttgtactactatattgtactaatacgtatacccggaaagaacattaatttttcccctcattttgttatatcatcatgagtttactcttacctagctacatgtgtatatgtatcaaagtgtatgatgaaatgtcagtagtagtggcctggcaggttggtgctactccggcggcgcgaggttgagcaccatgtcggggcccttgtcgccggcgacggagaactcgtcgggcaccggcacgcccagctcctcgcacaccagccggaccacgcgccgcgtcacgccgcccagcgacatcttgttcaccgtcacggccatggccagcccgtgctccacgtcgcagaaccccgtcgacccgcccatcccggagtgcccgaacgtcgtcgtcgccaccttctcgccagcgccggcgccatagccgtacctcctgaacccgagcccgaacttgccgttcgggtggatcatgccggagaagtcgccgacgcccatgaacgcgtcgagcatcttggtgccgccgtcgacgaacatgctgctgccgctgccactgccgttcccggccaccaccgctgacaccgtcgacccctcgtcgctgccgtcgctggtgcggagctgggtgtacccgtccttgtcagcgacgccgacatcattcttcgaacctcccttcttcttcttcttggacggcatggtggggaacttgggggtgtggacatggctgccgagtggcggcttggagccaccaccggagtgcggcggaggaatggcgccgcctgcccccagcgcggcgtagtatcgagccagagcgcgcgccgagcagtggccattggcagcggggaggatggcgcggcggatgttgagcgtgttgaagaggacaggtaggccggtggccatctgggcgacattgctgagcagctcctgtgggacgtctggtcctgctctgaatcctgacagcttctcgagctcctccatgtcgactgtcagtgccgcaaggcgagattcgacacctgacaagggcggaaaatcgatgaacatcacatattcacatgtaggatattatctacaacggtaagaatatagcagcaatttcactcatcaaacctatggaacacatctccaaaagcgtgggtgagtatgtttatggaacatgtcaaaacaagccagagacagagaaaatgcgttctttggacaagcatcgaactcatgactgtacttcacatatgcattgtagtctcttttcaaataatctttggaacagtaataatagcaagaatatagcaccccgcaaaaaaaaggtaagtatctagcgcaattttttcactcatcaaacttatatgacatgaacacgtctcgaaaaggttaatatgtttatggatttgtagaaaaaaaaaatatccatcattatatcaatgcgtacacctattttgttgaaagctaaactgggaagttttgttagttatacctggaggaatgccaatatatagctccccgttaatgtgaagaggatgaacaatggcctcttctaggacctcttgaagcttctttccggacgcatgctattatcaccaaatatcagcgttaggattcatgaaattaagttcacacagaacagtgacatacaaacacgtgttgttttcagttatttacctctactttgccaatagcccataaccaaaaaaatataacttggtgggctgtgcatttaattaagcccataaccagattaaaaattagtataactatgtgaagccataaagatccactgatccagttaaaaaggttcagtactcccattgaaaataaatgaactcggtgtatgtgatgctcgggagagacatacctctatgattccaccacacagccaaccaaaggataagtagtgatacatttgttcagaacccggttctgtttccggcgtacacttggtaatctggtgcagcatctcttcccagtcacataccaacaacggatcactcttcatcacatctcccaatgcattatgtaaaccagatgtatgattcagaagatgatgaacctttagtagaaaattgcaaatcagagtctgttaatcccaagaaacagtgtttcaacaaacaacaaaaaaagaagttctagtacctttattagctcttttttgttagttccgaattttggccatatattggcaacagtctcctcatacttcaacttcctgaaagataacagtatgctgtcagcctgtcactaataataaaaaaacactggatatgagaggaaagattctcatatcaaaatttatcaagaggggtgaggcttgaacctgggtcggctagcccacatcttgtggtgctagccagaagaccccaggcctttctcagcctgtcactaatggattgcaatgcacataaaagcctaaggtagcagggaaaagatgctcaatgttctctgtagtaccatcactgttagagatttagaggagttgcttgctttatacaagaatctgatgctttatactttttaagcactagaatgtagataatatcaagaaatattgtgacctggataacgtggatgcaactgcaggaaactacactgcaccaatctaaattttatgtttcaacagtgactcacatgtcataattgtgaaggattgccacctgcactaacatggttcagcctaatcatgggaacactggcacccattctccatgtccatttttattgttcaacatagactcacagaaatacggtacaacaatttgatgcttcagaataaaagttgtttgcgcatgtgagtgactttgccatgtatataaagatggaatatctttattttgttagaatgttagtagatcaagaggaggcctacttaaacagggtggcatactaccatgctcgttactgttaggccaaatattatttttgatacactagtaagctactaagatgaggtattctaaatataagtcgttttggaacttctagccacttcttcatcttctcttccatgcttgaccttggcaaataaatgctagctctctcaacaaataaatgattcatatctttcatgtagtataagtgtagggtaaaatagtcagttctgttgttttcttaattcttgtgcataagtctaaacgacttatttggaatctgaggtagtataatgtactgtaatacgacggcctgcaaacatatttacactagcatgttaagaaaaaaaaaacttggcattgtgattaagcactcaccctttgtcaacaagccaatgcaccatgccagcagtgataccctttgtcactgaaaaaactggaaagagagaatcaggttgaacaggacgtggatcatacttccctaacgtaccagcagcggtatctattatgacctttccatctttataagcacaaacctggtaaaaggaagatttgtaaggcaccaatgaagcaaagtcatagcatgtaaatgaatcgcatgagattatcaacctacttgtattcctaaaattttgttgcttcccaactcaagcagaaggttccgcagtttagactccacctctgagttaacaggtgagtcataaatccactgactgttagctgtgggcccacgtgtcatactcctaccatcaacgaaggcataaataagcaataaaaaagatgctttactctaaggctcctgcaaacagtagataaacaggcatctcaccctagcaaagttgattcagcaaatggcctcatgatgtctagataaactatcctaacatttagtgatgctgatagccctgcataagtgcagataatagagagcatgttaccatgatactggatatttcaaaggaaagaatgaaaaacatacctctaagaagattcaaaaccctcatgaatataattgcatcaccagggaaagcatcaacctaaaggcgagaaaatgttcatgtaacacctatttcttggttgacaaactaaacacatatgaagtaaaaggcatgcctactcactggattgaaacgttgaacctcctttttattcattttcatcttttcttgaagtgccttgacatttcgttctctttggtcattcaatgtctttatgttctcctaaagaaaagtcataaccaaacagttaatccaaacttccaaattaatacaagaggagggatacagattacagtagtggtagcctcctacctttgcttcatttgctgtagtggactgccgaaaaaatactgtagcgatctccatagcctgctcaggcatgtcaacccgcagcttaagccccatctccgcaaaggctgacagcagtgccacatggtctccctacccattgacatgttaaatatcagaaatgtagtttaagaaatttaatcatagcatgagcaactggttcacaaacagcaaaaggtagaataaaccgaagaaccctatctcacaaaattttaattatcaaattttgacacgtcaaaatactagtgcatgtggtcacttaacgttccagtgcactttctaagtctcaaagttgattcaaggaacaccaaagcatagtagagaagaaaataaagattagttccagattctgtctttgttttcttatagcttgttaaatgtgatattcatctgccactttgcaataccacttatgagtaaagactgaaagataggactaaactaggatacaaaaagatcggaaagtaaacaaaaatccattcttgttataataaaagatcgcatctactccaatggaaatggctgcagcttgtagatgccaacaagacaaccatgtttgattaactccattatttgtttccttgtgtatgtattatttagaagatcaaagtgtcaaacctcagcgcatgacaaaaacatctttgctagtgcctgcctcattgattgagatatgcgtttagtaagcccaaaatcaaggagaatcggcttgtgtggaggttccttgctaacaagaaaattgcctacagaaaaataatgcattgtcagcacaaatgaatttgcaagaattacagatggagaataaaaaaattgaggtgacagaagatctcttcaaggcacataaaattgaaataccagggtgaggatcgccgttaaagaagccatcaacgtatatttgatgagcatatgcacgggttatctcctccacaagtctttgcttatcaacaccatatgcttctaacgaatcattgtcattcaaacgaattccatccatatattgcaaaattagaaccttatcagttgactggtacacaaagaagaatggattagatgatctgtcaactgaaccggaaaaactgacacgatgacaaacaggatgaagtaaaagaactcagacctgaataacttctggaatcagtacgtcaacagcactagagacagcaccactctcgcaattggtttttcgactaagattactggagacagcctttgtgttctctaaaattaaggattttatagcatacattatcaggatgatatgttcattagtgactagacctttacttttaaaaaaaatatggatgagtcacaagagcatgcatgttcttttatatggagagaggagtatgagaactgaaaggggtaattacctgcctcatggttgaaatcaagttcctttggtgcctccttgcaccattcatctatcatcgggttaaaattatattgaggctctgcccatgcaatccattcaactaatgattttgcattcttcaaatcctgacaacattaagaaaatgatatagcaatcctgcacattttacataagtccgttttttcagaatagaggcaaacctctaatatgatatctttgataccatcatgttggattttcacaactacttctctgccatctacaagagttgcacgatgaacctgtgctatctgacaaaagtacatgaagactcgtatgaacatactaccatgacaaaaaaaattagcaagttgctcgaggatttcgtcaaaaaaaacatactatgaatttccatcagatgaaagaagttcattccaatataacagaacttactgatgcagttgctagaggatccagcacaaaattagcaaacagatcattcatgggtttcccaagttctttctctatggttccacgaacctgaacatgagagacaagaattgagttaacgactacgattagctacatgttaatatttggattgactacagatgaagcaaaattagttatgaggatgaacctcttcaagagggcgaggaggaagcgagtcctgcaactgcttgaggacatttatgtagggttcaggaagcacatctgctcttgtggataaatattgtcccattttcacccataaaccttctaactctatcatcaggttgagaacacgacgagcatttcgctcgtgtgtttttgtccatatagcatcctttttaccagcgccaacccatttaactctcttctgaactgcctgcttgtacctcaagaagatgttaatctgcttctactagtagaatggattgagactttttattgaaagaacagcatgaagaagtgatacaaccacaccttatagtcgaagtatataaacaaggccatggaaaagactttgaggcgcctggttaaggtgtttccccatcccattagaagtcagcacaacagcagaagagataacaaaaaaactctgaaacaccgtagttaacaactctaggctcccggccagacggttgatcttctgcaatgtcacaagtacaagaaggtaaatccaaatcagcattccttagtcactaccgatcacatacaataggctcaaaacttcttcatagaaaggactgttcttctgttcttgacaagtcatgacaagataacgaattcgcgcgacagcttgtatttacattaaatcagacaaagacagagtttaaggaaagcaaataaagcgtataactacaaagaatacaggtttcttcctcacaccacattcttatcatgacaaagggataagcaagcagtttccaaggagctacaacatcagatggtaggtactggaaagccaccaagggatgcaaacaaggagtacttacttttgcagtagagcagaagaaaacaaactactactagcttgtgtagtattaaggcctttaaacataaaaagaaacgaattttttgcttgatcacatcaaattgagcggataaaaccctcggatatcctccggacatccacaattccgcaactttattacctcagaatcgaatctaaatcaggggcaaacgacctaacaacgagttcagctgaactccaaaagaactttttttttcttggcctctccaaacaatcttctaccctacatcagagaaaccctgaagaaacctgattccataatgggaggggcacgaaatcaactcgatccgaacaacaacaacaacaacaagaacacaccgaggacgaccaagaacgaagcggccgcggggttgggacggggagggtaggaagacgtccacaccgccgcgcactccggagaccttcccgccggtggtgccgcgcgcagggaggggaggcgaggtgggggactccgccgggaagaggaggagagagagagagagagagagttcagagttcagacagggtgaggcgagggaagaaagggagatagatggagaggagcaggggcaattctggcaaattttcatcgtttttctcatccttttataattttttttttgaaagttaaattcttgacactgtcaacttgaaacctgtttccttccaaaccggtggcaagtacagtaacaacaatcatatataggagtagtccctatgtcattagagaagtgtatggatggtctctaaaattatgtgggtatgttacctgtgtgtctgaaccttaaaaatacatttctggctccaaagttatcatgagtatgttcaaacaagtttcaattcactttgtgtgctgacatggcaatatcacggtggcacttatatgtcagtgtgacccacatgtcaaccatatagaaataagtttttactgtttttattttctatgtgactaacgtgtaggcaccactgtgatgccatttcagtgtatggagcagtttgaatactatttggacctatatgacttcaaagacaagttcaggaacccgaaaatccattttgaaagtttatggatgttgatgatacacctgtacaaatttaggtaccatccgcgtacttcactcttttttatagtgaaaaatggttttatgttttcggcttatgtaaatagacacataaccaataagctttagagtcaaaaatgagaaaaatcgagtgatgggaaaagtctccatctcctctgacaaaatgactacctgaactaaaagataaaacaaataaaaaaattagcaaatggttacacaggtgctacgccatctaaaatgttacaaaagataacgactaccaaaaccaataaaatagcatcattatgcataatatctatttgttcttttatccttgtcaccaaacaatattcatatttagaattcgactacttttttgtaaaaaataataaatacttaaatagatgtcactttatcgaagtgtattatatattaaacataattattaactttgttcataataatctagtcatttaaaaatacattaaagtttgccacaatactgatcaatggtgataattatataggaattgagggagtatcatttttagtggttttgagaattaatataaaagttttggggaggaggattataagctcttttttcagggtgaaattgtaggcatctaatgtcatgtttgtataaaagaagcatagtttatccattttttgtgctgtttggctgtaaagaggtggattatttttacttgagtgggatgggagaatcgaatatatcttttttgtttcatttggatatgacatgtgagcatccaatgaatttgtaatcttttgagagaacaaaaaatcatgcaacaccttaaacagcattaaagtaagtcagtcgttgatatagatagtagagcaagatgacattgaactcaatgtgaatacacaaggcgcaataaaatcgccagcattactacttgctatggccagatagctgcaaattaatcactgtagcacgacactatttatgcaaaaaacatcatgtatttggaaggccttaacagcagttaactgatggcaggagagaaaaaaataaataagaagagggggcaacaaaagtaataaaaattcagatggacaatccatagattctttttttttaaaaaaaaagaaaagaccagtccatgaaattaacctgcatataattcaatgagcaagtagacttcagacagctccttggaaacttcttggccaatttcttgacatactacgttgctgtcggcttgtccctgtctcttttatggtgcacctatattgtattttttttcccccaagttttcatttaccctttcgcaagtctcaaattaattcgattctagaataagaggagatggagacgcaccgaaggctctgaacatgcaagaacctgtaattttttccaatgggagatgatcaaggtcagactgaaaatgtgggttcatgaaaagtcttcaaaggcggccaatgacttctctcatacacactgccaattccaacagcaaagttcatgaaaaaactacggcgaccactcgaggagaaagtctttctgcccatcgagagagaatgtacactgtacatgtcaccaaaaaatcattaacatttttttatatataagatggatcaatatgcagagcgctgtagagaccgatgtgcagtactccctctggttctataataattgacgttttggacaaggttgagatcaaacttttataattttgaccatcaataactttaagaatatttagtttaaaaaaactagaaaaacatatatagatttatctttcaaagcactataataaaagtaaacatgcatttatttattgtgtatattataatagaaaaataaggtcaaagatatattttgtagaccgtgccattgtctaaaacgtcaattagaatgaaatcggagggagtaagtgtatatcatgattcatgacatagttcagaatttcagatatcacatattgtttgagtcgagtggtagcatgcagcgatatctgatgaaacatagaaaacggactacaaggggcactaataaagtagtaataaccgagtagaaattgcatagtactactacaaattaaaggaactgattcatttttaatgtcactattaagaacttgttccctttgaaagtcattatataaagcattatattccgaacttaggaggaaagcagaagaccttaagaataaagtttatgaacacatggtaccatttcaaagtcgagaagagagatcattgcctcattggtggccagttcagttactcagttgggtagttcacccacttgacttgacccatgcagttcctgtttatctgtctttttcatcaggcattgatgcccaattacccatattaccatcactcaaactcaattatcatgtgcttgatgtactatattttagcatccttctgttttcatagacagaaccacacctaccaagcaaagttgggccgaaataggatttttacatgctgggccaatataagttgggccgcaacgggattcacacattgggtgcagagtttacatgcttatggaaatcttcagtaatattgtcaactgaggcagcacttacatggcaatacatggacagattttgtttctttgaagaacaacgtagagcggtagaggacatattgacagtgtgcagcacctagcaattgtatttgaatacatcctgacattcgatcttcatcttatcagtatgtatgtttgtggattttgcaccccacattcctattacagagttcagacaacaccattgctagatg

SEQ ID NO: 77990 - DNA, 24839 bp, Oryza sativa
aacatcgatccatcatcttgtaaatattttgttccaaacacaaaatgaccacgtacgggcagcttgcaacaaaaactgctctactagttcattgctcgccaattggccattggtactcgaagagtacatgttcatcttggaaaaaaatggaaagctgaacagaatatgaaaaggtgaggatcttggaactggtccggaatctatgccttttgtgcatttttatatgttctataatcctcacattaaaaagcttgctttcgagcactaatcatgcatactatttcttttgaaacaaaagctctaatcatgatgcatgcatggtgacattggtgagtaagaaatatttgaaagggccgaaatgagaggcctgcatgcgccatgacgactccacgcgttgctgcccacggaaaaggcgccgtttagccaaaagatgagcgaaaagatgtcaaatttacttatattgattcggcgccgtaaagcaagatcacaacaactttaaaatggttcaaccgtaagaattaatattaaagtaatagtacgatacaagtttagcaatataattaccatattctttttttccataggaggagtgcattataggaaataccatacataagtgttaggtttcatattttcaacatacaagttctagaaaatagcatcgcatatagctaatttctctatgaaattatttcaccgttatggctctatcaatcccgtccaacccactaaacgtataaaaacactcttgcttgcttggccacctcctcccatagcatcgccaacattagcaaggctttatggccacctgaatcgcgctacactcttgagtggagctacatggctatccttgatgatgttgcctccatgtctcccatgctcctcttgctcagccatcgtagcttttcctccgctcggcgtgaggccaactcctagttcggcagagccaacaaacaaagtggctggattggagacacgcaagaaggcagcaccgataatacccgtccatccagtgcaccctgagcttgcagtggacaaatctggcacgcctcatcctctaggcatcccatcactcaatggtcatcagttgaccttggaaatgaggaggccgctaggaagacgaaccgggaggcgatttctgagtctattgtggatgaatttggctcgactagatcttgtaggtggtaatgtggtgctattgggagcgcaacctccatggataagagccatcactcccacaactaaaatcaaccgccagaccctgtgtaggagacgcacctcccgttggccatcgcctggaactcaacgccatttgccggatgtccgttgtctgtcgccgttgttttagcgtgtacgttgggaatttggggatttgacgttgttaaccgagtggtagaattgtatttttctatcgcctaactgacaacttctactatcaaattaacgacgatgccatttctctgacctattaatttgtaagatggtatatatttttacagcaaaacatagaatttaacacttgtcgatggtatttatttctaaaatatatctatttccataaattggtgagatggcactacgtacgtccataaatatattctgaaaagcaaactacacataaattaaatacggttacggtttgtccatacttaatacctgcattgatcaggtcggtacgcgatgcatgattggatccggccagaactttgcctgcagcgccagccagccaaaacctgagctaagcttgcaactgatacttgttagagcaagtttaatattatagcccactactagctttaattcatctatagccaatctaatagttaattcatacaatagttgtttattatactattaatatatggtcccacctgccatacacacattatgtcttggagtccgtgctgcagctgactataaatctgtaggccgctgctcttctctctcttcctttatctctttaaaatatgtttacagctggcttatagcctctattgtacctgctcttagtaatcctccagatagaatcaatagtttggtttaatttaatttggtgttggtttggatctgaaatccccaggaagctacggaacaaaaatcaaaatggcgatggcgaagcacatgatcatcctcatccccggcgccacatcgcatgcattttcttctcttcacgatgttcgtgcttgcacacaccggccattgctaaccttcacatgacagcctcacatggaatgttctcccgttgttgctaccactagagtttgttgagtcggcgacacgcatcaatacaaaacattcgtcagttgagttttgagacattagggctgcaagttggagactattatgaatgaatgaatgaattgaatgtatatattgctgcgtggaattattgttgggatgcagatctgataggcctctgttgtcgtttctaatttctaacaggggtacaatcatatctcatctagaaaaatagtactacaatctctgtttttgtggtagcattccctgtaggctgtaatgcttgttggagcttcaccatgcatgcaagctaggcagaatattttgtcatgatttaaaaaatttatccttcgatcaattttatattagaacaaaatttacaaaatctactatgtaataagtttatgatattgtgatagtatttttcaaggtaaaactacgacatctcaacatttattatgctactatacgagtagtaccagcttttaatgccataaagaatttatccaatttcttatttcttatttgcgtagcagttgagattgtgctgaaattttcaatggtgtaaaaggaattgtttttttattcttacgtatacaatttttgttacattttttcaggtccctctgtaatatgggattgagaaaatgaaggaaaaaacatagaattttaacatgaatgcacgtgtaaaacaaatagttacaaaagacatgaaaaacataaaaaatatcatttaattggatcacagtgaaaacacataaatttgaggagatataaagactcgtagaaaactttccatgaggttctacttcatgttaaatttcctcgaaaacttacatgaaatgaagttcctcatatgaatttgggattctgtagtgtccattcatttgattcaacgatctatatagaaaaatcctataaaatgaaacctcctctaaaattcctactattttcctttgaatcaaggggccttatctttaggacccatttgaatcgtagaaataaaaaaacgtagaaattaaaaaacacatgattctaactaaaatgtaattataaaacatataatgcaaaacaaaacaaaaatactggaatgattgttcgattggaccatgggaaaaaatacatgaatcaaatgagaggtagaatcaaagcaatttgttttcaaggggttagaattcttgctaagttcccttcaaaatctctatatgattgtctattccatagaaatttcaaatgatgagaaatgattcgataatctatttcaaatactttcatatgaaattgttctatagaattaaaatcctctgaaatttgtatatttttttccctacaaatcaaagaacttgttaatgtgtactccctcatcgcttgttcgtaaataagggattctaggttgatgtctttgaagtttcacaaattgaaaaggtcatgtttgataataaatgtagtggttagatggattatattgcaatattttcccaccttatgttctgagcgaggattgccatttgtatcaagtgaaacaggataaacaccggatgatttgctttgctgtgggctgttgacgagagaccacatggataaaaattatccaaatctacagggggtatttgtgtcaatcaggccattgttcatgtcgtcatcctacagttccaagctacacgaatctccaggtgagaacaaattttttttgctgtagctcctctttcgtcagtcccgactcccgacacgaggcctcgcaacccgggtcacctggtcaaaaccagagggcccacacagcgcatttccggggaacacccgggcccaccctcgtgctcccacccaacacgcctgaccagaaaataccattctttttttatttttaccaacacgtattgccaataatatttttcaatgttaggccgcatttagttgtattttttttttcaaacttctaacttttccatcacatcgtttcaattttaaccaaacttccaattttagtgggaactaaacacagccttacagcaccttacttcaaccatactcgtataataaaatactactccctcaaatattaggaaaattgatgtcctcaatttgtatagcaagagaaaatagaaaaagtcgctctcaatacaagagatagttaaacatgttttcatgcattgaacatatagtactactgcatttcagtataccttccatttcaaaaaaaaaaactcaattctaattacgaacttggacacgtaggtgttcatattcatagttaatatgatttactactatttttttttacatagtactagtgctcttgaataatgcgtcatttcatggaaaaaaagtgaagctgaatttatatatggaaatgaaaaaaatcgttttagtgcagtcgctgtcacatggaggtgggcccgggaggcgccgaccggcagtgaccacgtcagcaactgaattttatacttacgtcctcagtttaaggaatgtgtttttacaagtggcagaaagaaacaattctcgcactgtcatttctttgttcttggttatatacagtacggattaggagcccaatccctttctttaagtactcaattgacaatattttactactccagtttctgtacaatgttgatgcagtatgagtggttttaagtcattcctaaccccggatgctcaggccagttgggcattgcttgatagagaccatagtcgtaataaattcaatggtagaagtactaactatttatgccttgtttttttccttaagattattcaccaaaattttcaaaatggactagtttctccacttgcttaaataaaacattttctaaaaaaaatgcttaagctattacgactgtgctgccacagctagcacaaacgaacaccctcaatctttttggctttatattggtatttgtgggatgggtgagaaatgaacttattttgggatgaagataatatataataaagtactccctccatcctaaaatgtaggtatttttagttatgaatctagacatactgattcataggtaaaaattactatattttgggatggaggtagtacataacacatagcaataactcgctgaatagtctaaaacaaacgtggtctaagtaaatttatctttgtgtaaactttttatgtactacattcagctagtactataaatttaaatttgtagacactgtcagcactaatcaatcacgatagaaacatgggggaatttgggcaaatatcataacaagaaagtgttacactcgatcagtgtcacaccctctcttttggagacgcacacaacacaagagaaaaaaagcaaagcaaaccaaaccaaaccaaaaaaggcgtaaacacaaaagcaaggcagcgttttgcgcgtgaacccccaaatccaaaaaacgagttttgcgtgacacggtttacgaggccgtggcacgcgaaaagatctgagccgtcgatgaggagcagtgtgcacgcgacggcaaccagcgccgcgccgtgggtggcgttcacacggtgggccccgatcggatgacgcggcagcctttcccgattcggccgtggggatctcgccacgtggcatgatggcgatggccccaccggccaggggcccagggatcccttttgtgggggccatgatgtcggcgtgtcgtcctgtcgatcgatctctcgtgggttttatgcatcgaccgttatttcggttgagctcaaatgcgtacggagagtggagtggagtacattgggaatcctattgtcatttggtgcttttatctcggtttcatctcatgttacctcacttcgtcgtgaggattagaccattcccaactcgatgaatacgatgatgtccataatattaaataagctgtcacctataatgaaaaatgatatgacaagtggataaatgaggaaagagaaggaaaccatgtcttacatgagacatgatttctacacaacatacaagacatcatgtgagataagtagcattaaattcaagtatggaatagtggtgtttgcattggaagaatagtgtctagtactagtttcttgatgatgtggagtttatggaaactatgcctagtgtcttgggttgggaatagccttacatttgagtacttcggtccggttgtattcttaagtcaggccttgtttagttcccaattttttttccaaaaacatcacatcgaatctttagacatatgcatggagcattaaatatagataaaaaaaataattacacaatttgtatgaaaatcgcgagacgatcttttgagcctgattagtccatgattagccatagtgctacagtaaacaacatgtgctaatgatggattaattaggcttaataaattcttctcgcgttttcaagcgagttatgaaattagttttttcattcgtgtccgaaaaccccttccgacatcaggtcaaacatccgatgtgacacccaaaaaatttcttttcgcaagctaaacaacgcctcaatgtttcaacttcatttatcttgttttccgcaagcaagtttttcaaactgttaagtatcgtttttctaaaaaaaatctataggaacttgtttttttttaaaaaaatattcatacgtttttaacttttgttagctaatacttaattaattatacagttatgcatgcttcattttacatgtcaggaaggaggggttcccgaccccttctcctgaacacgcctagatggttctaatagccggtgagtggcaaacacatccatcaaatgtaatttaaaggagtattgtgggttttttttgcccaagtttatattcgttgttgatgtggatactatagccatgtttagttcctaaaaaattttgctaaaaaacgtcacatcgaatctttagacatatgcatggaatattaaatatagattaaaagactaattgcataatttgtatgaaaatcgcgagacgaatcttttgagccaaattagtccatgattagccataaaagtgctacagtaacccacatgtgctaatgatggattaattaggcttaataaattcgtctcgcggtttccagacgagttatgaaattagtttttttattcgtgtccgaaaaccccttccgacgtccagtcaaacgttcgatgtgacgtccacaaattttcttttcgcaaactaaacacaccctgtaatagtcaccgtagacatgtggttttttctctctctttttctttaagaaaacaaattgttatcttcttgattgaatgattgccatatatgccaagccaaggttatcttcttgtacgcttatatttgcgaagcactaccaatatgcgatcttttatgtgtttatttgaaacatgagtattctcttaattcttgtaaaatataaattaattactttgaaattttgatgaaattattgcatttggaaggagctctattaaactattaaagtaatagaaacccaaaagaaatagaaactattaaagtagtccggtaattgtgactggacaatgtaaagaaatgctttgcttttattagcacacaaattactatagtatctcccactattgtaccatttaggttctcaatcccttttagcccaacaatttaataacaacaactgtagttgtagtttttattataggaattgatgagactactattggtgatgttgttttgccctagcagatatgggcagctaggcaagggggcaatcatgctcctaaatattcccctgagcaagatgcccataacaaaagatgaagctaagcaatgtaattagtttaattacaagtgggggtgattagtttaaagatgtgcacatggcaatgatggagctggtgaggaaggccacaggagattagttggcctgtgcatatgcatgcttgcacacctgtgttcccggctttgctctctccaattatcaagggccacactctttgtgcttacatcgatcaaacccaagtctaaaagcaggggattaggggcagtaggtttggtgaaagtatccaaaaacggattagtttaatcttagattgtactagtagtagtaccaactagtatgtgtttgcaaaaataaaaatgcttattggagatgttttcaggtgacctaatggaacatttcttcggagaacatggaatctgtcccaaggcatttcttatttgtatgatagggatgtgaatttttcttgtactattacacttgacaatttgattttttatttgactctatggtgaggttacttccaacaaatgtttgtagcagtaacttattactgtgcacatagtgaggagtatttttatgggagcatttcagattttttaaggaggaagcaaacttttgctttgatccttgggattccaagttcctgtttgatttttattcatgttgattccatcaatcccccggtcccatccaccaaacaatcccaattcccaagcttcaagtaacctgtgaaagcttcaggctgcgtcaaggtcaaaattagcggcgacgatttatactgctaatgatgctcgtgccagtgagattactgtttgttggtagataaacacacaaactatactcaagtcaaagggctcaaagaaaaaaccacgaaaagttcagctcccttcacttcagcggtgaagaggattattaaaagttgcaaatgtttcgtttgttcagatgaaatcatggaacggttaaatatgataatacagtatatagtattgtactagtaatgattatatatggttaacagaagtagagatagaatggtctgaagaattgcaaaggccacatggccaattcaactcaaaaatgattctcctactctttccacaatagttcaaccgttttgttttagtagtagaacttcatcctgcaattctacctcacaatgcgaaaatacaacatactgtgtaaccataagttcttttgcagtataaccatatcttcttgtttaaaagaaatcaatcactgtactagaataactacagtcaaaccataaccgtccatttgagtactctaatatttagtgcataatatgtcaaagaacaattgactattactgttatatctccgaattatcggggagcacgtttaaccaaggataaatttctaaaagtgtgccacaactttagaaggaatccaaattttgtactcaaggaaaagagctaaattttcaacgcggagagaccatgttctttcctgcttagggatgaatggatgaattcgctttcggatcttgtagacatgcaattatttcaaaaagaataattcttagtgaactattttaagttcagttttgaccttcaaaataatagttactcctaattcatgtacttttaccctcaaatgttttgtgtttgagaggagaaccaatccctcctctgcacgcaaaacagagcggccttttaatattagttaatttttttaaaaaatagatcaatataattttttaaaacaactttcgtatatatattttttttaaaaaatgcaccatttaatagtttgaaaagcgtacgcgtgaaaacgattagtaaggtgggttgggaaaagggagcgccgaactcagccgtaacaagaaacaatatgagagttaagccattaacactaattgattatttaataattactccaaacttaaacaatactctcagtacgagagtatattaatacaatttactccctttgtccttaaaaaaattcaacctagtaggatgtgtcataatataacgaatctggacagagggtctaggttgcatttttttacagagggaatactaaataatgttttttaaaatctgatattcattgtcctgaattcaaaacactgtaaattaatttggtgtgagcctagcaggagagggtgtaggacccacacaaggcagagagaacaaaatgggagcagaagtgagagaagaagaagaggatgggtgtagctgtagctgacctccttccacctctcgcacacgcacaataacaaaccacttttaattccccgaggagagcagagagctcgaagcaaacaagaatcacaggagcgagcacggcaggctgcagcatcaccaccaccctactctctctctctagctagggttgcgctgcttcggtctcggtcttggcgccgcctgcctcgcccttcttgctcgcccctgctcccctgtccctctcgtgtcggggcgacggacggacatcctcacccgcgcgcacgtacgggtgatcgatcgattgattcctgctccgacgaagacggcggcggcgccggtgacctcgccggacatgcgcggggcccgctgaggtctttgttgccggcgaaaggggtggagtgattgactcggtcggtgtctgcctgtctggtctgaggtcatgatgaagcaggcgcagcagcagccgccgccgccaccggcgagctctgcggcgacgacgaccaccgcgatggcagccgctgcggcggcggcggtggtggggagcgggtgcgaaggtaggacgagttcttgctttgcttgctgcttccaatggcggttcgggatggagcagtggttgccttgccgtgttcttgtttctgcaatctggtccctgttttatcgcgttattatttcgccacaaaattaggcaaataaatcctttcttattcttcttggattttggattactgcatttttttttctctgcatttttgttcctgtgatttctggcgagcgtcgcagcatttactgttccacatttatgccccctcaaagtttgagtaatcgcaacataggagtacgagtagctgctactgcagtgctaagccatgtgcagagattaattggtttgtgtaaaaacctggtcgtttagggggcgaactgcaaattacacacaagctcgccggcggcgtagggcaaaatgcatttggtcatttggatcatccagcttacggcgagattattagggaaaaaagttttcactgttttgtttggttactgattggccgtggtgttttgcaggggagaagacgaaggcgccggcgatcaactcggagctgtggcacgcctgcgcggggccgctggtgtcgctgccgccggcgggcagcctcgtcgtctacttcccccagggccacagcgagcaggtgacttcgaagttctattgatttttttttcttctttgtttcattttcatagccatggatggcctcgttttgagaccctttttaattgactttttgttcttatgattctagtttttttttggtttgctttttttaaaaataagaattctaattcgtctcgttctgaatgttgatgattcttgcacgaataagttcacaacttgctgtccttttatgagttcttgagaggtggaatgcttttttttttgtttggtgttccattttgttcagtagtggtggcagttataattatatgatgggaataatgggatgtgtttctagggccaaaatgatatattttgttcacatctttatttctgggaatgtttcacttatcgcctaggagtatatgtctcctggaatcttttctgaattcatgtatcttctgttgccgaaaagtagtagtattatcttttcatgaattgttttttttggttctttgatattacagccatcattgatctatttggtaatttgattttctatgttttatacgatgtgggagatctcgattggtctgtttgttcattgtactttattttgtttcattagctaccaatttttagcttatggccaaagtggttggaagtattgggcatactggacccccttcttttatgggtttatggtgtgtggcaccattctcttgctctgtcgtttggtagatgaagcagccaagcagcttcgatttttttttcgcatttaatggtaattacattcagtagcttcttttgcaactttcttggctttggtgttggggctaccttattttgagcaagtttgaagtatggggtgatgaactgtttggatttggaaaagattctttatctaaaagctagtgctggaaggtgcctaattctgtattggtttttcctatcccttttgtgatgatgagaaaaagggaacttttttagtaaccgtgtgatggctatgtcctcatagcacatgccgatgtgaggcaagagaaagttttgctgtggcttaattaatataaaacgaatttatgctttaaacttaaattcagcctaatgttggtcatgcttttttgtgtggggaaattgctgtggttgaagtagggaacattttgtaaaagggagaagagttacatagagaatttaaaataaaacttaagcaacataaaaataatatttgtaaaaattcggttgccattttttcctgtgattttcatcgtgatcgagtaccctttggcctttgtttccctgtgactgatgattttttgttgataaggtcccagtatcaacagatttatatctgcatccttctgattccagtgtgaaaattgttgcttagagccacagatttaagtatctttcatattgcaggttgcagcctctatgcaaaaggatgttgatgcacatgttccaagctacccaaatctgccttcaaagttgatttgccttctgcataacgtcactttacatgtaatctacagacgtgagatgttattatagtttctttttacctttaaccatctatgctgaaagtatggtccatctatatttcttaggcggacccagaaacagatgaagtgtatgcacaaatgactcttcagccagttacttcagtaagcatctgatgcccttgcagatccccaacaaattttcatcgatttcccttttgttcatggattgtaacccaccttttgtgtttcaattgattgtgtattgaaaagtatgggaaggaggccctgcagttatcagagcttgcactcaaacaagcgagaccacagacagaattcttttgcaagacactgactgcaagtgatacaagtactcatggaggcttctctgtgcctcgtcgagctgcagaaaagatatttcctccactggtatgcaaagatcagagtcatatgccattgtttacttcattttctgcatctttattattaaatcactggtgcttgctgtaggacttctcaatgcaaccacctgcacaagaactacaggccagggatttgcatgataatgtgtggacattccgtcacatatatcggggtaagcaaacaatagcaacgataaaaataaagaaaatatatagtataacaaatgaaaaattctgctgttgacatcctactttatagttgttgatacttaatatttggcatgattggctgaaattgtgtgcatatgcatgttttgttctttacgcatggcagttcctgtattcaaacttcaaattattgtgtttttatgtaatatatgtggctcgatatgtattttgtccagacaaaatatttaatcgcccatgtgttttgatataaacaggtcagccaaaaaggcatctgcttaccactggctggagtctatttgtaagcggcaagaggttatttgctggagattctgtcatttttgtcaggtatgctacagcttatatgctatatctttaaagtttgaactaaatgatgagaacaagagatgcatgatgttttcttgttttttgtggttattcacatcgatttaacggtggtcttctttctttttcctttttattttttagggatgaaaagcagcaacttctattaggaatcaggcgtgctaaccgacagccaactaacatatcatcatctgtcctttcaagtgacagcatgcacatagggattcttgctgctgcagcccatgctgctgccaacaatagcccatttaccatcttttataaccctaggtcagttctgtactaaagtatgttttgataattctctagtagtaactactggagagctgttgaaatgatggtatgcaaattccgtatttcagggccagtcctactgaatttgttatcccatttgctaagtatcagaaggcagtctatggtaatcaaatatctttagggatgcgctttcgcatgatgtttgagactgaggaattaggaacacgaaggtacttttttctcacttttccataaatggaaataattgtggactgaattgccatattatatgattatacatgtcaatgacaaagctgggaatgattcttaattttctttttaaattttttgttgttgttttcttgcccttattgcagatacatgggaacaataactggcataagtgatctagatccagtaagatggaaaaactcgcagtggcgcaacttacaggtttgttctctggttaattttggcagcactataacctagtatttcttgtgcccattttctgctgctgatacaatatattttgtgttttttcattcttgaacaggttggttgggatgaatccgcagccggtgaaaggcgaaatagggtttctatctgggagattgaaccggtcgctgctccatttttcatatgtcctccaccattttttggtgcgaagcggcccaggcaattaggtgagctctcatgttacattgccattacttcttttatattctttaactgctcttgaatccagttattgatccaggagaataccccttagtcatttgttatgtctagctactagcttggaaaatatacctgcaaccaagctttacctttgagatgacaatctggataacataccttttgagttgtacgcacccaactgatttgagctaattatcgaattctagtggtgttgtgaattcaaatagatgaattgtttcactaaactgcttgtatgtatgcttaacttttgatccctaccatgtaattacagatgacgagtcctcggaaatggagaatctcttaaagagggctatgccttggcttggtgaggaaatatgcataaaggatcctcagactcagaacaccataatgcctgggctgagcttggttcagtggatgaacatgaacatgcaacagagctcctcatttgcgaatacagccatgcagtctgagtaccttcgatcattgagcaaccccaacatgcaaaatcttggtgccgccgatctctctaggcaattatgcctgcagaaccagcttcttcaacagaacaatatacagtttaatactcccaaactttctcagcaaatgcagccagtcaatgagttagcaaaggcaggcattccgttgaatcagcttggtgtgagcaccaaacctcaggaacagattcatgatgctagcaaccttcagaggcaacaaccttccatgaaccatatgcttcctttgagccaagctcaaaccaatcttggccaagctcaggtccttgtccaaaatcaaatgcaacagcaacatgcatcttcaactcaaggtcaacaaccagctaccagccagcccttgcttctgccccagcagcagcaacagcagcagcagcagcagcaacaacaacaacaacagcaacaacaacaaaaattgctacaacagcagcagcaacagcttttgctccagcaacagcagcaattgagtaagatgcctgcacagttgtcaagtctggcgaatcagcagtttcagctaactgatcaacagcttcagctgcaactgttacaaaaactacagcaacaacagcagtcattgctttcacaacctgcagtcacccttgcacaattacctctgatccaagaacagcagaagttacttctggatatgcaacagcagctgtcaaactcccaaacactttcccaacaacaaatgatgcctcaacaaagtaccaaggttccatcacagaacacaccattgccactgcctgtgcaacaagagccacaacagaagcttctacagaagcaagcgatgctagcagacacttcagaagctgccgttccgccgaccacatcagtcaatgtcatttcaacaactggaagccctttgatgacaactggtgctactcattctgtacttacagaagaaatcccttcttgttcaacatcaccatccacagctaatggcaatcaccttctacaaccaatacttggtaggaacaaacattgtagcatgatcaacacagaaaaggttcctcagtctgctgctcctatgtcagttccaagctcccttgaagctgtcacagcaaccccgagaatgatgaaggattcaccaaagttgaaccataatgttaaacaaagtgtagtggcttcaaaattagcaaatgctgggactggttctcaaaattatgtgaacaatccacctccaacggactatctggaaactgcttcttccgcaacttcagtgtggctttcccagaatgatggacttctacatcaaaatttccctatgtccaacttcaaccagccacagatgttcaaagatgctcctcctgatgctgaaattcatgctgctaatacaagtaacaatgcattgtttggaatcaatggtgatggtccgctgggcttccctataggactaggaacagatgatttcctgtcgaatggaattgatgctgccaagtacgagaaccatatctcaacagaaattgataatagctacagaattccgaaggatgcccagcaagaaatatcatcctcaatggtttcacagtcatttggtgcatcagatatggcatttaattcaattgattccacgatcaacgatggtggctttttgaaccggagttcttggcctcctgccgctcccttaaagaggatgaggacattcaccaaggtcagtacctttctgtttctttatctgaagccaaccaacagcttcttctgtggtcagcgtgaattttaattataagtaaacatgaagctttttatctttttcattaccatggtaacaataatttaaacttgcgatggtagtttcatctactggaaactaagttctcatttattaaccttcaaaacattgaagtaaatgtgcatatggataagccgaattgcatgataagtctgagtcagattctgttccgtgatgtgatgaggacagtatgagtagtttttttttttggttgcctaggagatgttaagaagttttatggttgagtttctagccgaacataacttttatgtgcgaatctcacatgtttgtattaattatactctttaagataagagttttctaagtgtaacttcaggataaatctgttaaacgaagcaccgtttctttgttgtattatagcattttatggatgcatttgcagttgcatctttgcataactatatggtactgtaggtatataagcgaggagctgtaggccggtccattgacatgagtcagttctctggatatgatgaattaaagcatgctctggcacggatgttcagtatagaggggcaacttgaggaacggcagagaattggttggaagctcgtttacaaggatcatgaagatgacatcctacttcttggcgacgacccatgggagtaagttcagctctcattttcttctcatgcttgcataaaacactctcaagtttcgcttccagaatctgaatggatagatggccgcattccacccacaatcaacatcgcctatgtatcgggcattcatgttcttgcattcctaatgagtgctactgtggatcatacagggaatttgtcggttgcgtgaaatgcattaggatcctttcacctcaagaagttcagcagatgagcttggagggttgtgatctcgggaacaacattcccccgaatcaggcctgcagcagctcagacggagggaatgcatggagggctcgctgcgatcagaactccggtaacccttccaatggttcatatgaacaattcgaatgaccaaattcaccagtccatattgtcatgctgcgccggtgtaagtagacaatcaccggagtgttgttgtagatgttatcagcttacatccgggagcgcaaatggctcggcggatcagtagtgttttttttgtctatatgtgtagtttctcacacatcaaaagggagtagggatggtaaatgaaacttacctagagtttcttaaggttaggcgaaagatgattgtactgttggaaaggcagttctgtagtaaaatgattcttcttcagaggccattcttaagatctccatgatgaaatcaaaagttgaagatgtcaggtctgtgttttttgagtcgtatgcatttgctttttgcaaatgttatgtcgggttattcttcaggtattggaatactgcgtaatttccataggacaaacggtttttgccaacatgagtgctaatttttaacaaaaaaaaaaataaaagttactactgcaaaaaaatacagaacacaaagcccttccctaacctatgctaaagatcatgaatcaccacttcaccagcacacattggaccaacagaaatcacagtagaaactttattcttacatgtattattaatggatgatgctataaagtataaagattacactctcgaggagatgggttatttcatactaacatgctaatacagcgaactgccatttcactatatatatcggctattggcgaatattgcaatgtagtccttcaaatctcaacctgggtcgtcgtcgtcgtcgtcccaggctgttggatttcctgcatgaatgattggtaggtttcaaccctggacttggattcaggctgttcgaggccatccatgaacccgtgggtcatcgcaaggaaatctttcatgtgcaacctcttccattcctgcaggggaaaaaaatgaatgagctcaaaatggatatcacacaatcgtaataaccactgtcaattttatcaattcagttaagcatgaagacagtttaagtacaggtgtgagaatggaagaactaacaaaataacatgggcttaagatcttgtatatatacaaaatggcatcaggtatgaatacagacggaaataccctcacctcaaaatcccattcaccataaagatttggatcctctgcatcagcccatacataggtgtcagcaagcattgtctctgaagtatcctgcaaggacaaatcacctttgtttttagcaaaaccatatcgattttttgacgacgtatcaacagcaaaaaatgtacatgatgaacagaggaagaacattattgtatggcaataacaaataatttcctaagatgtatttttgtgtctcctgcataatacttgctgccagcattgattatgttgacaacgtcagtgaaaaactcacagttaatgatatctcaactcttgtcctcacgtactccacatcttcaaattcatccagaatctggagctctgcatcagtaacaccggtgatgacctgcagaaaaatagtaaccgtaggtaagaggagagagaggttaaaagcttaacaacttcatcttttcgcttatgtttgtacttatcagccaaaatttaaatttttgaccttaaatttagagttgattttggggtttttttattcatcgaagtttattttttagaacacgtatataaaaaatttattcataaattatttttcgtttgtaagtatattgaaaccatagcttcttttcaatgagatttaaggaattgcttgctgtcataacggcctaccgcagttactgtcgaacagtgaacataatagcctaattatatcatgagaatattaaaactcagtaatacaatcagatgttcattatactatggtcaaacttcaaaatagttatttatatatatactctctaggaaagattaatttaatttatgttggaggaagaccaaaaaaaagaaagagaaatagtgtagcaaaccttgccagcaactttcttgctttgaacaggtaggattgcaggataaatcctacccttgatgttgaacctgtggctgcgacaatctcacactttcagcttattgcatctttattatcaatatgaatgaagaacagaataagcacatagatcaatattttttttttgaaaaaaatctcaatctcaatgacgctatcacgcgtcacgatcgacgacgtcaccgggcgcactagctagcgcgagaggaatccattcccggcgagggaggcgaaagcgaatccgcaaaaggggaatctctctctgcagaagaaatcaagaaccctaggagaggaagaggaggaagacggcggcgcttactagttggggaggagcgccggggaggagggcgggacgcgcttgatgatggtgcgcaccacctcgtcctgcatcaggctcccgtacacgaacacgctgtgcgccccgaccccgaccccgactccgtccacggcggcggcggcggcgggtggcggcgccatggcgaggtgggcggcggcggcgataaggactagcggctgccacgtggcgagcgaagggagatggaacgaactctcaactctggctcactcgattcttgtgcgtgtgtgcagactgcagaggtgcagaggaatgcgtgccattatatacaagctgggctctacgtcaagattcgtgctgtgtggtgtggacgtgatcgccgtggagattcccgtctctgcctctccaaagatctgatcagtgtggacatgatctgattcgttttttttttcttgaaaaaaaatagacccgaggcatatataactacggttgaccttaggctgcgttcgggaggagcggttgggaatctcttctccccggcacgtaaaacagagcacgcattactgaatgattaattaagtattagctaatttcttttcgaaaatggattaatttgattttttaagcaacttttgtatagaaacttttttaaaaaaacgtaccggttagcagtttaaaaagcgtgcgtgcgaagagagagagaaggggttgggaggttaaaggtaagaacaacttgagcaaatacctagatacgtaaaaataaattgggtcgtcaagaccaattgagtggaactgattggagtgttatcacaaaatgaacttcagagatagagctgggttaacttcactacaggcttaattcttaaagttaaatttataagttgaaaccttaccaaatagccctcaaatatattactgacataaacccgtgtatgcgctcctttatactagtaccgtattgattgtgtattgtatggcagagattaggatacaaaccattttcgttataaaaaaacatcgaactttttaagagtacaaaaatccagacatgcgacattgcttgataattctaggcataaggtcgttctcaagggaatacaactagtgataatatatgtgtccatactctgctttttcatcgagacatacttatcaccagtatgtatgatcccatgttagttgaacactattaatctatgaggctctaatgtccaataacaattgaaaattcctccaatagaaaggtatttggaagtttggccatggacccttactaattctaagctacattgttacataatccttcatgtgaaatcttgactaatcttaattgaagcttcaataaaaaaaactaaaaaaaaattctatacctactacatatttacaacccattacattctaaatcttaatgtacaaacaaaccatatcactatccgctaataattattacatcttaatactcatgcaaacattccacatcatctactacaatttattaaattaaagctccacatgcaagcatatcaaattatcaccccttatcatttctaagatatctcaacatataccattcatcatttctataatattaagagtacatttatccttgtattcggcagcaaaagcgtgggtcatcattttattacttctactttggtggtcaaaatatctatgcatgatcctcacactatagtttagatcttaggacccatatttactctttttttttaataaagaaaccaacactaatataccaatttcattgaatatagcagaagaaaaggtattgaaaaaaaatgtaggagaaaggaaagcactaaggaagtagaagtgttttgctcctactaaagccaagttttggcctcctccttgatttgtcctccgagagatgtgacatacagttctttgtgtaaaaaaccctatgattcctttcctatcaaatttcccatgccgtaaggaggatgagggtgcaggcttcttttttcagtagtcacatgtgactataatgtgataaaacattttattagatcataatttggttggaactctgttttattgttttatcatgtactccctccgtactcgtagaaagtcgtttaggataatatttaagtcaaaccttgggaatataaaccatgaataactctcaagttgttgcgtttgaaaatgtaaaaattatatgaatatatttgtcttgaaaaatactttcataaaagtatacatatatcacttttcaataaatatttttacagaaacaagaagttaaagttgtgttttcaatactgtgtcgctgtccaaaacaacttcctttacgagtacggagggagtatgtattaaaagaaatacaataatcctctatttctaaataactacaaccaactaactgcaattattgtatactaagtaagttcgattgaattaagtaaaatataattttgctgtggggtctccagtttagacctgaccaaagacttgaaacttgaattcttgaaagatgtaacgcaagcatatgttgcggtcaagttgatgcgcttaatttgcctttggctctctacacattcaaaaaggggaattcaaacgtatttacaaagtgtaacattctagatgaatttgctgccttgtcaaatgtcatgttagtctgatagtctcatgccttgactctgctgcatcaacttattatattcgagtgataactaatttgccttcttttcgaggacctaaatgctaatttgcttgcgaacagaacatgggccaggatattccaaagatattcgagggctggaaaacatgggccatgcccaacttgagcaaaacggacagcccataaaccgggagtacctatacatctttcgaaagatttttatgatcgtatcacatagatttttaatctttagattaaaatccgatatatataataaaaggcaaaaagcaattaagaaacaccataatggatactaaattaccatatcctcaagaaaaagaccaaatccaatacaaaatttaaaatttacatgcgaagattcaaaaattacagtgtaactaacaaaagttacagtgtaagtttcataaattacactgtaacttataagaaaaggcactgtaaatttgagtgagaaaatcgagtgagagataagaaaaaatctttcgagtgagatatagcaaaatcgtaaagggatatattcatggccgagaagacccaacaaacatgggccaggcccaaattgagcaatgcgggacagcccataaagggtgctatttatggcccagaaggcccaccaaacatgggccaggcacaacgtggaacaaacaggacggcccatgagggcactaataaggcccatccgatcaagcggcccgcccatccactccgtctccacccaacggcggaggcgacgacccgatattccgatccgccggcgccggcgccgccagtcgccgactttatcggccgtgcggctcactccactccgggcgccgccgccgctgatcgccggcttcatcaaggattcctcctctcctattgggaagcttcgggctcctctttttttcctgtgagtagcaagggctcagcgcgtttattatccactccgtttattacaattccagttgcttttttttattattattatttcctcttcttctcaaccacgtctcctcctctccgacgcagcaaggaggagatcccctgcggcggcgccgtcgagccggtgggggaagggagagcttgaggcggaggcggaggcagagcgtgagctccgaaccaccaccatggggacctctgcgcaggagccaaatctctggaagcaaatcgacgacgccgagcagtaagatcaaatcctcccccacatggttcgtagtcgcattagcctaggtcttaaagtagttcatcttggttgcttgtttagtcaggtaattgaatcgcgagttcgcgactgcctcgctgaattatgtagtataagacggtagcgaattgagctaggttttcagttcgcgtagcgcaaaagggcagggaatttagccggatttgtagacatgcttgccaggatgaatgccatgtaaaatacactgttcttattctggaatctggatgactttaggagcagtcaaccatatactgtataattgtgctttacaatttacgcaagcatgtaaagttccaaatggtgaataaaaggttttaaacttgtttacttaagttgacatcctgatggctcagctatctggtcagcggattgttcgagcaggccgtatccactgccttatctgtatccagtcaagtacattcggctgccatggagaattcatgcgaccatgatgagcttctggaaatgcttgaattagctgggatggtacttgttcaggcgcttaaagaacttaagaggtaaatccattacctttcctcattttattgcttttatgctctgaccaaatctaaggttcttatacattctgtaattagagagaatgctgcctggtaaagcaaatttaagttttccattgcttctctatgataatacaagtataagttattttttatgggcttctgattttgcccaagaaaaaatatcttcacgagtaactgtatataatcataatatctgtcttgtttcctggtgaaacttccttaataccc

SEQ ID NO: 77991 - DNA, 2839 bp, Oryza sativa
tttacccttggatgatcaaaaaattcatgaattacattattaaaaatataaaagcttctcgcatgagactattatagttatgagtttgttgtgcgatgcattatttatcccaaaaaaatatttttagataatgaaataaaaaaaatacgtatttattttttaaaaaaaaggtcataaaaatgaggagcattcatataaagataggtataccaatgttcacaacatttttttttatgaatgctcctgataaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatttgcaaccaaacgtaacattaaaatgatggaaaatgtaacggtaggggcatggaagggatcaaattgaaatttcaggggtatagaagggatcgggtaaattttagtggtataaaagggattgagtgagttttcaggggtacccagggaatttactctttttttttccctttcatatagcaaatcggtaggagtcggactttttttaaaaaaaatttcgctatttttttttgaccggacctggaatcggtagagtcggactttttttttatttttggatcggactcttttttcgcccagtttttttcccaaggttttttttagccagttttttttcgctcttttttttttatcggacgttttttttttctcccggtttttttctttttttgatcggactcttttttttcatccgggttttttccgcctggttttttacggatgataaaagcacctcttgtttttttaaaagtaagcagagattacggccagttggaccttcccttctggaaccatccacggccttccaaacccctcccgccaacccccgtcttctctctcgaaccatccgtccccaaaatccgccttctccactctccaccctcgtcctcgagcttcgtcgaacactctagaacctccataaatacccacctccaccacactattataacaacctcgcctcccttccctcgctcttcccaagtcacagctacgcacgcacgcacgcgcaccacgaaccagcacgcgcaccacccaatggcggacgacgcgtacgacgacctcccaatggccggcgcggaggaggaggtggacgacgtgatgaaggacgagctcgacgaggagggggactcctcctccccggtggcaatgaaggtcggggaggagaaggagatcgggaagcaggggctcaggaagaggctcctccacgaaggggaagggatgggatcgccccgaatccggcgacgaggtccaaggttagtaggcgcccaccatgcctgtgattcttcatcctcccgttgattcgaatcacacgaatccattcaagcacgcagagcgttgaataattcgaatttttttgtttgtttttgtttatttcagttcactacaccggcactctcctcgacggaaccaagttcgattccagccgcgatcgtggaacccccttcaaattcagcctcggccaaggtgcggatcggattcccaatttccccccacatttcgtcgcaatattcaccatagttgaattgaattgccgaatcgtactgaatttttttgaaaaatctgcaggggaggtgatcaaggggtgggatgagggtatcaagacgatgaagaagggggagcaggcggtgttcaccgttccgccggagctcgcctacggcgaggccggctcgccgccggcgatcccgcccaacgccacgctgcggttcgacgtcgagctgctctcctgggccagcgtcaaggacatctgcaaggacggcggaatcttcaagaaggtgctcgccgagggacacaagtgggagaatcccaaggacctcgacgaggtgctcggtacgtttcaaaattttgttcgaacgaaatctcaagtcgaaacgagaatcaggagaaaattttcaaatgagaagaccattttagcattattgtgatcattttaaattcagttcaacacagcaaatagtaacatatggggtatgatgaatttctatgaaattcaggaagatggcaagtttctgaaaatttcaaattggaagactattttagatttttgttcttctcattttaaagtccgtgaaacaaagtgagacagtaagataaggggcagaaggaatttctacaaaattaaagaaaaatataggcgaatttcgaaattgcatacactgattggtggtttggtaaattggtatccatcagtgaaaattctcttatactgaaatggttgctaaactttttttttgaaagaatggttgcaaaacttgttctctatttgcagtcaagtacgaagcgaggctcgaagacggaactgtggtatcgaaatctgacggtgttgagtttgctgtcaaagatggtttgtatcccctgcatcattgagcctctgcaattcagaatttaaccctgaaaaatgccatgtcactctccgatgaacataattctgtttatcttcaggctatttctgcccggcgctttcaaaggctgtcaagacgatgagaagggcgagaaggtcctctcactgtcaagccacaatgtgagtcaatcggagtcctcctttcaagagattttgcaactaatctatgtctttggtggtaatgttctgatgatcttggaaatggcattgttgagtgctgacatgcacttttctgatctgtagatggctttggtgagcaaggcaaa

SEQ ID NO: 77992 - DNA, 638 bp, Oryza sativa
cacacttacctcagctcagatgcgcttgtttctcaccattgttgcttgttgaactgctgcagaaggtgcctgggaagcaggaggcacagcctatggccattgacagtgccgcttgaggattagctctgctttcttttttctgaacctggttactgctagtactactgtctctactggttgtatgagtatgaaatatgaatggaaaatggtagttaatttgccctttgcttgatagttgcagtctttgcaactctgcacccatatgtgctcagctttgtacgagaagtggttgccgtcatttgaagatgtgatgctgtgattgtattgtggtgttagaagagcaaaaatgccataacgacactttggactgcgctactaatgttgttctttcttgtttctattgcaatatggtataacatctgtgccttgtacgcaggacgtatgtcccgacattgtttgtttgtttatgagaagattgtgagactgaactatgttttgttctcgaggcagtaggccacaggtgacacgtagaatgatttacagacataatttatgggcttgaagatgaagataggtttacgcacaaacacaagaattaaggaggtttggacttgtaattcagacatcatatgaagatt

SEQ ID NO: 77993 - DNA, 3713 bp, Oryza sativa
attttctttttcctggagttaaatttcggtttctgatttgaacggtgcaaaagggcccacttaatagtcgtcctctgcatttttggttgaggtcactttgtgcatgttcttggtgattagcgtacgcgtgcagtcgattaattacgagtcatattttacctttatgcttagctgacgccgtggttcctgatttgttcttcatgctattcgtccatcggttggaccagactaattaatcaagatcaaacttgttatgattgactcggctaacgggctaagctcttgatccattctccattctactttatgaactctggtctctcttgaactttcagtctgcaacaaaaaacaactaaattttcgtgcttcacaagagtactttttcttgcaagtgcaatcagctacttccaaatgaaggttgtaaggaggcaatgacaaataatgtcaactaaattgtttatcgattaatctggttgatttcttgctggtcatagattaaaatgtcagtgcgtagaacagagatatgtcatatgtgtgcacttgactttatatttcttttgaacaaatattcatattctttggcttgaccagaacgtagctgcagtagaattcaaaacgctggcatccatataggctgtgtttagttcagcgcaaagtttggattttagttgaaattggagatgatgtgactgaaaagttgtatgtgtatgataggttaatgtgatggaaaagactgaagtttggatccaaactttggatctaatcacagccatatttcgcacgctcgagcaacttccgtgacatttcatacagtgacacactgacactaaataagcctagctacttgatgcacaagcagcaggaaataaccattcaatctcccaagtgcacgtacaagtctagcttgatgattcagagtttcaaaccaaaataacccacatacatgggaaagaccaatcccagattattaattgaaggaattattgctgtggaatcgtggattgtgtactcgatttaagtggtagatatttcagaaaataaactgaacaaacatctggtttaagcaatgtaatacaatattaaaaaaacttattttcctaagcatggagtaaataatatgtttcaataatcagacgaataatctgaaaaaaaacaagaccttaattctctggctgcaagaaaattaacaaactaggacatcagtacgaacttgaaatgtccagccagcattgatgaattcgtcttaatgtgttcattacacttgaatcatgcccaacagaagctgaaacctggcgttgaatgaagtgcttgctatactacttgtttggagctattttttaaagttttttaaacatttttaattcatctctaattaagtaaataatcatcgtcaatatataatctagtgaataatctgttttgaacggggtcttattagttagaggctgtgatcgagttagtgaaaatctgttaaccattttcttgtgtgtaacaacttcggacgcctagcttgttcgtttaatccccgagagagagggccagaatagagcggattgagaagatataattccacactataataggtgtgtaataaatcttctccaaatcctactcaatcccctttgtgggaggaattaaacgaataaggcgttaaggagatgtctcacgtttaagagattttcttttgaagctctcattgtggactgcataaaaacagatcgagaatgtttttttttaaaaaattgttgtttgttcaaatgaaataaaacactgttgcgtattatcagctttgcggatctagaaatttcttcgagcctagacaaacgcatggacaaatgattttaaacgttattgaatattagtatggtgatctgctagcgagccccagcttgcccgaggtggcctggccttggatatgatccaccctgactctagtttattacctttaaagagactagaaaaaatacccgtgcattgtaacgggtaaagtctattttagtttattattattatatgatttagttaaaataaaattcactgtgggagttcgcttgaatcgatatatatatatatacgcaaaaccaggtagttctatagtttgtgaagcatatacgcaagaaactatagagggaaggttgagaaccaaaacttgcgaagacagcctaagtgatgctgtagataggatctcttataatttaagatagaggtattacattttttgcttttgaaaagaattaacagtgcttaggactttttcttcgattaattaagaagtaaacatgcttgcactcaaaagaaaatagcgaattaatatgccccagtaatgcatactagcatgttaatatattgattatatatacaagacagaactaatcaaataggaggagtacattttcacattgacatatcacaatcaaactagtatacaacacattcctgccaagcatgttacaccatctgtcccataatttttcgggtcacatatgatgtaacatgcttagccccataacttttcgggtcacaatcaactagaatcaatcaatcaatctcggccactcaatcggtagccgggaaaaaggataactactaccttcattctaaaatatatacatacggttgaaatatgggtattaaaaaaataggtaaaattaaaaggaagaagattatgattggtcgagaagtttggtaataaaattgaatggtgaagagttgtgtttggttgagaagaaaatattggtagagaagttatatatattttagaacaaatcttgaatgctccaaattgttatatttcggaacggatggtaattaagcttagctctagctagaggagctagctagctagcagcaggtgcctcttccatttccgccggacttggagccgacgagcatctccaccaccgtccgtacaacgccaccgccatccgtcagcagccactcctccccgctcagactcctcgccgccgccgccagcacgctggagacatgcatcagcaccaccaccaccagcacaagcttcgccgtcgtcctcgccggcaccgccatcgtcgcccgccgtgttcttgtcggacagatggagagacagggaaaagatgtgtgtgctaattgcatggggagaggtagtatatatatagcccgggaagccgcgttaattttgaagtttgaagccgtcgcgtcttgtgcaacggcgggagagtcagtgtcagtgtgttaatttgaagtcagcaagtgcgtgtgtttatatgctataactttgctaagcaaattaaattaaacgcagttaattaattaattacgtgctatgggtatatatatatgtagtatcgtgtttatatatattaagcagttcctgatcgattcaatcagttcaattcgatttcatatgatgctgaccaagaagattgactgctgaaaggaaattctccccagacgagagttttaatttcggtttttagaccgatgaatttccggtcttcaatgaactagtgatagtattgactcggttgtttttcacttgacgccgtaaaatccttgcggccctgaagtttgatcaccaatatatttagatttatgtattttgtatcattagatttttattagaaataatgctattgtaatatcataatgttattattgtatctcaatcaccgcaaaaataaaaatatatattggtcaaagttatactgggtcaccacgaaaataaaaaaaaaatg

SEQ ID NO: 77994 - DNA, 1370 bp, Oryza sativa
cagcagctgacgggatcagctaggcccgggtggccgattgtaaagttgttggcccgggtggccgtttgaaaagctgttggccgggtgccaatcttgtttcaattctaaagactgatacattgcacatactccgaccggacgagacgcactgtctcatccgtgtcgtttgagaagcactcacttagttgtttttagaaaagagttcaaataaaatcaattacgaaaacaacagcctttccttgaagcctacattaaacacttatttccctggcttgctgagtactcccgtactcacccttgctctatataaatatcccccccccccagttgctgaagaagatgaagcggatcctgctgatgaggagttcttccaggagcaagccggctatgatgagttttagggtttcggcctagttcccaagtcgcgcctgtgttgtttggtccaagtcctggcttccgtttcccttctgtaatgcagttgtgagctcgggatctgtccgcagcccaacatgactgtacctctactctataataaagagacctctgttgctgtgatattctgtctccctgtcataccagcactatttcctgggactggtatcgattaacaggttaaattggagcgtcacgggctagttccggtcgggactagttcggggcgtgacaagagatggtatcagagcacaggcttggccctagggcgaaacccgacgtttaggacgaccctaaggatactaagttcaaaactgcttgcgaaaagctaaggcttcttttggtttccttattttcaatagtttgtttctaaaatggttactgatccttctccctctttcaaaattgtagatggcagtgaactccagcttcagttcccacggttttggtgagggtcaccacgtcgctcagcttcgtgacctcgcccgtttcctcggtttctcgtgtcccgagtacacggggtactccgtggaccgtgttccccctcactgtgagctctctgtgtacctttacccccgtggaggtatacacggagccggccttcgcccacaccacttcaccgtggccaggcccactctccagatcgcgtaccaggacctctcctggactgcgcttcgtcgcctggcccacgactacagccaccgtctcggaggctccgccttccggcagcttccacgccttccttctggccactcagacgccaggtacccttgtccgtacagcgagtctcagccagtgctgactcgcatggttgagctttcggaggctcaggccactcagcacgacctactccttgaggcttaccgctcccttgcccgccgctacgccgctttggaggcccgtctggccgaggagggtgtcacctcagttgacactat

SEQ ID NO: 77995 - DNA, 4999 bp, Oryza sativa
agtgtgtgctatctgagttgctatttactttgctacttgccctcctaagggcttatctaactcttaccccgccctcttctgggagtttagatggctagccgcccccgccgtgcagctcgtgcaccagcccgctttggttttgaagatggtagagccgagccagaagcaaatcatgagtcagctaatgagcagtctcaccacagcaaccgttcacaccgtactgtttcccgcaacgcagaagttgagcaaccccgccacagcaaccgctcgcatcgtacagcttcccgtgatacgaagatggaatagtctcaccgctctcaccacactgccagtcacaattctggagaagaacgcctcccttccccacctcatgtggaaaacaacatgcaacacttaatggcagttcagacacaaatcttgcaaggattagccgcagccatagccggttttcagcataatacgcatggaaatggccaccctcacatgagcaacaatagatccaagctgacagactttctgaggtctcgtccgccagagttctctcagaccgtcgagcccgtcgaggctgacgattggctgaaagatgtggatagaaaactcaacttagtgcagtgtactcctgttgagaagacgctctacgcctctcaccagctaagaggacccgctgcagattggtgggagaattactgcaatgcacaccctgaacccactaacattgcttgggatgagtttgctacggctttccgtgcagctcatatgcctgaaagcactattgacatgaagaaagaagaattcaacagacttaagcaaggcaacagcagtgtcaatgagtacctaagtatgttcaacaagttggctcggtacgcccctgaggaagtggacacagacaagaagaagatcaggaaatttttgaaggggatcgcagttggaatgagactccagttgcttgctcatgactttcccacctttcaacatatgatcaacaaggcacttttacttgaggatgccagaaaagaggctatcgaagaatacaagaaacgcaagtctaaccatcagggaaattcttcccgaggcgcacctcgccctcgctacggtcagcccatgcaatatcaccagtcggtaactcaggctaaccgccagccaggctacgcccctcgtcctcagatgaaccatccggcacctcagccacagcagcgtgcccctagtggcaatactgcgccaaacagtgttacctcttttaagtcaccacagggaccgtcagcagttcagtgcttccggtgcaaccagatgggtcactatgccagacagtgtcctcagaatcctaccaacaccaactcagtacatgctaatggcagcactgccagaactcctactccagcgacagctcagtctcgtcccagctctcaggcaagtggacaaggttcacgtgcttccaaccactttggtcgaggacgtgtgaaccatattcaagctgaaaccgctcaggatgctccagacgttgtgatgggtatgttctctgtcaactccgtacccgcaatagttctgtttgattcaggagcttcccattctttcatatcacaagcttttgtgaaaagaaatggttggaaaacccaaaatttacgtgtaccaatgatagtacattcccctggaaggaatataagggcaactcaaatatgcccggaagttaaccttaaaattgaggaagttgacttcctagccaaaccgatagtcctagactcgcaaagcttggacatcatcctaggtatggattggttggctaagcacaaaggacagatagattgtgccgaaaagtccatcaccttgcaaggacctggaggaaagcaagtccgctttacccctaacacccctaccgcaagtcggtctatcctaacctgtttacaagtcacctccttggagtcggtgcccatagtctgtgaatatcccgacgtattcccagaagaattaacgagtatgccaccagaccgagagattgagttcgctatagaactggcaccaggcacggctccaattgcaaaaaggccctaccgaatggcagctaatgagttagcagaagttaaaagacaaatcgaagagttggagagtaaaggttatgtgcgacctagctcatccccttggggagccccagtgcttctggttaagaaaaaggatggctctgagagaatggtaattgactatagagccctgaatgaagtaactataaagaacaagtacccgttgccacggattgacgatttattcgatcaacttaaaggagcaagagttttctcaaaaattgacttgaggtcaggttaccaccaactgaaaatcagatctgaagatatcccgaagaccgctttctcaacgcgttatggtctatatgagttcacagtaatgtccttcggactcaccaatgctccagcattcttcatgaacttaatgaacaaaatctttatggaatacctggaccagtttgtcgtggtgttcatcgatgacatcctgatatactccaagaatgaggaagaacacgctgaacacctaaggctgataatggaaaagctcagagatcatcaactattcgctaaattctcgaaatgcaaattctggttagatcgagtagcatttcttggacacgtgatctcctcccacggtgtcgaagtagatcccagcaaggttgaagctgtacttgcttggaacccgcccaagaatgtgtcagagattcgcagcttcctaggcttagctggatattatcgaagattcattgaagtattctctaagctagccagacctatgaccgagctgttaaagaaggaaaataaatttcactggtctgcatcctgtgaagacagctttcaagaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcatccaggcagctcaggcctcatgaagtcaattatcccacccatgatctcgagttggcagccgtggtgcatgcccttaagatctggaggcactatttaatcgggaacagatgtgaagtatacaccgatcacaaaagtcttaagtatatcttcacacagaccgagttaaacatgagacagagaagatggttggaactaatcaaggattacgatcttggaatccattatcatcctggtaaagccaacgtggtcgctgatgcgctaagtcgcaaggcctattgcaatgtagctcaaatacggcctgaccatgatcacctgtgcagagaattggagaagttaaggctgaccgtggtacagtcaggtgtccctgccagcttgacagtacagcctaccctagagtcgcaaatccgggaggctcagaaagacaacgaagggataaaagaattaataaaaaggaatacaggagaagaaagacaccaatttctccatagacgatcaaggcacagtttggtgcggtccacgcatctgtgtaccggccaagaaggagttaagagatctcatcctaaaggaagctcatgagtccgcctactccattcatccaggaagtacgaagatgtaccaagatatcaaggcatacttctggtgggctggaatgaagcgagatgtcgcagaatacgtagccttgtgtgacatttgccaaagagtcaaggcagagcatcagaggccagctggtctgctgcaacccctaccgattcccgagtggaaatgggaagagatcggaatggatttcatcaccggtttgccaagaacccctaacgggtacgactccatctgggtaatcgtggatcgactcacgaaatcagctcatttcgtgccagtgaaaaccacctttgatggaaagaaactagcagaactctacatgacccatgtcgtgtgtagatttggctgtcccaagaaaattgtgtcggaccgaggcactcagttcacctcaaggttctggaagcagttgcatgaagccctcggaactgatctaaaatttagtacagcctaccatccgcagaccgatggtcagaccgaaagggtaaaccaaatcctagaagacatgctacgagcgtgtgccttggatttcgaaggcacttgggatcgttgtttgccgtacgcggagttctcatacaacaacagttaccaggctagtattcagatgtcgccgaatgaggcaatgttcggaagaaagtgccgcactcccttgtgctggaatgaggtgggcgaagcactggtattcggtcctgacatactcaagtcagcagaagaataagttaagctaatccgaaaacgtttaaagacagcgcagaaccgtcagaaaagttacgctgaaaatcgaaggcgtgaccttgagttcgaaaaaggagatcatgtgtacctgcgagtatcacccctccgtggtgtgagaaggtttgggatgtccggctagttagcaccccgctacatcggcccctacctcataaccgccagacgtggcgaagtggcttatcagcttgagttacctgaaggtctcgcagatgtgcataacgtgttccacgtatcccagctaaagaaatgtcttcgagttccagaagagcaagtccccctgggtaatatcgaactggaaaagaatctgacctacaaggaaagaccgatcaaggttcttgaagaggcagaacgtcagactcgaaggaagaccatcaagttctacaaagtccaatggagcaatcattttgaagacgaggcaacctgggagcgagaagatcttctccgcgccgagttcccggagctgctcccttaggtgctgaatctcagggtcgagattcttgttaggggggttggtctgtagtgcccattccgtcgtggcgcctagcgggaaaattatctcttaaaaaccctaattacgaaatttgcttctttgcttattgtctagtgtccgtgccatctcaagatctcaatccccgatctatcgtcgagttcaattccgaat

SEQ ID NO: 77996 - DNA, 1330 bp, Oryza sativa
gaaagaaataaaccactgttcatggtgtggcaacattttcttgctattatggcgtgactggaaggttcctttttttaaaaaagaataaatttgtgagagttgattttaaaattttgaatttataaaagtctgaaaaataagaaaaattctcatccagacatgtaagtacgtacttattatcacagcaagttaagatatattgctcgttctcaaaaaaaaagtcagatattgccgcatatatttgcacttcatgcatgttcagatcatcagatggtggtgtcaagccacagggaattaagctagcttggtgttagactgttatatagtccctctgtctctaaatatttaacgccgttgactttttaaaacatgttcgaccgttcgtcttattcagaaatttttgttgaaatgtgtaaaactatatgtatacataaaagtatatttaacaaagaatcaaatgataggaaaagaattaataattatttaaatttttttgaataagacgaacgttcaaacatgtgtaaaaaagtcaacggcttcaaatatttagggaaagagggagtatattaagtgtggttggtattatctaaataagaaaataagtgtggttggtgaggaaaaaaaactgtgtagtcggattatggtccagggatgtactacgtgcacaattcgcctcttctcagagagaaaacgacgtctgaattacgcatgcacattgattaattaaacgaccggtcgtctcgtctctctcacaccccccggccagccggctaccatttctaaaacgtggaaaagtatatctattctgctaattaacaagctagctacttcaattataacacatgttttgtgtgcatgctgatatgatgatcaataaatcaattgattgattattacaacgcggtatacgtactggcctgcatgggaacatatacagcagctgatcgatatcgatcgtcgcatagttttcgatcagtttttaactgtgcaaaacttaagttaagctgtacttttttttctgtgtggttattattattattatttttgtaaatgtgcatacttaattaattactgtacgtatactatatcgatcgtagcaaaagttaattactgtacgtatccggcggcggctaagggctggctgctagctaggtcgttcgtctcatcgactgatataaacgtacgtacgtacggtgaaattataaatttggattgatccatgacgacgatgactttttggttgctgtgaggaataatattctatctatacgtatgcatacgtacatgcatacatagcactgttcctatcgaagagcgctcagcccggcag

SEQ ID NO: 77997 - DNA, 5406 bp, Oryza sativa
tattctgctaattaacaagctagctacttcaattataacacatgttttgtgtgcatgctgatatgatgatcaataaatcaattgattgattattacaacgcggtatacgtactggcctgcatgggaacatatacagcagctgatcgatatcgatcgtcgcatagttttcgatcagtttttaactgtgcaaaacttaagttaagctgtacttttttttctgtgtggttattattattattatttttgtaaatgtgcatacttaattaattactgtacgtatactatatcgatcgtagcaaaagttaattactgtacgtatccggcggcggctaagggctggctgctagctaggtcgttcgtctcatcgactgatataaacgtacgtacgtacggtgaaattataaatttggattgatccatgacgacgatgactttttggttgctgtgaggaataatattctatctatacgtatgcatacgtacatgcatacatagcactgttccctatcgaagagcgctcaggcccggcagctaacacgtaacgtaaaagcacaccgtcaatcagtttgttgcatgcatgtatatacaataatgtaaattatatactcccctccgttccgtttcatattataagtcgtttaacattttttctaaataaatttctttgagtttgaccaaatttacagaaaaatatagtagtattttcaacacaaaataaacatattaagagctcccctaccgtcgccctactgtcgcgctactgctccaccgccctactccctcgagctcccctgccgccgccgcgctgctgtcgcggctgccaccgccgcgctctgcgacgtgcttcatggcggtctcccagtgggtcccggtgggccactgccgccgctccagcccccatccgccgccgccgctgctctggcccctgtccggcaccgccgacaacccgacccttgcccgtcgccgatgctcccgtgaagagaaacgggggagaaagagatgatggagagagagagggaggaggaagatatggccctgccgccgccctgaccgccatcgaccactccctcgaccaccgccgtcgccgccctagtgtcacctgcctgtcgctgccgcttgccctagtgtcgcctacctgcctcccttgactccctcgatcgccgccgcttgtgaagggaagagaaagagggagaggatgacatgtgggcggccccacatgtcagtgggtcctacaatatatttttgtgtgtgaatgacaaatggatcccacataattttttttatttctaatgccacctaagcaccacgtcgatcaatgccatgtggaaagaagaccgagtcaatactaccatgtagacgccacgtcagcgaaaccgtcctccaaaaccatctagctagggagttaaattgcaccggttttaagagttgtggtgtcgagatatccggttttgtagtttagggtcatggattatatttcaatcacttttgagtgtcacaaagtgaacttattccaattatatgtgctacccaaatttgggtacagtttcccatctaaatatatattaattacttcaaacgatcttatacatgcagacaaagtatcacgtacctgccaagcatagaagccttggagaataacatgggaatatacggggaaatatagagaagataataaattaaagagatcaatttctatactggacagtttaattagggtgtaaaataaagtaaaacccagaaccggcatacacaattttctaggcaattgtcaagctagttgaattgaccgtctaaataatttcttcatccagccatttcgttccgttgaagcctttatacgtccattcttgtgagtgcgtcatacatacgtacatgcatgcatctaaaatttgcagtcaagtctacctatatctaattaagcttgcaaactttagtttccgcggcgcaaagtgcaaacgatattatattatcaatctgattaactaattaactatctccgtttcacaatgtaacactttctagcattatccacatttatatatatgctaatgaatctagaaagtcttacattgtgaaacggagggagtaattaaataattaatagtactctcctccatcccacgaaatagcaatttagtacccgatgttaacccatcataatactacaaatttagacatagattattctgtccagattcatatactccatccggccgtctaaaaaaacctagcatgtctagatttatttattgtattagattatatcccatccaagtttcagttgtggttttttttttttttgaacgatataagtttcagttggggatttttttttttaaacggatggagtacgtatcaatccaattgaccagtaggaacgcgtgcacggcagcatcagatcaggattctgtttctccatcgatcataatcgatcaggtgcacgcgtcaaaccggagccgcacgggtgtttcggttgcaatgttttttcaattttctgcagtgaaattttcggcttgttcagttgaccggcaatagctagcaatcgtactgtctacgggaagatccaacaaataaaacgtttgcgtttacccggcatttatgcgcatatattgtgattcacgcatgtgcatatatgtatcagcgtatgcatgtgcttatatgtcaagctagctagaattaatagtctataatttcttcaacgatatgttttttgcttttcattttgtaggtattgtatatattgcggaatataatgcacaattctagaaacggaattttgggaagttctataaatttcggaccgaattgaactaagttaaaatttgaacaaattttggttaaatttgaataaaattaattttattaattgaaaaagtgtatgtttctatcgaaataatatcctaccaggggagatccatggacccgtaattattaattgtaccaatggcgccatagacaatatcaaattattaattgtacaaaaacattggctaattctatcataaagcacatgcatcttcattttgtcatatactcctggtcgtcaaagttagataaatttagcttataacaaaactaaaatactttagaataccggacgagtatcatatagtataatatataccatcggttgggcaatgtcatgataattgaatgaaatcatcagttcgtcactagttatatacgtgttactggtgtaatgttcagtttatgcaggaaacctattgggcgggatgttgcttggtcagctagcatatactagtatataacaataacgaccataacaatattataattccaacatgtcaggaatcgagacattagtttcatttgacaagtagtagtatattaatttacgcgttacgatggatactacgtacccccgtcccaaaataagtgcagtcgtgaggaaccgtgtccagcgtttgaccgtttgtcttatttgaaaaatttataaaaaaaattaaaaaaatagacacccataaagtattattcatgttttatcatctaataataataaaaatactaatcacaaaaaaatttcaaataaaacgaacggtcaaacgttggacataaatagcgcaaaactatacttattttaggatggagggagtaattaactagtacagtggacacatgtttattacaatatgatctcgtctcaaggatgacaaaaggaaaaaaaagaacagaataaggcgacttgctaattaaacagaagctaacagtaaccaagctttcagtaagaggttcaatctgtcagcaaatttctgagctgttaggaagatttcatctgtcggtaaaaggtgatccatgcatgtaaatgccgtcactttatatgtcggctaatgatttgcaaagtcttcaatggcctctagcgcactcagtgaagaaattacatatcatgagcaaattaagatgcactaactgagtccttgtatggggctttggacgacggataggattgtttggggaaatccactacgtgcaataatgtgctagcctgcaacattcatcgatggttgcaaaatcctccatttacaatttgcattgcatagtaattttttgacatgatggactgacggactgtgcaatagctaacaactcatagagtctaaacatatttttcccgtgagctaagtgcctgtcaggaatataatctatattcgtcggtgaaaccgagaccgttggattaaaaagagtttgcacgcgacagcaacaccaggacttgtcacaacatttcaggtacatatacatacgtatatatctgcaaattaaataagaggaagaaaaataagaagcaaaaaagatgatacaagtttattaatttcattttctggacccagtcaagtcgccgtgcagacaggaggagagtatacttttcgattcagaggaggtctccaaaactcgtcatgcaatatgaaaaaaaatgccgtttgttgttttactgcttcttggtcatacctaccaacaaatgcaaggtcgatgttgatgatcctagtataactgaaaacgacgacgacttctgccatgaaatgccgtacactttctgctacctttgttcagcttctctctctctagaactgtttacgcaagctaatctgtacgtaaactagctatagaatagaatgacgcatgtgttgaacttggttggtgaatatgaactctagcttttcggctagctttcctctctctcttgatcgatctgtttgagtaattaattaaagcatataggagtatatagtatatggtatagtacatgaaactggtaatggaatgaccaatatgtctggaactgaacgttaattatatattgtcttgacttttgaccgggcattcattcacgcgcaaagataaaaaaggtaaaaaatctcttgcgactttgccttctagctaccaacctagaatagcttatgaatatatagtaatttcgatttgatcgggttaattaatttaattttgtcctggtagaacatattcctcaagctaaccatacattttattacctccccgttctatacttgtgggtcgatgtgttgtctggtaaagtatggttttaacttccacggctaataatttttaaatgattatactaatatttaatattaaagaaagcttattaacgaaatcttaatttttatatttcaggatacaacacgcttcaataatttaacatattttcaaatgtttatgcacgatatctttttttttaaaaaagaagagtcaaagcttaaatattaaatataaacagtattcggtgataataattggcgaacgtgggtaaaataatggccgagtgagaaaatagcatgcgagtacaagcaaacaagagattaattattattaatcgagtacacaaatactctagctggctgattgtgcatattgtagaaagaatgatcgata

SEQ ID NO: 77998 - DNA, 2222 bp, Oryza sativa
ccggtgctcggcggaggcggtggcagcgtcccgtggaggaggctccggtggcagacgtcaatcgggtgtagcgccagggcgtcgccggtgatcagaggtgggtctcgcgtcatcgacacgaatcagagcaccatgtcgttgatgacatcatccgtctgtccatcacacggatcaaatcaaatcggttcttcgatgattcttgatttcttgattgattggtcgattccgcgatgtacctaacgctttgtgcgggccgcgaacgacggcgacgaggcgccgtcctactcgtagcccgctccggccactgcccaacctgctccgccggccggccgctgcgccccgctcgtagcccgctccagccgctgctcaacctcctcctatcggcttcgcgcgtcgccgccgcttggctccgccggccgccgccgttccgccctcctgccggcgagcttcgcccgccgtcgcctcgcctgtccgccttgctctgcgagttggcatgtgtttagagagaggatagagataatagatgaggccaattgtgactgtgggccccaccattttttattatttatgtaactgacatgtgggtcccacgggtttgattttttatatcaaattgtcacgtcaatgccacattgaacgaagacctagtcaaagaagcgccacataggcgccacgtcaaccaaatccagcgactataccgccaagggacattctttgcacggttttgtaagttgggggatgcgttgtatccggttttgtgctgcagggatgaaaatcagactgggcgccaaatagagggacctaaagtgaacttattccaaggaaaaagtacacaagatccctcaccggagtttgctaattcgcgcatacgcgccgcaggcacgcactccggcccacccggcccacgcgcgacacgcgcgccgtcgcccaccaacaatttttttttggtttttggtgtttttttccccattgctttttccctttttcgcttttttttcctgcgccgtgggaagtcgaatcaccatgaatatttttttttgtgattttctaaataatatgcgcacgattttatttttcgtgattttttcacatgttttgttgtgaattttttaaaccacatgcgcacgtttcaatcaaaagtttttaaaattttaataaaaagtttttgaattataagtttgaaagtttttataatttaagttgtatgattttaattttgagatgaaagttttcaaatacgagttaaaagtttcaaatctttagtcgaaagtttttaaatttgagttgaaagtttttaaattttgaattgaaaattttaaactttcaacactaatttaaaaactttcaactctaaatttaaatttttaactcagattgaaactattcaaattaaaaatttgaaaaaaaaataaaatcaaaaattaaaaactttcaacacaattttgaaaactttcatttcaaaatttgaaaactttgaactcaaatttgaaaactttcatctcaaaatttaaaaactttcaactcaaatttgaaaactttcatcttaaatctgaaaactttcaactcaaaatttgaaaactttcaatccaaaattcaaaaactttcaattgaaaaataaaaagctttcaactcaaatttaaaattttcaactattctttttaaaacttttaactaaatatttatgttttttaaatatttattgctaattaccataattagccctaatttactataattagtattgattaggtaattagcctagaaggaagcggccgcgtgcgcgctgcttctgtggctcggcgcgcacgcgccgagtaggaacaccctccctcatcttatcatccagttacgaaattgtcccctaaccacaaaaccagatatattatatccttcaacttacaaaaccgttcactttaggtctttcggtgattttgatcctagttttgtctaacgtgacagctgagtcagcgtgaggcccacgtatcatgatgccacgtcatcaccctctcccttcttcttctctctttctcacacacttttctcctctaggcaagctggccggcggatggggaggaggtcaccaggggtgaggccggagaggaggaagtcccgctgtccgcgacgaggtggcggtggctgcaacgcgggagcagggcgctttgccttggtcggatgtccgggcgaagactactgcggcggggcgaccggaggatcgaggaccc

SEQ ID NO: 77999 - DNA, 10602 bp, Oryza sativa
tggcatgcgaggtttccctgaaccgactagctacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcaggttttgaaggcttcacaaacccatttcccaagttttcgacaagcaacggtgtatgtgggatatttggtatacgcgctcagagagcacgaataccgaggtaccacaagggtggagcgacaaggaatcagggtagtacgacctacggaaattagtgcgactactgggtaggtccgtcgatttggcatgcaaaccgaggccaagcaagttaagtgtgtgattctataatgcaagttgcaaacaaaataataatgacttttcaattataggagcaattgatcaaagggtgacttgccttgctcaaggtcttcacgaagcttcacgaatcttcgagaaaacccgcgatcgacgaaaatccgataaccgcaactatgcgcaaacaatcgaaaacctaaacaaaggaccaaacgaaagatcctatttagactaattagtagtgccattaaatagatctcaattttacggaattactggaagttgaacggagtcaaacggaagagcggttgagaagatatgaattttggaagtttaattggagtttctggaataggagaaatggtttatggaattttatagaaataatattctcaagaatattattgacagtcactgacgtacgggctcgaggggacgaattattggaatctccggattaagaggatgggtttatggaatttggaatataggaaatgatttattgaatttctagaaaagagaaatatgtgtggagtattgaaaaagatattcccaagaatatctttgactcattgacacgtggggccaacaagaaggtgagagagagaggagcaattggagggagtaattgtggacttttagctcttgggtgatgtcacaccccgaagttttcctcccaagccaaaaattgaatttacaaatgaccccaagaaaatgcaggtgaaatcaggagaaaaccctaagaaagtaatgcaaataataatcggattggacatgtggaatttttcttgagttctacatgtcgaaattcattaacaggatttttagtggaattttcagagctctagaaataattttcaaccaattaaaattgagcaagcaatattttaattccagggaaaaatcctttttccttttctttttcttttttcctttctttttcctcctttttgtcaaatgggccgtcggcccatttcccttttcctccccctcctctctactgggccggccacaggccgaggcccagcccgaccagtccggcagcccaggccgcccgccgcctcctctctcggggtcgccgacaggtggggcccacctgtcggtcccgtctccctcctcccgccgatcccggcgcgccgccgcgcccgaaaccgccgccgcgccctcgtctccgccttccccgggccacgtcggccacgtccgcgcgtgcgccgcgccctccgcgcccattcccctctctctcccgctcgcgcccgcgcccgagatggccgggattcgaaaaccgaatcccgcctctctctcctccccactcccccacgtcggccggcgaatcccgcctcttccggccacgtccggccctctctccccctatttaagcggcgcagggaccctctccgctttttccccatttcgccgacccctcccgagctgccaatcgtctccgcgccttgcagaccacccgccgccgccgtttttgccacttcggccgccgctagccgccgctaggctcgccgccgtcttgcgccgtcgccgccgttagattcgcggggtcgagatctacctcggccgccccttcccctttgaggttcgccgccggagacccatccccgtcgtgcgccggtgagtgacgccatggccgccgccttcggccggcgctctcgctctctcgcgctcttccctctccctctaatccctctccttttgttcgttaggaggttccggagctcgtcccgccgtcgccatcgtcctccgtcgcccgccgtcgtcgaccgttgtcggtaaggccctcctcctcgttttctctctcccgcaccgtttagccgccgcgtcgccgcctagctgcgtagccgccgctcctcctctagccgccgctctccgccgccggtcggtcgccgtcggccgtcgccttgcgccgctgccgcatgcgcaccgccgccgcgtgagcgctgcgccgccggcgccatggtcgccggttcggcttgcgccatgcccgcgcgcccggccgcgagctcccaccgccgtccgatctacccttgggtagatcggggccgtcggttcggccgccacgtggcgccgccgccccttccatctcccgtgccgctgacagtgggcccgcgggccgacgcctcctctctcctccccgtgccgctgaccggtgggtcccgcatgtcggcgccgcacccctccgtgctgacgtcagccctggttaatattgcgcaataaatgatttaaggtttttcttttatagtaataaacacagtgaatcttctaaaaatcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccggttcttccgacgctccggtgtacttcaagatagtcgccgaggtccctccagcagcagagcaaggcaagtcatgcttgtcacttgatcatattgatcctatattgcaaatgtcctaatgttttctttcaaataccgcatttgttttgcaatattactatgggatggttacctattattacagccatactattttgataccatgctcctttgttagcttgggtcataacatgattagagttaggactagggtttgcttagccatgcttagttcaactagcacacaatggggagatctcatttaaaacctagattataggtttatatgataatgttggattagtaccaccgctctggtgttggttaattaaaatgaatcacatggtgggctgtgggtgcatggttttgctggtcgcacccatggcagttaaggaccggttcgcgggatgccctagaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgccggcgcacggaaacgtgtcgtggggctgtgtcttgtgggtacagttgtacacctctgatcagagtaaaactattcgaatagccgcgcccgcggttatgggcggtcaaccagattcaccgtgattagtctcaccctagtgtaatctgttgaacttggatagtttaggtggatggttgggcctgtcgcaacgtgggttagcgttggacagcggatatttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagtttagtcaaggcttagctccagttatcttttgtttccgctgcatttttgtaagacttttatgatatttgtaagacgtggatctgaatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcgagggaaaaatcttgtcgcttgtttaagtgagttgttttcaaagcaagtcagtttagggttttagtaaaattattgggatttattcgtcagtcagttggggtttgatgggtgaaatgcattaggtcctagctctataacatgggttgcaaggtatttatgctttgttcgttattattaatatgtatctaatttctcattactttgtcgttatatgagtctgtcttatttattcgctctcatgcaaaatgacctatgcataaaattttgttcttgttcgattctcttatttgagtcttttattgctttatttaaatttggatttgagcatgcattgatcctactcctttgtcttctctagatggccggtcacccacccaaccaccgcggagaaggcatgatcgacttcgtggcagagctggcacgcatgacactggtggtgggctaccccaatgcgccggagtacacgaccatcccaccgctcagtggcgagcttcctcaccgtgtccgcttggaggtccatggctacgtggggacttgcctcgctaacatggcggttgaggcgtcaggaggcacagcagatcatgcctgtcaggaggcagcctacttgatgatggccaggttacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgagatagcgcgcctgaagaaagagaatgctcagttgaagggtcttccagcaccaggaggagtccggatccgcactacgccccgtaagaggacgactgcacccgtgcgcatccagcttgcgcccaggaacccacctccagcagcagcagctccggcagttcctccagctccagctccagctccagctccagctccagctcccgctcccgcgttcactctctccttcgctccagcatcagccgccagaggaccagccagtggtaccggaggttggttgtctgctactcccagtggcagcggcgagactgatctgtcaggctccaggagtcgctcagagggacctggtgacgagcaggaggacgccttcgactccaccgaccgcaggagccgttccgagcattaggctcgttttcccattagtttatcgattgtctagtttctgtttgttagtttgtgtgtttaggttgcttgtttggggtcagtcgacggtcgatatcatgtgcctatgatatggctgtcttaataaggatgtttgcttgctcttttaagtgtttttaattcagatcagaacaattgcagttttaattcctttataataaagcttagctcttgagcatctgtttttcttcttctcccccgtctgctttcccctccagatggtctacaccaggactggtagccgcgcaacaggcgagggcagcaacggtgaagaacgcgctgatggtgtgcaccccaacagtgagtccggcaatggtccgccaccacttcccgagaatccgacgcttgcccaagttatggcacatcaaactcagatgatggcagccatgatgcagcagatgcagcagcagcaccagcagatgcaccagaggatgatgcagcacgccgaacagcagcatcaacagtttggtccccctccccctcagtccaagttgccggagtttctacgtgtcaggctacccaccttctccagcaccaccaaccctatggaggcaaatgactggctccatgcgatagagaagaagctgaatctcctgcagtgcaatgatcaggagaaggtcgctttcgccacacaccagcttcagggtcctgcgtcagcttggtgggacaaccacatggccacccgcccaccgggtactgaagtcacatgggcagagttctgccgtagcttcaggaaggcacaggtgccagatggggtcgtggcacaaaagaagagggaattccgggcgctccatcagggtaacaggactgtgacagagtacctccatgagttcaatcgcctcgcgcgatatgcaccagaggatgtccgcaccgacgccgagaagcaggagaagttcatggcgggtttggatgatgagctgaccaaccaactgatatctggggactacgttgactttgagaggctggtcgacaaggcaatccgccaggaggatcaacgcaacaagatggacaggaagaggaaggccgctcagttcagggcaccccagggaagtcaccagaggccgcgcttcactcccgggcaacagggtggacctaccaccatgatcgtccgtcagcaccgcccgttcaaccctagcaacttccaccagggcactagtggcagtcagaaccaccatggaagtcagcccaaccgcggtacagctccacgcccaccaatggcaccggcacagtcaggccagcccgcacaagccaagaaggagacgggagcaaaaccagggtcctgcttcaactgtggcgagcttggccacttcgctgacaaatgcccgaagcccaggcgtgccgggccaaggtttatccaggctcgtgtcaaccacgcgtctgcggaggaggcacaagcagcaccagaggtcgtactgggtacgtttcctgttaactcaatccctgcaacagtactttttgattctggtgcaacgcattctttcatctcaaagaaatttgtcgggatgcatgggttaataagagaggaacttagcacaccgatgcgggttcataccccagggaatagctccacttcggttcaattcagcccttctataacaatagaaattcaaaggtcaccatttctagccaacctcattcttctcgaatccaaagacctagatgtcattcttgggatggattggctgaccaagttcaagggagtcatcgattgtgcgagtcgcacagtcaccttgaccaacgagaagggagaaaccgtggtgtacaaatctctagtctcgccaaagaaaggggtctcgttgaatcagattgagacggaaatcccagtggacaccgtagagaagaacttgagaaaattggaagatatacccatagtctgcgagtatccggaagtgtttcctgaagacctcactaccatgccacccaagagagagattgaattccggattgacttggcaccgggaaccgctccaatttacaagagaccatacaggatggcggccaacgaattagcagaggtcaagaagcaagttgatgagcagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcctttaccgcgaatcgacgatttatttgatcaactaaaaggagctaaagtgttttctaagatagacctgcgatcaggctaccaccagttgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtgttcatcgacgacattcttatctattcaaagtccggagaagaacatgaacaacatctccgtctagtactcgagaagttgaaggagcaccagctatacgccaagttcagcaagtgtgacttctggttgacggaagtcaaatttctgggccatgtcattacaactcagggtgtggcagttgacccatcgaacgtggagtcagttaccaaatggaccccacctaagaccgtgtcgcagattcggagttttctaggactggcaggttattaccgccgattcatcgaaaatttctccaggatcgcccgacccatgactcagttgcttaagaaagatgagaagtttaaatggacagctgagtgcgataagagttttgaggagctcaagaagaagttagtatccgcaccagtattgattctgcccgacccgacgaaagacttccaagtctattgtgatgcatcccgtcacggacttggatgtgtcctaatgcaagagggcagagtggttgcgtatgcctcgcggcagttgcgtccacacgaaggaaattatccaactcatgacttggaattggcagcagtggttcatgctttgaagatctggaggcactatctgattggaaaccgctgcgaagtatatacggaccataagagtctgaaatacatcttcacccaaccggatctaaaccttcgacaacgaagatggttggaactaatcaaagactatgacatgagtattcactaccacccgggtaaagccaatgtggtggcagacgctttaagccggaaaagttactgcactgccctatgcatcgagggcatgtgtgaggaattgcggcaggagtttgagcatctcaacgtgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccacgaagatgagcatggcaccatctggatgggagaaagattgtgtgtacctgacgacaaggaactgaaggatctgatactcaccgaggctcatcatacccagtactccattcatccaggcagcactaaaatgtaccaagaccttaaagaaaaattttggtgggtcagcatgaggagagaaatagctgaattcgtcgcactctgcgatgtttgccaacgagtgaaagcagagcaccaaagaccagcaggtttactccaacctcttcaaatcccggaatggaaatgggaggagattggaatggactttataacaggactgccccggacatcatcgggacatgattcaatctgggtagtcgtggatcgactcaccaaggtggctcactttatacccgtacataccacctatacgggaaagagactggcagaattgtacctcgcaaggatcatgtgtttgcatggggtacccaggaaaatagtatccgaccgaggtagtcagttcacctcaaagttttggcagaaactgcaggaagaattggggacccgtttgaatttcagcacggcctatcacccgcaaactgatggtcagaccgagcgagtcaatcaaatcttggaggatatgttgagagcttgcgctcttgattttggtggagcttgggacaaaagcttgccatacgcggaattctcgtacaacaacagctaccaggccagtctacagatggcaccgtttgaagctttgtacggccggaagtgccgcacacacctctcttctgggatcagacaggcgaacgtcaactgttcggaacagaagtattagcggaagcagaagagaaagtcagaatcatcagggaaaggttgagaattgctcagtctcgacagaagagctacgcggataaccgtcgaagggagctcatttttgaggcaggagattacgtgtatcttcgtgtcactccgctccggggagtacaccgttttcagacgaaaggctagttggcaccacgcttcgtgggaccatacaaaatcttggaacgaaggggagaagttgcttatcagctagaacttccatccaatatgatcggcatccatgacgtgttccacgtgtcccaattaaagaagtgtttaagggtacctgaagaacaggctgattcggagcacattgatatccaagaggacctaacatatgtggagaagccggttcgtatacttgataccagcgaaaggagaaccagaaataaggtcaccaggttttgccgagttcagtggagtcatcattcagaagaggaagcaacctgggaaagggaagatgagttgaaagccgcccatccgcacctcttcaccagctcctccgaatctcggggccgagattccgtttaaggggggtaggtttgtcacaccccgaagttttcctctccaagccaaagattgaatttacaaatgaccccaagaaaatgcaggtgagatcaggagaaatccctaagaaagtatgcaataataatcggattggacatgtggattctctcttgagttctacatgtcga

SEQ ID NO: 78000 - DNA, 4330 bp, Oryza sativa
atgcttgcagtcctttctccaattaattatgccttcgtcatcatgttcgaggaactgagcaaccacggcatgtgctcggctccaatgccgccattgccgcggccggctgctgcatgctcccggatcgatgccgatggcgtcttggtgcagctcgtcggagttcatcggctggaagataagaaaggaggaatgaagacggagagggaggagggccggcgagctcgcccactccgcccgacgctgtgtgggtgtggcgaggagaaagcaggagatcaggaaggagaaaggtggaaggagaggaggatgacatgtaggctccacatggggccatcaattttttttgtattttttttatcaattttagtgtgacgagataaattgaaagtataggtttcccaaatacaatttgcttttttatccatgcctagcaaagttttaatttggatgcaaactattgacattgtttttaatattgcatgatgtgcaacaacatagagaattaaatttgaaaatatactattcatcaattttttttcttaagaatagtcgggatgcaaaactttttacaaaaatataaactgttgcgtgaaaataatgtgtgcgtaacgttgcgggcggtgtcgcaccagggaagcggtctcgcggagcgagaccgaacggtctcgcaaaatcaaatagcgagactgtctaacagctcaatttaattagtgattaattacttaattaacaattaactaataataatttagtattaataataatttagtaattaattattatgattactgattaattaatcactaatcatgataattaatcgctaattaaattggcattgaatggctcatgcatgagcgagagcgctatccgcgagaccgcgcggtctcacgctgctgccgagcaagaccgtgcggtctcgcgctttttccgcgtgataccgtccgtgacgtcattctcatatcactttcacgtaacggttgtgcgagaccgacgatatatttctgtaaaaaattttgcatcccgaatatttctgagaaaaaattgaatgaatagtatattttcaaatttaattcacaacatagatacatgtaagcattattgaggcatctcccatattcaaacatgtcctaccttttgttttcttaggcctctcctaattaataggagattcattttcattaaagagtgagatacatagccggtacttaaacttgcagagtaatattatttaggtccgtgaacttgaaaattacacatttagatccgtgaacttggtttaatgtaccactcccggtctaatcgttatttgaccacgtttgacccccaacatagcatgccacgtaggcaacacttttgtactcagccccctccaaatatacattcgcacataaattgccttgaccagtgcatttcaacctaaatcccccaaaatattcctaaatcggctaaggttttgacggtgaggttagtgaaaggaagccgagaggtagcggctgtggtggccttggcggtgagattagcagcaagaggcagcgcagtgcagcaaggttagtggtggcacagtgcggccggattagcggtgggaggtagcgcaatgcagtttgcacgataggcattcccatggattctccaagctcgtcctcgtcttgaaatcgccggaagaaggtgttgttgattgcccgttgtgcaaggataaggtcattttggagcatagagcaaatgacaattgctaatcgggaccacattttctatacatgcaaggagaagaatgaaagggaagaacgatttgagaaatttttttaggattctgatgtcactatatagctaaaaggagatatatgcgacgtgttgtgatgtggagggggctaagagcaaaagtgttgactacgtgacatgccatgttagcggtcaaccataggtaaatgacgtttggactgggggtgatacattaaaccaggttcacggatctaaacgtgcaattttcaagttcacggacctaagtgataccaccatacaaatttagggactgaccatatatttcactcttcattaaatatggtgttatgtcaacatttttatgatgtggtaaggaattaatggagatagaaatgaaatgagtttcatctagattaaaccatatatacattatttccaatatgactcgtctatgcatgtgttgcctatgaaatagcaaaaatgaaacaatacattgtgtgagttattttaaccatcaattaaatttcttaaatatcttgtttatatgtcacttgaaaacatactaatgaagcctccagtctgcaaggaatggccttactgatatataggtacatgtaaatctcgaggagctattgaagggtgtcatctaccatagagatgggctggtagtcaaatggtgacatcttcttgagttattgcttatgtcctggaagcatttaatttattttgttttttagccaaataataagtgcagcgagaattagtgaaatggaaaacagttgtatcaggtctgccctttgttcttcttatatatagggggagagaagtaccagggaaccacattccctttctcaaagatggaagcaacatctctagatcttcgcttcatcttggttcttgttctacttctgaatccaacatttgcaggtgcaagggtggatccacacagagctcaagtggtgcacaccacacagggtaagttctgaaaaattcattagcatttgatcatgttatcacataaataaagtagcatatgtgtgattaagaggtacttgtgtatgatacctggtaatttggattctacatttgcccctagacaggtgagttctttctcgactattttttgacgttattggtataccttttcttgtcatgtagcctctatctaaaaaaaaaagacttgatttctggctaagcatagaggcaagtaaatagccagaagtcaaatcttttttagagagagggagtatgttgtgtcttgcaatgtttgttgtgatttactctgtttataactagtgctttgtgcatattcaacagtgaaattatagatcagattccttctccatgcaagttctgaatggtgatagtctgattgatgataagcattataacaagtggtagttaatctcttttttttcacagaggattgtattattgacattggctgggtagtgttctgcaccaaaaggttctgcaaatttagttgctggggtgaaggtcttataaagaaggggaaagtccgagactattggtgcagtgattttcacggctgcaactgcttgatttgccgtggcatctaaaaaagcaggggctgttttgttaaccgtatatagtactaaaaggtgtatcatcatgcttaattatgcatgggaatagtcaataataagtcagttgcttcatgttctactgctatatgatttgatttcaggtctggctccgtgtgttatcccctcctggctgggctgccctctctccccctcgtggcagctggctccaggattggtggtcattctccagggtatgtttacctgagcaccttcgcagcggcttcgactccttggtattcctagtctcctggcagctgtagaaggaacgaaacttcagggttttcgactctgcgctcgcttcggtcgcagtggttctagagtccttccgctcggagggccagctgtggtctttagctagtgttacttgttttggggatttcttgggagtgtagcgtggctctgcccccctcccgctgtttggagttgcgtttttaaccgtcgtagtagttcctagcttcaagtcccccctttaggcataagccagtctagctgattactttgtgtaacaaaaactcttttcctgctaatatattgacgtgcaattcttttacgtgttcacaagaatatatgatttgattcgtcatgtggatgtgttgttctgaaatgatattcatgtggatgcagagtgtttgaaaaaacagaaaacgagaaaatcgaggagatacgtaaaacgagacaagctattaacgtgcgattaattgagtattaactattttaaacttgaaaaatggatgatatgatttttaaacaacttttctatagaatttttttaaaaaaggcattaccatttaatagtttgaaaaacacacgaaaaataaaaataagagactttttccctctgtctagaacgtatatataattcggctcggaattttaggaagaagcaatcactatcactcgaaccaaatcctaataatttcatttcagaatagaattctattgatcgaaacaaccccatgagactttgatttggctggagaaattcctgcgtctgtcactgtattact

SEQ ID NO: 78001 - DNA, 9591 bp, Oryza sativa
ttgattatctgtatgtcgcgatcgacaagttcactaagtggcccgaggcttatccggtcgtcaagatcgataagcactccgtacttaaattcattaagggcatcacagcccggtttggagtgcctaaccgtattattacggataacggcacccaattcactagtgagcttttcggcgactactgcgaagacatgggcatcaagctctgcttcgcctcacctgcccaccccagaagcaatggccaagtggagcgtgccaatgcggaaatcctcagaggccttaaaaccaagaccttcaacatcctcaagaagcacggcgattcgtggatcgaggagttgccagcggtgctctgggcaaaccgaaccacaccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgaccttgactacttggaggagcgaaggcggcgcgcggccctccgagccgcgcgctaccagcagagcctgcggcgctaccatcagcgccacgtccgggcccgatcactctgcgtagacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccatggaacatcgaacaccttcgtcgcttctacccctaagggggatcgggtgtcatgtttcgggctcgggccaaccccgcacccccctcgggcgtgcagggttggccgggggctaccacacatgcatatttttatttctcttatatctgctcttatatctgtatttcaataaaagcattttcgatttcctaaaggttgtatctgtactgttgtttccttttggagaatcttaacttgaaataggtcactcgcgctcaatcctgccctcgggggctcgggtcggctaaaatcgccaaaaggggcccagaaccgagccgtgccccggggcgtggtgaactccgggggggaatcggtaaaaacccacaatcgggtcacccataaccctcggtcaccacgctcccggcctggccagtctcgacacgtggatctccccaggcactagccccgacccgcgccttttgaggactgggacctgggcacgagcccttaatcaagctaagacacaaaaggaccacggcacagatcatcctcatctcatacacatagcaaaatgaaattgacacagaaatttcttcattttgattgcagattaagttaatctatacaaaaaggaggcccgaaggccttacaagaaagaaaagaagaaaaagctgaagatcggcgggggcctgggggctcaatccgatgcacccgggtcgtcagcctcgtcgccactgccgcccattccgccgtcatcgtcctcctcgtcggagttgagggcgaacgcgagccgaggggctgaaccctcgaagctgtggacgatgtggttggcggcgtcccggacctgcgcgcgcgcgccgtcctcggtcccgggagggaactcgtccagcgccgtccatggggagaagtcgggatccctggcctggtaactcgccagtacaagctccaccgctcctcgggcgaggtccctcgaggatgacttaatcgtcctctcgagctcctcggggagccgttggagagtcccggccatctccaagaggcgctgggcgaggcccccctggttggcggcgtactttgctgtcctcccgccccagaggcctgcctgccggccggcgcggtctagaccggagacggcgtcccgaagcatgccgggccctacctcgcctgccaagcggagggcctcgacctccccggcggacgagtctagcgcgccctgcagatcggcgatggtgtgttcggcagctgcgaggcgggcggctaagtcgctttcgcccacagccgccccgccgctgcgcgccctcgcgtccagctcctttgcctgcgcctcgagttcagcggcccgctggttcagtgcggccctctcggcgcggacaccttccagattacggcgcgcctgctcctcccgcgctgcctcgcggagggacaggctgtccgccagccgttgcgccgcggcctcggcctcctcgagagctcgctcccgctcggtgagcgcgtcctcgcggaggcggagtgcggactcctcttcggcgcagacggcctcgtgcgccgccagcgttgcctcccggatggagacgacggcctcgcggtccgccaggtccctctccacgacgcaggcacgctctttcagcgccatggcacgggcctcaagggcttcttcgcgccgccgggatgccacctcggtctccgccgcccgccgttctcgggcagcggcagcgtcaaggaccccccgggcggcgtcgagcttcttccctagctccgcctcccagctcccgtgttgaaggcggagggtgtcctgcgcctcgttcatcacggtggtggcgatgagggcagccccccgttcctcctccacctccttggcgatctccgccagcaccttccgacgggcttcaagatctgagacgtgccggcggtgtgccttgcggcccacctccaccatggcctccaccgagcatcgcccctcttcgacacgcgcccatgcggcgtcgagctccgcccgctctgcttgcagggccttcacctgggcacttaacccgtccaacaccgtggtgtttgcgacggccaaggcctgcagaaggggctctgcgttcagtggggcaacggaaggcgtggggaagagccgcctcggagaagatgccgcgcggctcgggccgccgatggacgtgccggactcggggatgtcccccggacctggattgtcctgagcgtcgcccgagggagtgggcccaagcgatgcgcccgcggcctcgtcgcgagctgcctcggaagtcgtcgtcgcctcggcctggcgaagtctggcctcctcccgagcggcttcttcagcttggcgagctcggacggccacctgggcagcttcctcggcttcccgaaggcgatccgtggcctcttgccggtcagtttcacgggtcgcctcggaggatgtcgtcgcctcggcctggcggagtccggcctcctcccgagcggcttcctcggcctggcgagcccgggcggcctcccgagcggcctcctcggcttcccgtaggcgatccgcggcttctcgccggtcagattcccgcctccgagcctctgcggccgccggatcctcggcctcagactggccggacttggaatggtgggagggacgcgacgggatctcgctgaaacagaagaaagaccagaagacaaacaagatgggtgagtgaaaactcgcgttgagagaatgaatacagccaagatgggcgtgggacgaacctgcgagggggtcggttaaacgaccaccttggaggggaaataaggtttccccgggatggttctgtcccccccatcttgcggagccgcttcttttttcgctccccctcaggctacgacgtcggcgtggccccttccgggcgcctgctgctggcacgcgccgccccgccccctcggggaggagatgggggaggggttccttcctgcttcctcttcccccgggcgtcggcagggcggctgctccccgggcccccgtcgcggggcccagaagcacgaccccctcccggggtagattgatcccccctgcggctcccgcccgcgccatcgtggcctcgaggagcccgctcctccgacgccccgaccgcctgcatgatggtcaggatggaggcgcgatctggatcgctgcagagggggaggactccttggggaatgagggatgcctccacggagctgagattcagcacccgttggactactatcttgaagtcctcaggagcccaatcccatctgaccccctggtgggtcctcatgtagtcttcggacccggtgtactcccaggcgccccgggcgcgccgctgaagcggcgcaatccggcgacgaaggtagtcgccgaacaccatggcccctgtgagcccctgggatcgcaggcccgccaggcggtcgaggacggcgtcatagccatctcccagatctaccggcgcccgccagttggaggcctgcgctgggggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcagccaccaaccactgacggcggcgacaccggctgtacggtgaagaaccaccggaacagccgaagggatgggcgcaccccgatgaacatctcgcacaggtgcgcaaagatggccaatgtcattaccgcattgggggtgaggtgcgccatctggagatcgtaaaactccagaacatccatgaagaaagaagaaaatggcggaaccagccctgccattgcaaaagggaggaagaagacggaccgccccgggtagcatggcgccgggcgtccctcgcccagcgtgactatctcccggccggtggcagattccggcatgaagcggcgcggcagcccggcctgcctctcgctcacgatgcgggaagacggcagcacgctaccatcgagcagagcggagccccgtgccatggcgccggaagaggagatgtttgagaacgagcgcgtgtggcgaaggtagggcacaggaaacaaggagttagggcgcaagcggcgaagacaaggggaataatgacgagaggaaggaagcaaatctcttcctcggtgtcttcatacccttgccaacgctgtgcccggctcctcacttctcgcgcccactatctcgctccctcgtttctcgcgcccacgcttccactaatcccattcgcccgcttgcggcgcatgaggtggatatgcggttgtggcagtcgagatggaacatatcgtgcccgcgttaattacgctcgccgaccgaagcgccatcaccatatctccaggcaaaacgaaccggctcgtcccgattcgcgtgctacctgagtaatgtggcagtcttgaagaggccgctcattattgacagtcgagttaccgttgccggagtgcgtgatttgtgaccattgggtttctgcccaactgtggagaccggtcccacctgtcaccaggcttttggaagtggcgtcacgcccgaccgcttcccttaaggagggcaatcgccctggcataacgccgggggctactgtcggtgacatgggaccgggagtatcatgactagaggcttgggcaggagcaatcacccacgaggcctgaccccctcgggggggtcgggcccgagggtgatgtggccgcccccctctttgtctccccgaggggtcggaccgctcccgtttcggccccgagggttgaggcgccctgtcacaccccgaagttttcctccctagtcaaaattgtaatttataattgaccctaagaaaatgctggtgaaatcaggagaaaaccctaagaaagtaatgcaaataataatcggatttgacatgtggaatttttcttgaattctacatgtcgaaattcattaacaggatttttagtggaattttcagagctctagaaataattttaaccaattaaaaatcactaaagtgcaattgttaattccagggaaaatcctttttccttttctttttctttttcctctcttttccctcctttttgtcaagtgggccgtcggcccacttctcccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgcattccccgcgcccgttcccctccctctcccgctcgcgcccgcgcccgagatggccgggattcgaaaaccgaatcccgcctctctctcctccccactcccccacgtcggccgtcgaatcccgccgctcccggccacgtccggtttccccatcccctatttaagcatcaccggcaccccctctcgctttttccccattgcgccgacctctcccgagctccccaacgcctccgcgccgtgcaaccacccgccgccgccgcttttgctactccggccgccgctaggctcgccgccgtctcacgccgtcgccgccgttagcttcgcgcggccgaggtccacctcgtccacccctcctccgtcgaggttcgtcgccggagccctcatctccacgcgcacgggtgagcgccacctctaccgccgccttcggccatggatcccgatcgccatggtccatctctctctctctaatccctatcttctccttccttagggcacgccgaagctcgtccgctagccgacgccgtcctcccgtggcttgccgtcgccgtccgccatcgccttcctccgcgccggccaccctcggtgaggcatcccctcccttcttttccccttcctctcctctagccgccgctctccgccgccgtcggtcgtcgctttgcgccgctgccgcatgtgcgccgccgccgtgtgagcgccgcgccgccggcgccatggtcgccgccgtctcgcgccgcgcccgcgcgccccggccgcgaggtcccgcgccgccgtccgatctacccttgggtagatcggggccgccggtccggtcgccacgtggcgccgccgccccatccttttcccgtgccgctgaccggtgggcccgcaagccgccaccctctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcatatctaattcatccgagctccgtttaatcccatttaagtctcagtaaatcaagaaaaatgtgtagaatccattaaaaatggttttgttctctgtttcagtagtcttatagcctgtttgcaatgtttgctttgtatgtcgctagattccggttctttcgacgctccggtgtacttcgaaatagtcgccgaggtacctccagcagcagagcaaggcaagtcatgcttgtcacttgaacatgttgatcctatattgcaaatgctccattgttttctttcaaatattgcattgttttataatatcactatgggatggatacctactgttacagccatgcttttggatatcatgctcctttgttagcttgggttataacatgattagactttggactaggacttgcttagccatgcttagttcaactagcacacattggggatctcatttaaaacctagactataggtttatatgataatgttggtttaataccaccgctctggtgttggttaaataaaatgaaccacatggtgggctgtgggtgcacggttttgctagtcgcacccatggcagttaaggaccggttcgcgggatgccctggaagaatttatcgtacttaccacaagccagcgtgggcaacggctgggcttatagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgtttaattttttacaactgtttttgcattaaattcctgtttataaatgccagtatttatgcaaatgaacctgcttagctatcccttgttaaatccatgcatcatacccctattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagtttcttttgttttccgctgcatttctgtaagacttttataatgtttgtaagacgtggatctgtatgtcaacattgtcgtttgtgtaccccggctggtcctggacgggggttttaatacacattctgcttggaattctattcgggaatttctgggcgtgacacgccccgaccccttgtaggttttgcgccgcgtatatgggttaggtgagcgcagcagggctcacctaaccgcatttattgcggtttggacgagcgcgtcacgccgcatgtaacgcagtgcagcgcgctcgtttatccggtctgtgaccagtcacagaccgatcagatcgtgggttaggtggcgacaggcggtctgacacacgcctcgccccatcccgtcaggatgagagcctccaagcactcgtccctagccgaagccggcgtgttacctcctggagatggcacgttggtcccggtcagatatatgccaggcttcatcctaaccattacaagcaagatattgtatgaagaagggcgaacatgcagattgctaaactgacacgtggtggacaagaatgaccgatttgtgaccggtctgacactggtcatgtcgtcagcagacagccatgttcccacgtcgcgcctgcttccggcggaagtggaggtaggtgtgggccgtcccatcagaaggtcattcggacggcaaccatacaaatctccgtccatttatgaagagaaggcaagtcaagttggagaaaagagaggataagtccccacacaaaagagagatggtgcatgtggtatccccttgaggtataaaaggaggaccttgcccacttagagaggggatccagaacgatcgaggctggattgggaaccagaggagagagtttctagagtaaaagctctctgactctccagctctttgtagcttcttcatacacagatccaccagaacacaggagtagggtattacgcttctcagcggcccgaacctgtatacatcgcccgtgtcttgtgcttcttccactctcgcgaactttccacagactaggagcttagaatttcacccagggcccccggccgaaccggcaaaggggggcctgcgcggtctcccggtgaggagccccacgctccgtcaccaacgatggatagaaacttggggt

SEQ ID NO: 78002 - DNA, 1418 bp, Oryza sativa
ttcccacgaataatacgagaatatattttaaactctcgaatggatgttaaccgttatttcatgtagttcaaataattaaaaaaaattacaagattgattaatatataatatatcgctacataaatatgtatgttctttacaagttttttataaaaacacacacattgaactctagctactttacatatgttaacagccattttttattgtaacttatagaaattaaatttaaagtaacatgtttgtgaaccgatatatcgcatattaatttatccttttttaatatatatatatatatatatatatatatatatatatatatatatatatatatatatatatatatgacggaacgtggggctcctcaccgggagaccgcgcaggcccccctttgccggttcggccgggggcgctaagtgaggttcttcaccctcgatctgtgggatgtcagcgagaaaggaagcgcacgagacacgggcgatgtagacaggttcgggccgctgagaagcgtaataccctactcctatgttctggtggatctgtgtgtgaaggagttacagagagccggagagcaagagagttcaggctctagaacccctcttcctctttctctcctctaccagctcaggtattctcagagtcgtctgagagtcctccttttttctcccttccttcggtgggcaaggtcctccttttatatctcaaggggataccacatgcaccacttctacctactcttcttttgggtggggacccaccctatcttgaccaaaacttggctcgcgccttcgcctggaagctaaatcacagcttgtccttgagtgaggcccagcgccgtcactcgcctgacacaggggataaccctgtcattccttcattaatgggtggagatttgcaatggccactgtccgaatgaccctccgatgggatgggtcatacctacctccactccgccggaagcagatgcaacgtgggagcacggttgtctgccgatgacgtgaccggcgtcagaccagtcacagaccggtcattcttgtccaccgcgcgtcagtttagcatgccgcacgtctgcccttcttcatacaatgactcccttaccatgattgcgatgaagcctggaatgaatctggccgggactgacataccaattccaggagttagtacgccggctccggctagggacgagtgcctggaggctctcatcattctgacgggacggggcgaggcgtgtgacaggccgcctgttgccacctaacccgcgatctgaccgttctgtgaccggtcacacactgcgaccggtcacggaccggataagcgtgcgatgcgttgcattaaatgcggcgtggcgcgctcgtccaaccagcaataaatgcggttaggtgagccccgctgtgctcacctaacccatacatgtggcg

SEQ ID NO: 78003 - DNA, 5497 bp, Oryza sativa
tgaagctggggagcgacggccggctgcgcatcatcagctacgcgctcgtgaactcctcggcgccggtcggcggcgacttcatcgccccagccggcgactgcgacctcccgctgcagtgcccgtccctcggttactgttcaccggcgggcaacggctcaacctgcacgtgcccgccgctcttcgccgcatccgtgacagttgccggctcgtgcacgccgggggacggctcgacgctcgcgtcgccggccgcgtgtcagaacaacgacagtagcagcggcggcgcctccgtttcatacatcgccctcaagccgctgacctcctacttcgccacgaagttcgacgccccgacgaacaccggcgtcaacaagacggcgtgtcgcgcgctctgcaccgccagctgcgcttgcctcggcttcttccacgacagcgtctccctgagctgccgcttgatcggaggaaagcagctcggctcgctgtacaagggcgcatcagatacaaacctgggatacatcaagacgttcaactccgcaaccaaggccgggagcaaccaaatcggctcgtcgtcggcgaaccacaccgtgccgatcgtcctgccgtccgtcgcggcgttccttctcctcgccgtgctcggatggtatatatggtggaggaacaagatgagcaagaacggcaggaaaaagaagggcaagagctccaccatgaaagtgtacttgggccgtcagaagtcgccgtccagggacaccggctataacgcggacgctgacgacgacggcggcggcgacgatgacgacatcgtcataccgggcatgccggcgaggtttagctaccaggagattacaacgatgacctccaatttcgcgacgaaggtgggatccggcgggttcggcaccgtgtacaaaggggagcttccaggcggcgaggggctcatcgccgtgaaaaagctcgaggccgccggcgtgcaggccaagcgggagttctgcacggagatcaccatcatcggcaacatccgccacgtcaacctcgtccgcctccgcggcttctgcgccgagggttcccgccggctgctcgtctacgagtacatgaaccggggctcgctcgaccggtcactgttcggccgcacggggccggtgctggagtggggggagcgcatggaggtggcgatcggcgcggcgcgcgggctggcgtacctgcacaccgggtgcgagcagaagatcgtgcactgcgacgtcaagccggagaacatcctgctcgccaacggcggccaggtgaagatctcggacttcggcctcgccaagctgatgtcgcgggagcagtcggcgctgttcaccaccatgcgcggcacgcgcgggtacctcgcgcccgagtggatcagcaacgcggccatctccgaccgcgccgacgtctacagcttcggcatggtgctgctcgagctgatacacgggaggaagaaccgcggcgagcaggaggcggcggcgccggccaacaacgtcgccgtcgctgccggcagcggcgagcactcggacttgccgtccggatggagcagcgcgatgacgtcgacggcgagtggcacgagcggcggcggcgacgagtacttcccgatgctggcactggagctccatgagcagcggagatacctggacctcgtcgacgcgaggctggaggggcgcgtcgacgaggccgaagcggcacgcaccgtccgcgtcgcgctctgctgccttcacgaggaccctgcgctgcggccgagcatggccaccgtggtgcggatcctggaaggcagcgtgccgccgccggagccgcgggtcgaggcgctcggcttcctccggctctacggcaggagctatcccttgccggtgccgggttcgttgaccgccatggccggtggtggctcgcatttggacgagtcactgaaggacacgtcagcaccaagatagcactatgaagaccgagctgcatatcatccggcacatatgacgtggcactgtacaattgtccgcagtgccgacgtggcagtacacctgtccattatagaatccatggaaccgattaacctgacgtaatactccctggacgataatctgcaatgctgcatactttcgtcggttcctcccgtggttatatgcttggcagtatctgcagttcttcatctgataaagaagaagagaaaactgatccatgaggtgtggacaggttgaaaaacacaaaagaatggctgccatagattaaaagaactatgccaacttgtccatgtactagagcattagacaaagttagctttgaagctggtgacatggacagatgataaaatgattgctgattaattagtactccctccgtttcacaatataagtcattctagcattttccatatttatattgatgttgatgattcatcaacatcaatataaatatggaaaatactagaatgaccttatattgtgaaacgaaggaagtatatatgatctgcccggtacatttgtttgggaagtagagaaggctgtaaactgtacttaaaaccaggaaaagaaaacagagataaataaacggcatacacttgtaatctttctttacataccaaaactaaggctgcgcgttcgagtgcaggagaaagagagaaagatagttttgtgttccacgcgtacgtttctcgaactactaaacggtgtgtttttttgcaaaaaaattctataggaaagttgctttaaaaaatcatattaatctatttttgaagtttaaaataattaatactcaattaatcatgtgctaatggctcacctcgttttgcgtatcttcctaatctcctcaatcctatccttctcaaacacacactaagtattgcattcttttttagatgtttgtttccctgtacttaaagacacccgttaaacgaggagaagccagtggcttagcggcgagaacgagtttttttttcctcatccactaggttcaacacaattatttacagaatgggttaaacattgagcttctttgacgtgtacagtagggctttaattatacacatcagtgggacaagcatgaaccgtgtgtccttattatacattatctatgttttcgggaatgctacatatcggaatcccgtccgaacgggacacttgcttatttaaagaggagcgatacctgaccatgcatgtcccgagtagcagtagcagcctgtacaggacacggtgccgctccagcacgcacgcatggctgacataggcggcggcgctacggcgcccatgcccgcaccgtcaacgcactaccccgcgcgcgaccgcgagctccttgccggcagcactggcgccgtcgcaggggaggaggagcccagcgcggacgcaacggtagatgtggaagtagagcgcgaaggtgctgccctcgccgcgtcgttggcgtggagcacgacgagcacgtacttggctagcttgtcgaggcggcggaggaagcggccgcccgcgacaagctccgacgtggcgtggacggtggaggatgtgactgtcggtgacgagttccggcctgggacgtggatgacgaaggacacgcccgtcgacgactgtcacgcccagaaattcacgaaccagaatttctaagctgaatgtgcattaaatccctgtccaggaccagcccgggtacacaaacgacaattgttgacatacagatccacgtcttacaaaaatagaaaagattacaaatgcagcggaaaagataaaagcgagctaaaccgggaagcttgacttcagcagcggggcgactccactccacaggcaatccttgacggcagcgacaaaaccaacttcaacaagatagctccaactagaaaaatctttagctctggtgtgggggaaaagagagcaagactgagtactacccactgtactcagcaagtcataccggaagaggaggtatgatgcaggatataaccaaaggaggctaggggttcttttggacaaagctagcatttaaaagcagtagttgaaagtagtaaaacaattgtagtaaattaatcaatattaaccaatcactgttcaacgctacaccacgttgcaacaggcccaaccaaccacctgaactacaccagttcattaagctaaactaggggtgagactaatcacggtgaatttggttgatcgcccataaccgcgggcacggctattcgaatagttttactctggccagaggtttacaactgtacccacaagacacgattccacacatgtcgccatgccccgaagtatcaccatgatactgcaaagggggaaatcgtgacaagatcctccacataaccctcccctaaccatccacaccacgctaaggtttcacccccacccctcaaaaggcagtgggcggtcccctcttgcgccgcggtgaatccggcagctggataaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccagtccttaactgccatgggtgcgaccagcaaaaccatgcaccacagcccaccattcagtgtattttaattaactaacaccattgcggtggcaccaaatccaaagctatgctagtagacaaagtctatgtaataatgtgatccctttttgtgtactagttgagctaaacatggctaagcatttcctaaaccaacatctaatcattttgatacccaggttatcaatggcatatggtaaacaataaatggctgagtaataggacccatcccacatgacattgtaaaagaatgtaacatttaatagaaatacgggacatttgtaaattgggtacaatatgatcaattgtaatgcatgacttgccttgctctcgcactgatgagaccacagcaacgtcttcgagaaatcgtggatcgacgaaacggccgaaatctacgtgacaaacaaagcacacaagcaaaacatgctataagactactgaaacaggaaacaaatccatttttagtggattctagggatttttatgaatttactgagacttgaatggacttaaacggagctcggatgaatactatgaatttagaagataactgtgtttttactaataaagaaaagtccttaatcaatttattgcgcaataatacccagggctgacgtcatccaggggggcccggctgcgccgacaggtgggccccgcttgtccgcgcacaaggggagggagagggggctcgagcaagtgggccccactagcagcggcacaaggtggtcggtctaccgtggaccgggaccacgcggtggtccactgccggtccacgggaccgacggtccggatcggcctcaaaagcgatcggacggcgcgggggcgcggggggggggggggggggggctaggcatggctcggctcggcttcaaaaccgaccggcggccatggcggccggcggcggcacgcgcggtcaccggcggtgaccggcggcgcgg

SEQ ID NO: 78004 - DNA, 2949 bp, Oryza sativa
ggttgttgtaatcatggtgagttggtaaaagccaaggaattgatttctgaaatgatgaacaaggatattcctcctcgtggtgtcaagtatttcagttcaataataaacaacctgtgcaaagagggaagggtagcagaagggaaagatatcatggacatgatggtacaaacggggcaaaggcctaatgttgttacttttaattcattgatggagggatattgcttagttggtaatatggaggaggcatttgcattacttgatgctatggcatcaattggcattgaaccgaattgttacatatatggtacgcttgttgatggctattgtaaaaatggaaggattgatgatgcattgactgtattcagagacatgttgcacaagggagtcaagcctacaagtgttttatatagcatcattctccatgggttatttcaggccaggaggacaactgctgcaaagaaaatgttccatgagatgattgaaagtggaacaaccgtgagcattcacacatacggtgttgtgcttgggggactttgtagaaacaattgcaccgatgaagcaaatatgctgttggagaaattatttgctatgaatgtaaaatttgatattattactttcaatattgtgattagtgcaatgttcaaagttggcagaaggcaagaggctaaggaattgtttgatgcaatctctacttatgggttggtgccaaatatacaaacctacagcatgatgataacaaatcttataaaagaagagtcatacgaagaggctgacaatctctttatatcagtggagaagagtggccatgcttctgactctcgtcttcttaatcatatcgtcaggatgttactcaataaagctgaggttgccaaggctagtaattatctgtctataattggcgagaataacctcactcttgaagcttcaactatttctttactggcttctctcttctcaagggaaggtaaatatcgggagcatataaaattgctccctgcaaagtatcagttttttgagggagcctggcaagattaatacattgttgtatctgaaattgtttcaacatgttgcactctagagtttcttctgctcccacgggaaggaaaataacctgtcccccaaaattctggcattgattattttattgttgttgtcagtaatgtgttgtttgtgttgaaatcgtgagcttgtcaattgctctgcataccttttatctgttgttattgaatgagaagctagacagcggagttcaaaataaactgttgcatttttaatacgacaacttctgatgaaaaaggtagcacaggtaggtgtatgcattgtgaagatatttgtgaagataggaactaacttacctttatattcttatgttttagttgatgttattcttggcgatcttctgcttataagcgactacttgattacttttgcttgaaggatattatcttcatttcagcacaaaaggtcctttgaagactgaatattgtttattcttcgacaaatttccaacgacactttatcagtaggaggttgttgcataatggtcagatcagctatagtttcgtttggacaatactcgatcctcaaatgttcaactggctgatctggtgatcgcctttatttcagacagttcagagcagagaaagccatttcctatgtttcgtggctatctttctggaccctgattcaaaacaattacttttttcataagcatatctttggcagatacaatcctagctagctagtgaacttcgtgatatggatgggcttattacttttgatacattgaagtcgtgtggaagcaggatttttgaacacgctgataaaatttttcactatcagcagacaagatgaatgcccatcaagttatacttgcataaaggtgagatgagtaatgctatgttttcattcttctgatgaaaacttgctatgttaaaatttcaactgcttggtttctatatttatttaacgaagtattaaacatacaaaatatattggcaatgtagggactgccatttaaaggaggggtaatcactcggtaaaaatttaaaaacattctgctaacaagtttttatcattgtttgcatcttggttgcctcctgctccgtggtaaatgacctagtcttctcctgtaacagaaatggaaaattgagttgctgcatgcgatgaggttcagcgttgtgtttacgattcactcagggaaaggctggaggtagcgaagagggagattcgccattgagttgaagatggaagtgctttcccatgattgcggtaggtagaagaaattattttgcaggtagtgttggtgcttttgatgtcttatttttgcatatcgttcacatttttctccttcttaaattctcctgaaacttgttagagctgtgacattcatcatctacgttttcagttcaggcaatgttgcttactgcttagttaaggtataagaaattatcgaagccaacttatatggagtgtggacagtttcatcgttattttagaaaaaccaactaatagtttcatcatggtttggatattgtgcatgtaggtttagatgcaagaaacataagtactgcagacctgaaaatcgaagcgctgacaacatagctgcaataataatttctctaactggcttgggtttgaggtctgaattaatcagctggttttggtcacaaaatgtgacatgaatatttctgaacgttggtcaacttacaattacatctgtccaaggctcacattctgttctctctttcagaattgcacttgtgaccatataaatctgcatggatagggatcactacctgtttatgattctctttccctttttgtactgaaattttccagggatgattaagggcctgtttggcacagctccagctccagctccggccctcctggagctggagctcagccaaacagtttcagctccaccaaaactgggagtggagctgg

SEQ ID NO: 78005 - DNA, 6813 bp, Oryza sativa
cagcgccatgcaaaatggacggcgtctccggccggccgcctcccgcattgctcgtcgtcatcctcgccggccaccgcgtgtacaaacgtacgacgttccgctcctcccacgccgccgatcgctgtgttggaaatagtccccacattgattatttaggagaagttgaaagtgaggagagtggattttaagctttttttttctccaataaaaactggataaacttttagataaaagtggcatgctttttaaactgctaaacggtgcgtttcgtgtgaaaactttcaatatgaaagttgctataaaatataagattaatctattttccagtttgtaacaattaaaactcaattaatcacatgttattatcaccttgttttacgtgaaacacttaatttttatcttcatctttgtcttcaggaaatttaaacaccaccagaaattcaaacacttaatctttctctattaagctagcttttaggatacaacaagattattttttccggttagaccaacatatctcggttttgggtcaacttgctgcgcaatacagcagtgggattgatcatggctgttgctgaggctaatcgctgctgcgaccgcggcgaaactggccggccggcacagcattaaagagttagcttagcttcctccgatgggtgtagctaccggccggccgccgggaggtcccccatctgcctgccgccaaagccttttaattatgctcactgtttgagtgtgttggtttcgtatgcttgcacaattaaggctaaacatgaacccatcgatcggtcgttgccctcagcttctctctcatttttttcatggcagtcggctgtgttttttttacgggtttggaaacatttctcctcggcgcataaaacggaggatggattaacgcatgattgattaagtatttagttttaaaaacttttaaaaccgcaatgtttaggctgtgttcgagaggtaaggttgggaacctttcctcctaatacggaaaacgaagcatacgattatagtgagattaattaagtattagcttaaaaaactttagaaatagattaatatgatcttttaaaacaactttcacataaaaaaacttttgttaaaaatacaccgtttagtagtttgaacagcgtgcgcatgaaaaacgagggaagtgagttgggaaagaggaaaaaagaacacggcgttagcagttcggaaaacatacgcgcaaaaaagagagtaaaagtttaaaatgagaagaaaaagaacacatccttaagagcataaaatgttttataggtgagggttacctctacctttgtctacatcatctatttataaatttaaaactagcctacatcaatacacctctaatacactagtcccagtacatttttcaccagtctacttctctattctctttcaatctttaaagtttgtgtagatgttacccttatatgaggggtgatttgtcctctcttatcttctctcctacacatcaccatttaaacctacataacaccttgtgtctactattaagaagcttatagtactttctctaccaacaagatactccattcgtcctaaaatataaatatttctaaaaaattttttaaaaaaattaagcatgtatatgaaattataggttgaaagttatgattgatttgagaagagaagatagatgaagaaactaaatgagaaaatgttgtgattggttaagatggggtaagtggagaaaatgggacggaggactaagacattattggttttagatattacgtttgacaattcatttccattaaaaaaaattatattatcatttttattgtaacttgttttacactaatcatgctctagatgtgacttatcttttcgtatttgtgctaaatttttaataaaataaatagtcaaaatgttatgtctacaaatcagcagcatatcatacatttataaataatgggagtacatttataaataatgggagtacaaggaaagataatttattgttcaatgcaaccttccattaccttaaaaaaaatcatttgccatatgtacttccatctagaacactcctgcttctttttaccttcagcctggtcagagtgattttctatgtaacgtgatcagaggccaaactagctttgtccccccgccaatatttaacattttagttcaaataaaacaacccacccaccaaatccaaattattaagaatgcctcttccccctctaaaaacagcattcatcctcgggcaacatatgcaaattaattcgtgatttctatataattctttcgttatacccataactttgatttgatcatgcaagaacgtactgtgtgtcaataaaacaaatggcacgggggtagcttagagcattattggagtactcttatataggagttagtagtgagtgatatatctgttctaattaagctccttcatcttattgggttaagggtttttatttttggtaaactggtcactaaaatacactgatacagactagtcctaataattcataagcacattgatgatgcagaggaggccatatgtaggggcatgggcaaaagtgctttgacagtggcagagcagttaagaaagttaaagtctaggagaacttgtgaacgaatgctgaggcccaatcaggctgaagatcgatgtgtgttctgactttggctagtttctgcttcccctttgcagacagcttattaatcagatcccccacagtctcatagttgcatagggtcgctagtggtgggcttgatctgcctctgcctctggaaacaatggaggagtagatccgatgtgttttatggaacatgatcgattgatcatatatcaaaggcggcttggatatgggtgtgcaaggcaatcagagatcctgtactatggttcacgtatcagtggcacaattgcaaactatacaaaatgacaatcagataagccacatccacaaacgtaaggatggcgatttttcaagtgcggtcgtttagatgggccgctgatagaaatatatttttcaccggggatactttgaaagggccgtctgtttaaaaatcaatttcccttaacctattttgctgatgtattttcacattcttaaccagactatcccgacgtatttacatatatagacgtgcatgttttaatccgcctctaaaaatacaaagggtgtcactaaaattgattttttttaacagtgttggccactaatactagtaagtacatgctaatttatataagcacattgatgtagagagggaccataaacaaaaggggctttggcaacggagggttgcggcgtggactgtagcgtagcaacaaagttactaagtctaggccaaacttgtgaaagggcgaggcccaactaggctaaagattggcctttttgcttacgcgtttgttgtgttcctctttgtatttagcttaattagatcccatgcatatggttcaattgtcagcgatctcccaatagttgcgcagggttgctgctggtggctctgcctctgcgtcaggaaagagtggaaaagagaacatcgggacatgcaacttcactgaaaataaatatcaaatatggatatgtaaaataaaaaaactactaattaagttttaataatttcaaacttgaaaaatgttttatctgatattttaaagcatcttctatttatatataaagttttcgcataaaatacactatttaacaatttaaaaaacatgctaacggaaaccgatgtaagatctatacgttaaacagaacgaacaaggtattaaaaatgagtagatatgatgtgcaatgtacgagtgagaatcatataaagatgcgaagaaatgtgacagtgacctgcactaatagaaaaaacatttttgtgacgttgggtatttatttttgcaggcagacatgatctttggagctaaatggcaacctaaaaaatgcaaaccggggtaagctcgctgtccacttgtaaaaatctattttcacaggcggaccacttaagcggtccgcctgcaaaagtaccctttatttttgcaggcaaatctcttatgtgccccgtctacaaaaataaacttggaatataaatagaggcgacataggggagattttttctaagtcctctctctttctccctcactcctctcctgcgtccctcaccttcggcccttccccctcccctcccctcccctccccggcgtgctcccggcagcgggcggcggcgactcccggccccttcctcccagatctggctagagggggcagggggagggcggtggctggcagtgctcccctccctcgcgacatggcggcggcggcctccggcagctgggcggtggtggcggccgcatgcggaggcggcgtggaggcgggaggtcggcggcagtggcggcgtccccacctcccacatccggcagctcccctctcctccctctctctctccaaaaacactaaccgagagtggagggcagcggtgggtagggctagggcaccgaatttttttttacgcttaaaaatatttttgcaggcgggtggatttagctgcctgtaaaagtcattaattttcgcaggcgtttggttgcaggcggaggctatggacgcctgcaaaaatgtgttttagccgccagtaaaaacgtgttttctagtagtgctagaaggacattacataccatcaaagataatttagataagagtgagaataggatcgaggtgtgtttgtgaagactttgtttggttaatcccatcaaaagggaattaatttcatacctatctttcttagagattaactgaacaaggtctaatggaagatgatagatgatcaaaggcatatataaatactacgcctcatacatagatcttgagcaagggtgagagagaagtaactaaggacataacgctgatattaatgtcaatataaatactactccacatgcatagatgtcgttgtattagcaaaacaatgtacacagttatccggtttcataattggaggccaaactttagaccatgttaatagactggacatgtaaaagataaatataaccgccgcatacaatttttaacatttcatatccttttctctggttgattttcgactatggtgcgacatcaacactattgtagcaaaaccacaaacaacttaactcgatcaacattttaacttgcacagtgaataagagatactcaaattagagaccatagaaattatacataattattatcaaatcaacatgtatataagagtaaaccaggatacccttcaaagaaaccaaaagaaataaagaagaatgtccgtcgtgatttcaaaggaaaaagagagaggggaaggttgggtgcgatccttcacctctctttttaaaagaaagttcatcgctctccacgtgcacgcttcttaaactgataaactgtattttttttaaacaagaagttatatagaaaattattttgaaaatcatattaatttatttttatatctaaaataattatatctaattaattgtacgcaagtggctcatctcattttccttttatctactcgtttctccttgcgtcaatcacacacttacaaaaaaaaaacttgggggtatctgtggtttccattttacgttttacccactagaaagcgtattccaccgcgctgtccatccactgactcctatatatattttcttgcgcgttatttaccgtgctcgtgccggcatctcttcccacccaccaatacggttacttccctccccctttcctgacttataggaaaaagtcagttttactcccctcaagtatgaccctggagcaaataaccccctaacctttaatttggtttacttaaccccctagattcttaaaaccggatcactattcacctttctaatctaatacaaaccgctttgctgatgtggcacatggattaggtggttttgcttactaggttggatctaacgtggagaaagagaacctgggagattaatcacacgtcgtattctcctccatgcgttggactcttctccctcacaagtcctctcatcatctcctctctcccttccgacggcggagaatccaggtgatgatcgtctcagataggcggtgctgatccgtgagatcgcagccccgtggtgtgtccctccccctccctcccttcctccctccctcctccccactcgatcttggcatgctttaggtttagggttgttctagaaggggataataagtgcgtgtggcagttggttgatgaaatttttttggttgatttcgttggtggtagggcactactgagggttaggttgttgctatcccttgctgtttttttttcttgcgagctcattatccatcgtcagatgccggcgctcggcgtgtgcgtcttgaagccgtcgcgagcgatggcacatgcaccgcaggcatcatacctagtggaaatgctgaaatggagcaaatcattgccatcgacgatgtagcatgggtggcagccgacgcccggcgagggtggctcacttcataagttgttgttcatcagctatctcacttcatactgtataagggactgttttttggttgatttttattttatcttgggatgagttgtttaggatttggtagataattgctgcttgattaatgtttcattttttaagataagtttactgatgatctcattgttgccatgttaggtgtaatggataatttggatgtactttgtatccggtttcactttggtggggaatttgattatgatggatattctgtggtttataatggtggtcaaactgagatgtcatacatagagagggacaaggtggcattaaaagacagggggatccatggtctataaaaacaccccgcg

SEQ ID NO: 78006 - DNA, 3879 bp, Oryza sativa
atatgatcaacaaaaatacatgaatattgatcctcatgctgtttcgtttaccaatgtagggactgtaagtgcagttgaggaatttttgccacaaattgagcacaggatgtgcactagacacatctatgctaattggaggaagaagtatagggatcaagcattccagaagccattttggaagtgtgccaaggcatcttgtagaccatttttcaacttttgtagagccaagcttgcacagctaactcctgctggtgccaaggacatgatgagcactgaacctatgcactggagtagagcttggtttaggatagggtccaattgtgatagtgtagacaacaatatgtgtgagagcttcaataattggataattgacatcagggcacatccaatcatatctatgtttgagggcataaggaccaaggtttatgtcaggatacaacagaacaggagcaaagcaaaaggatggctaggtaggatatgtccaaatatcttgaagaagttgaacaagtacattgacttatctggaaactgtgaagccatttggaatggaaaagatggatttgaggtcactgataaggataagagatacacagttgaccttgagaagagaacatgttcctgtaggtattggcaattggcaggtattccttgtgcacatgctattactgcattatttgtgagctcaaagcaacctgaagattacatagcagattgctacagtgttgaggtgtataacaaaatatatgaccattgcatgatgccaatggagggtatgatgcagtggccaattactggtcatccaaagccaggaccaccaggttatgtcaagatgccaggaaggccacggaaagagaggaggagggatccattggaagcaaaaaaagggaagaagttatccaaaactggcactaaaggaagatgtagccagtgcaagcaaactacccataacattagaacatgtccgatgaaaggaaattcaggaaaaaagatatcagtacaagagagagcaagagaggcaagtaatttacatgctacatatataagtggttgagtattgacatatgtgattctgatctctacattgaatgcaggttcaggaatgtagcaggccgcagaaaaggtttaggccatctgtagctgcaggaacttcgcagcaaaaagttcatgtaagttgcaactacattgcagactatattccatcacaataaaggtgcccaaaatatatgatcttttttttcatgtaaggtgcagattgatttgccatcccagagcagcagcttgtcaataacaaagaagggacaaacgatgaaagttgcaagaacaaacacaacaaagaagtgaagatttggttgcatatggcgtgttgtttttatggaatactttacatatttttcaataaagtacttgtcaaatatttggtggaaatggtaggtgtaatgtaaggtagattgagttttaagttattgaatctggttagggtgaacaaattttggtattacctttcagtctaacttgttataaatagtctgaatgtcaactcgttaatttagcatgtaggctggtgtgcttccttgctcctgctaccttgctgctatcttccagtagtctcaaaactgacatatgaaaaatcctcacgtcatcactttccacgtcaagtgcaaatttccttgtagcctcatcacctggcaagtaaaacctggctacaagtgaaaattctccacgttggatccaacctagtaagcaaaaccacctaatccatgtgccacatcagcaaagcggtttgcattaaattagaaaggtgaatagtgatccggttttgggaacctagggggttaagtaaaccaaattaaaggttagggggttatttgctccagggtcatacttgaggggagtaaaacggactttttccttaatttaataattaattcggtcagttttccatgcacgcgcgcgtttgttggtgtgtgactgaaactccaaatcatctcttacagacagtcttcagagtttgaatagttcgtggcacacttcctgcaaatcctgcttgtgcatcaagtagcgcgtctctgtgtgtgtgttagcacttactaatatcccatttaacgagagtatgcttttcaaactactaatcataaataaaatactacttccgtcctaaaatattaggatttgattcattcttggaaaaacaattggacactaccatataattgattttttcatgcggttaaaatcgattttcgcagacgggccggtggcccgtctacacccaggtgtttgcgaaaattatatttttgtatgcgggtagagcaaccatcatgaaggcgcttaagcctctgattgcaaaaagaaaaaaatgctaaaattattttttctaaagccccaaaactctagctagattcacccagccggattcactgcctactattactgctggatccacccggccgagcccgcggtcgattcgccgcctcccatcgccgtggtcgcccaccgccccacccgccccatgccaccagtagatcccacgctcgacggttgctcaagagagagggagaggtagagactggatagaggccaggagtgggagggaagtgaggagagtggggagtgggagggttggatagggagtgggcaggagaagagaggaatggacttatgggaagaaagggaggaggggagaaagaagagtgggatatttttcgcatgcggacctcttaaaatatccacatgcgaaaataggtttacttttttatgcaggcttgttaacacacccgatttttgcaagaggtcatcggatcgtccttgggggagcaatttttatatatgggatagttatgatccgtctataatataaaggggtctcgttggtaaaatcaattttataatagtgacagaggtcaaatcacattctagagagcaacacacattttgtaacaaagaaagtataaaagtttgtttttttaaaaaaatagttttaagtttttttttttaaaaaaatagtttttaagtttgcaaaggttaatacttaattaatcatatactagtaataattcatctcgtttcacgtgacacgatcagctcaccagacgcagctgaatcgaacgcagctactactagtatcgtcagtgcgacttaactgctgtgcagttgagttactgacatatgggccatagtaaggtgggacccacatatcagtgactcaactgtatgtgcagttaagttagaggatctgcttccgtccctgtagatactgtgtaacaccctaaaaattagaccgacaaaaatctaaactccaaaaaattgggccttcaaaaactttttaaataaattgcatcatgccgattttattcgattagtttattggattttgatttcggagtttataaatcacgaataatggaataattaattaggaataaaccctaaaagtaaattgacagggtaaataattaaagtgcaatttaaaataagatttggggaggacagaaatgagtaaaatattattacgaccatatttgtatcaattaaatctaaatgtgatggaataagaattaactctaattaaattcaagaaaattatataaaaataaaatatgggtgctatcaatctagagtgaatttttcgattaaaataaacacaagtatatgtaaacgtcatttgtggaaaaattaggaattaaaggacaagatttataaagaataggttaaattaggctagcactgttcattgcactctaggtgctcgacgaggttccctagccctaaccctccttgccgcgcacgcccggccgcctcaagccccgcgccgccgtcgcgttgccgctaccacaccgcgccaacgtcgctgtcgctgcctcgcgccgtgcgccgccgctg

SEQ ID NO: 78007 - DNA, 4391 bp, Oryza sativa
ctcctatataggagcagagactagaggggggctgctgatcacgggcgtgcgcggccgcgcgaccagtcgcggatcagcgcccctgtagcgagagcatagttaagaataagatggagataaatttaaatgatattgattgatatgataataagtatgttaggattgcacttattttagaaaaaaatttagaattacacttatagtgagacttagcgggcagtatactcttaagatgaaataaaagctgcaattagtgcgctaacagcatcacgcgcgttcatcatcctagtcatcaaactcatcagaatattgcaacatttcaggagtttctatttattttttttccaaagacccaacatgtctttgaatttatttcaggattcctttttgcattgtcgttgccttggttgtatcgtcctatctacggtacattcaacacgcgccggtgcgccttttagtttcagaattccaccatgtttggcaggcatgattcaagtgcgtgatagctgaataatttaagacgaatcgttagcctcgtcaaatttctttcagcgagattttcgggtccgccttgtcagttctcacacgttctggtctactttggtctgaagtctgaacccctgagagtcagagacgctcctgctctttttcccaaagctcagcctcgtcaggccatagctgatagctgccatgaggtgagtgaataatctgattttatcttcaaaggtttagttgttcctctccttcaggtcatccatctaattattgttgttattttcataaaatctaattatagttagtagatgcaaattttacacttttacagcatttcagtgtcctctctcctcttcttgatgtacttggtgcgcaccggtaagcgccaatcccgctacccacgtaaatatcctctttatagttaatttcctacctagtataaaacttgaaagaaaaaacttttctttaaggaataaagaaagagagaaactaaaatttcgataagcgaaaaaaaaactccacttgtccatttcacttgcatccctaattaaccggtgtcaccaatcatcaaactagggactaacagcttatttataagattttcctttgcggggaagcttagttataagttttagtttaggggactaataattgcctacaaatttggtgccagttaccgatacaaaattaaagtcgcgttcagagaaggcaaagtttgatttgatgccacactagtcgatcaggcagtaggatcttttgactagtgaagggcctggaatgggtgctagtttgctcacttgggccaaaatataagagttttcctgggccgaaacggactactactcttcaactatgtcaatcaaatttcaaaatatgaaatccttaacaagtaaaaaacttctatttaatatgtgaaaatggtattagttaatctctatgaaaataacttaaatatttatttttggaaatatttttcatgaatgaatatataattagaaaatagtagatacagatcgatgccagaaattttcaagtatagaaataaccaatatacggtacataataatataatatttagtttgcaaaatattatgctacttatttttttctcttccgaaagcacaggattaatttgtgcgacacagtgcttaatgttgatccctgataatgacacatcatatgccagggtgacagcaattgatgactacttcgattaattctttctttccatggaccatgacatgctgaacatgacagtgcccttttcctttgacctgaacaccgaggcacgtaagttcgactactcttcgaccgtaaaattaacaaaataaaaaataaaaaataaaaaccgtcgcccaaaatattacggcgtcaagtaaaaccgagtcaatatcactactcaactattatattgaagaccgggcataattcatcggtccaaatccaaatttaaacccgtgtgggaggaaaaatattttttagcatgcagtcaatctcaacgtacgaattcttggtcagcatcaagagaaacgaatttgaacagaatccaggaatgaactgcttaatcaaaacctagcacgtaattaattagactgagtttatatgctgcataataataataataataataattaaatttaaacacgtacgcatttgctgacttcaaaacatttgcctccatttgcagaagactgatctgacagcttcaacctaagctcaaaccgcggccggccggctatatatacgtagctacctgcttcgtctcgccatgcaattgattaagctaattaacatctctcttagcgcttaattttagcttagcttagccgctttcatctcgatctgtctccccgtttgcgcgacacagcaattaacggcgatggcggcggcggcgacgacggtgacgaagcttgtgctggtggtggtgctgctgctgcatgtctccggcgtgctggcggcggcggcgaggacgctgcctggggaggagtggctgatgccggaggccggcgtcgtcgtacggacggtggtggagatgctggtcggctccaagtccaacggaagtggtggcggccattgctgctagctccgtcgttccaagatggaccatggtttgcacgagctgtgtgctaactggtcgaactgacgaattagcagatgatgcatgctactagcagcttgatacttctgtatatagatagtggagaacttgtgatgtctatatatatatatggatttgttagttaattctcaattcctttttgttacaaagatgaaatgacttcccccatgatatattatgggggatagacgtggggtcttacggctagcactacatgatatgggctagccgatctaggttaattcgggcctcactcccctcctaacaaattttgatataaaagttctcatatccggtgttttctttatatattattaattatactgttatttattaaggtactactccctctgttttatattcccttcgtcttataatataagggattttgagtttttacttacactgttgaaccactcgtcttattataaaatttgtgcaaatataaaaaacgaaaagttatgcttaaaatactttaggtaataaagtaagtaaaataaataaataataattccaaaattttttgaataagataaatagtcaaacagtgcaaacaaaaactcaaaatcccttatattatgggatggagggattaccaattaagctcactaaatgcatgtgtatatatgcgaaatacgcagaaaatgttattttcagccatattaattaggaacgcacaattttcggaacatgcaattcaattatcaaatgctttataaaaaagtgtcctgcatggtgtgcgttccaaacaaacctcgatacatcagtctgagtttgatcggttgcatagcaccagatagttttgcaatttatgagtgtgttatggtataattaagatcccagtttcagctgtacaattttagtagaatgtacaagcccaagcagctgtagaaatcatcatcaacctttaaaaaaaatccacgaaccgtatagaatcatatttcttctccacaaaatgggcttaaaaccaaatttgttatagtatagctcacgcatatcattgactcaaaatttaagctttaatcttaacttctttttttttttaaaaaaaaactcaacctgtttaccgagtgtggttcctatctgtactggctcggttgataacttaatgatttttttaaaagtaaattttaaaaataaatcctctgaaaaattattcagttctaaacctttttagccacggcattttaattggtataaccgataaaaaaagtcatagcatagcgagaacggtgcactaagaaagatccaaaggtctcttctggcaaacatcacaagatggtaggtagtcagccaagatcgagcctcactcctcttaataaacccctttcatgtttagcgttttttctgtatagtacgcattgaacgctttgtttcagtctctgttggacatgattcatgcatgattctttaatttaagtgtaacaacaaattaagaagaattatattcatcgatcctgcgggacttttcaagttcatcctgatctgcctacatatacatagcttcgtttaaacttctcaaagcgcgcgagagattaatttactaattaattcggtcagtttttccacgcacgcgtttgttggcgtgtgtctgaaactacaaaatcatctctgccttccgagttaggtttagctagctactcagtcttcagagtttgaatggttcatggcatgcacttcctgcataatcctgcttgtgcatcaagctagtaggctaattagctaagtaaagcgccagtgcgtcactgtaggaaaggtcacagaacttgtaattaag

SEQ ID NO: 78008 - DNA, 3794 bp, Oryza sativa
cgcgaaggcggcggcggcggcggcggccgaagacgacggcgcacgcgcggagggcgccggcgctcatgggagagagggaaggaaggaggagaggggattcctcaccggcgagcacggcgaccggcgcgaaggaagaaaacggcggcgacgaccggcgatgccgaggcgcggacgggcggtggcggcaccctaagagagagcagagaggggttaggggaagggaaggcgaccacggcggcttgaattgccggccggagatggaggggagagaaggtctcaccggcgcgcgaggagaaaagggctccggcgttgttcggcggcaaccaagcggcggccgaggtgcgggcgggctcggtgagcgcgacggcggcgactgcgcggcgcggcggtggctatagtggcggcggcgcgtggccggagacggcggtaggcagcggcgcaaggggcgagcggcgcggtgacgataggaagcacgggagggcgcggcgagtgcgaaaaacgagagagggagatgcggggagcgatttataggtggggcggacgtggccggggaggtggccgttttggccggcgacgtggggtggagagagagagaatgggggggattcaaattcgaatcctgccccttgcgagcgctcccgcgggccaggagatgcgggggagagggcggcgacgtggggaggacgcgggagcgacgcggcgtgggcgcgggaggagcggaggaggcggcggcgcggcggttttggcggcagcggttggagctccggctccaacggccggaggtgggagacgaccgacaggtggggcccacctgtcggtgtcccgagagaggagggaggggcggcttgggccggcccacaaggaggaggggccgcgggagagggatgggccgacggcccaacaaagaaaaaggagggaaaagaaaagaaaaagagaaaaaggattttcctgggattaaaaatattgcacttgctcaattttaattggttaaaattatttccaaggctgtgaaaattccactaaaaatcatgttaatgtattggagcatggggaactcaagaaaaattccaccacgccgaattcgattattaaatgcatttattaattaggaatttagctctaggttacttaagataatttcttctggcaatttatttaaccaatttttaaagaaaaaaaagggggggggaaacttcagggtgtgacaacgacgagctccgtcgtgggatgtggatgacgaaggacgcggccaccggtgacgagctccgtggcgtcgacggtggaggatgcggccgtcggcgacgagctccggcgtggggcgtggatgacggaggacgcggccgccggcgacgagcttcgacgtggcgcggacggtggaggatgtggccgccggcgataagctccggcgtgggacgtggacggtgggatcaccggcgacgacgctttagtgcctggctcctgatatctggtatgtatcgtctgatacctcataagtatcatcttctacgtgataagaatcacatgatatctgataggtatcatttgatacctaacaagtatcacctgatacgtggtagaatcgcatgatacctgataggtctcacctgataccgggtaggtatcgggacctgatacctcgtaagtatcaccctctacgtggtaaaaatcgcatgatacctgataggtaccatctgatacctcacaagtatcatctgatacgtggtagaatcgcatgatacctgataggtatcacctgataccagctaggtatcaggacctgatacatcgcaagcatcacccaccacatgataagaatcgcatgatacctgataggtatcacccgataccggctaggtatcaggacctgatacatcgcaagcatcacccaccacgtggtaagaatcgcatgatacctcataggtatcatctgataccttgcaagtatcacctgatacgtggtagaatcgcatgatacctgataggtatcaggacctgatacagcgcaagcatcacccaccgcgtggtaagaatcgcatgatacccgataggtatcatctgatacatcacaagtatcacctgatacgtggtagaatcgtatgatacctgataggtatcacccgatactggctaggtattaggacctgatacatcgcaagcatcacccaccacgtggtaagaattgcatgatgcctgataggtatcatatgatacctcgtaagtatcacttgatacgtggcagaaacgcatgatgcctgttagatatcaggacttgataaccaccaggtatcgtttatctagaccgatcccactatgtatcaaatatgatacttggccatccagttatctagtacttgataccaaccgatatcacacacgatgcctgttatgaggcatggcacccactcggtatcagacatgtgtgatgcctgttatgaggcatggcacccactcggtatcagacgtaatacctaataatagacttgatgctcacccggtatcagatgtgatacctacctagtatcagatttgacacctggtagctaggtaggctactacttgctatactgaactagtttagctatcacatgaagattttttgcgtatgcacgtggacaaaatgacaaacgatggggtgacatgacacaccttttgagacacgatgacagacatactaattgaatggaaggaatcgtccggctaaattgcttgcgggcctataccgtccgaacggtataccagtatatagcagccccccaatgttttctaaggaaaatccacctgtacgttgaatcttgcaagtattattttgtgctgtggtggagacgtatgcgtatatttgatttattttcatgtctatagaagtaaaaaatggtacgaataattattaatttttaaagaaaaataatgctctagctcacaggaatacaaagagagttcggtgggtgaacgaaaagaagagtacaagagtacgtactacttaccagtgttgatataggaaatgcacaaattaatttatccggcttttagcattgggaatagttaggccctatcttttagccaaatgctaataatacgccgtactttgcatattagtaaaaaaaaactaagtaaaacttttatatacgtactcttagtgatttaagtgttaaaatgaaaatgaaactttgataaaaatattgcaaaataagccttaaaagtaagtttccaaatttaaattttgtcaatggtcgattctatacggaggaaacgatgggccttttgctttgctaaatctgtgattatcaggtagcccgttgccacaaactaacggtacatctcatcctaaattttgctttatcagtcagaaacagttgatatttgctaacaacatctgcggctctgcgctgattgtcaaaatcaagctagcgatgacaccacatgaccacagagtcaacaaacagccaaacagttctacaagaggctaggggccggatgctggcaatatatactccctctgtcaaaaaaaaaaatctagaactagacatgacacattttaatactaggattctagataaaggtgtgtccagatttgtcctattagaatgtgtcacatctaatattagattggtttttttatgggtcggagggagtgcagagtattggacgtgctcggactccaaaacatatgctgtttggaaattttttaaattttttaagtgtccttagtgctttaaaagctaatgtcgaaaaagaaaaccacattaaaaaaacctaaaattttctctaaaaattaagtttcaaaatttaaattttgg

SEQ ID NO: 78009 - DNA, 3008 bp, Oryza sativa
aaaacagaaggcgagtaaaaccaaaaaaacgctagccgtgacgacgaggacaccaccgcactcaaccaacagtcggcgcaccagcagctgaggttggaggaggaggaggaggcgccgcccctcaccgcacctcgcgcggcgcgggcgcaggcggttgcgagcgacggcctcagcggcggcggcggcggcggcggtggtggtgaggaggaggaggaggaggagcggggagagtgtcgcggtgttgtcagggtgaggggagtcagatgcgcgcggaatggggaagcccgtcgatgtggagctcggcggcgcggcaggcctcgagatcgccggcggcggagggggaggagggggaggggtgtgggccgtcgccggggcgatcggccgcgccgcgtcgttccggtgcgtgttcgtgctcgcgctctccgtgggagtcctcgtctcggcgctgctgctcctcgtgcccacccgcgggcacgggttcctctccgacgaccccgtcgtgctcggaggtgagctcttcccggtcaaattttgcttccggtggtgcgagggtatggggattcgtgggtttaggtctagtgaagtggtggatcgatgatgggatgggggaattgctgcttggggatctcatgccgagtgttgacacttcgatcccgccttcatggagctaggatttgcgtgttttagtagcgaattttgtagtttccggtgttccgggttttgtgcgacgcctggttcgttcgctgttttgctattccaagttcccaactagcgaaaatcgcattccctcgtaattagttatcagaatcttacgtggtaatgcctacaaatctcttgtatgatctgggtcattaaattggatggtcgatgtactctggtgcgacatagatgtcagagcaaaagcttgtatggtagtacttggtttacccactccttattctgtgcacaacgtgtaattgtctattggacattggagatttctagtaggttttcaagcttgcagtgtgtggtcaaccgagatgtgcgatttgctcttcttcttagagtactagtgactgcggcaataacaggagttgatttattgattaacatggctgctacataatatgatgatggtgcctcaagataaaagtacgctaagatttgcttcactttggcaataactgtaaaagccgtttgttgactattttgtttgatgggtacttggtcttatgatgtgcaaactatgaactgtgaatggaagcttgacaagcatggcatttgctttgttgtaccattgaaattacatagatagttttgtttgatcacaatagatcgaagtatgaactgtgaatgaaggcttgacaaatatgccattttctttgtgcctttgtttcaccatagaaattacatatatatttttgtttgatcacaatagattaagtcattgagtagctatccttggagctggctatgacctatgtaccgttcctgataatattttagaatatgaaatgctttaagtaagtagatgtgttgttaatttatttcatataatgcgcaaatttatagataacctagtatttgagattcctagttaccctattgttcgtgtactattcacaaagttgtgttataggattgacattccatactcattatgtgcttatataacaagaaagaaagtccatatgttccatttgattatatcttctcttatgtagtgagtgtagataagctgctgtggaaatttttttttaagcataggatgttttttaggactggatggaaattgctttatattaatgtttcaggctttggatatatggaactttttacatttacattctcgaattcatcgtacatgtcataaatttcaagctcatatatggaaatccatgctgcctgcctcaggtggaaacttttagatccctaaatttgaggtttctaaggaaaaactcagcctccacccaaccaaatttgtagtttcatatgatgataactaattatatccagaacctttataatcaactttagtcgttgcatatagtaatgttcctcttataatccttgcatcactttttccatcattgcattttctacttctcattgataccaattttctttacaccctatattgttgaatgaaaatgctatgccatctttttgtttactcatttgcatccttaactagtattgtttagctatattgcatttgttggcagttggcgcagtccttcattactttctcatccgtggaagtgcctcagtgattcttctcaagtatctcgttatttcacatgccattttcattttatatggtatactgtattaataattgatttggcaatgattttagagtattccagaaatcgtcttgtttttttggcacagctattgtttgtattttttttttatgtcacagtgttaaatttagatgatgtctcttgccttataatgtatttgaggactgatagtgttttcaattttcatttattcagctgaaatccaggttggttttaccttggaaaagccagtttcattccttgctgctcacatggataaactagggggtgacatatttgaagaaattggtattcctaatagcaaggtgcctgatgcctgtttcttttttactaattttgtttcctctgcatataccatttgttaatttaaaggttcataattttcactctggtccacttgtgaacctaggagtgaaaattagacccccccagggagacctgaggacctaaaatggacttctcttattgtttgaaacaggtttccattgtgtcaatgcgttctttgacctctaagtactccacaaatgtggtttttagtgttcttccttctccaaaagaagcctcaataagtttgcctgccctaagtgtgctgagatcatccttaatagcgatgatgctaaatcaggtgaacctatcgttgacagaaccactttttggccatccatcttccgttgagctgttgaggttccctggaggaattacagtaattcctgagcagtctgg

SEQ ID NO: 78010 - DNA, 16616 bp, Oryza sativa
ctcggactccaaaacatatgctgtttggaaattttttaaattttttaagtgtccttagtgctttaaaagctaatgtcgaaaaagaaaaccacattaaaaaaacctaaaattttctctaaaaattaagtttcaaaatttaaattttggccatggccaataatattattttgtttcacaatatacttatggactaggaaaaacaataaaataacgttacagtgaatatatctgcagaggcaaattcaaagtcattattttcatttgaaatgttgactgcacagatgccactacatcttaaaatatgtgcttctttccttgaaatggattccaactctttattcgacttctttctacgagtcattctgtttgttcacttccacttgcactataaaaagataattttgccaacaattgggatgggaaattataattttttttaagaatcagctgaaagtcttattgctgcccaatctgaaagtttcgaagctcaaacttgcgaaaagaaactgaaacatgatctggctgaaagagttgtaccacaaaacttgaaagagttgtaccacaaaattgaacgataacatgtgtgggctattgtacaccattgtgacaagcttggccgatgccttgtgtcgggctccgtcgtggtagtttaggttaggttagttgttagcatggtgttgtagctgtggttttcgttcagttttccctaattaactggaccctgtaaggtttggtctcgtttgcttcttaaaatgggacaccttcttcttaatataaaacgtcggcaacggccttaccattcgaaaaaaagacctggctgaaagagttgtaccacaaaactggtgaagaaagatgcactcagaaatatgccttggcattttccttactcaattaaatcatttaaatatgccccgattaatttatccacaagtatgaatttgtgtgcgtttcaacaggcattgaaagggcgcagataacttgtgccaaaaaaatatcctttgtctttttgaagggggatgagatcatgacatgtctttcccaccagcggcggagtcaggtattatcaaagagtagagttaaggtaggacttaattaactagtgagttattcattttttttatcacattctcatggtgatttaagagaatttaaccataattttggaggcaaatatagggcttgagccctagctaccctaagcctggcaacgcccccgtttctcacccaaaaaaagccatcggtgactgtacttacacaatgactttaaagcaggattactcacactgttttgatgatttggacactattatgtaaccctaatgttatgtacgtggtttaaatggggatggatatcatgaatacagaggaagatacaaagatataagggtgtggtatgctttctcattcattctattcttcacaagtgtacaaccccatcacctcctaccctctatttatctcattcacctcccatacttagcgatgaatcaatttattaagtaaccgggctgggtcttcgtgggtcaccggtttcctaccagaaaccatttagtctggccctcctttcacaagattatgtttcacccttcattgtcagttttattgacggactacaattcgttttcacgcatagaagtccctttctccatcaattgaaatggaaagttcaaattctttctatgaaatatagctgagatatggagtatatagcattgtaaaccaagtttagcaagtccttttaggttgcatttttgtaattttagcaaataaaaaaacagagagaaaaagtcaattcaatccaaatttgaactattctgagtatgatttattatttttgacttttcaccaagtactaattaataacgtctacattatggtggtgcactatttgcatgggacaatgaaaaaaaaacaatatcacccaaaggttacaatttgtatggagagaaaacaatatcacccagctactaatccgtattttgataatgaaatatggatacaaaatgttacaataagatcaagcagaggctttcagctctgccagttctccgattgggatagcagcaggagcaggagcaccaccagttgttggcctgtaaaattatacaatctcttagaaatcctacaaagaaatgttccccgtaagagaaaataccgtgcagaagttcagatagacttacaggccaaccataactttgaaagaatcatagatcacccactgagttccagtcagtgtaccgatcatgaggatgcgaagaggaaggccgcgggtgaaaaggccccagaggccaaggttcttgacagcctgaaaagaaataagaattcagcaaacgaacacaaaacaatcacacattggcaaaacgcatcaagtcaagtatagctcccggctgtgccgttctacagggtgcagacttacatctccaacggtggcgcccttggagttgttgagaaacgagaccaagttgtcagcagggtgcgagacggcggcgcagaagactccagcaatgtagccactcccgaagctgactccaagctgcagaggcttgctgcattgctccttcggtgtggggatgagatgcttgtatgccatctccacgatgttctcgtacgtcgcaaatttcatcatagtatctgcaacaaggaaatgccactcacagttcagatgttcatgaacgcaagagagctgatcgtgatcgtgacaaagcctgaatgttacagtaaagcagagtaggagtactcacaaggaatctgacgcccccaaagcggaaccaagcctctgaacagactgcaattaacaatcagctacaggtttaattaacattctactagatcagtcagaacaggataacaaagaactcatcataaaaaaatatacataccctgcatagctttcgttcctgacgatctttgggaagccgtcgctgagccccctggcgtagccgggctgcgtctgcacgcggaccttgacggcctccatggggcagagcgcgacgtcggcggccacctcggcggtggccgagccggcgaggtagatgagggtcttgtacctggcggcgtactccggcccggccatgtcggcgtactccttcttgaacacctcgtacaggccgtacttgaacgccccctgcgcgctgtagccgaggaacgtcggcgcccaccccctgtagaagccgcgcgcgccctgctcccgcatcacgacgccgaacgccgacgtcgtgctcttgtacttggtcgggtcgatctgcgagacgagcattcgtcgtgtcagactcagagatgagaaaaaacgggaaatcagcattttcgttggtgattgaaatggagtaagatggaattttaagattgatgggccgagaggtacaagagcccatcaggcctactagtcctgtttgacgaaaagttccccggaaagaaaaatgtttccagccaccgtcagtacgtcacgggtgacgagctcccggttcatcatgtttgtgagtctgtcacgctcctactttctcggcagctgacttggacccgaaactcccggtcaattaacacgaggaaaagtcttccaacaaaatcttcgagccatcgacaacgtagaacatagtagtaggttgctatgaacttgtttaatttactaccatattaccatatcataggcaacttttaatagtgtcgaatttttagacagcttatgagtgttattggcatattttgatactgaaccaaacattagacaacaaactattagagtgacaataatttgataaagcatattttggtatcaaatcaaaatgacctaaatattctgggacggatatagtagctaaattcacgaggtgctccgtttcgtaaaattttgcagaaactttaccaatatccgggcacgtcaaattaagaagcgcaaatctatccgatttttttttaactgatagctcatgtgtacctgtatgttgcatttgatgacgtcgagcggggtcacggcggcgtgggtgagcccgcacgcggcggccccgccgaaggcgcaggcggagtagtatgccggcgagaacagctcgatcatcccgaacggcggctcgctcggcgcccccgcgacgaccgccggcgcgcccccgccgccgccgccgaccccgtcgtagaggaagctcgggagcagcgagttgcgcggcgccatctctgtcgccacgacgctggcccctgtggtttcgtggtggttggatgactttgatcgccgcgtcgtctcgggccgggcggctttgtgttgtggacaccttgtggtgttcgttcgttcccctcgttgtttggagcttcgctgcccgcgcgcggccgtttttatacgggagaaactggaggaaaagcgattgtttggttggctcgtcggctgcgggctcgcgcgcgcgcgcgggtgcagtgtgccttcgcgcttggcggggtttgaccgcgtggtgtctttgggagcaaggtgatcgaagggagctggtcgtcacgtgccagcctgcctgcagtcaggtgatgtcaagtcctctggtttgggatttgggattaccttcctgagattggtgttaattttgaccctgtggtttattaggagaccgtgatctgttctcgtagtgaatttctcctcaacttgcgagttgcgacctgcgagggagatgttctggtctggatacgtcgactcgctgttttggacttcggagatgcattgcatgatggcggtctccatgtaggggtgggctaaaaaaagaccgaaccgaactaaccgagaccgataactttagtcataacgttgatctccatagtgtactaatcaattgggtcatgggtttcacttaaccgaaatacacttcaagaattaacccgaatacactccaagcccaacgaagaaattctaatttcctatccctcccaagtcccaatgaaccccacggcgcctcaatgccaccgcgccatgctcgcgcctcttcctcacaggcccgcgcctcctactcctcctccagtcctccactatggcctcccctcccctcatggttgtgttggctggttatctgatgaaattattgtgaataccatacactgagattttacacaccgactctgtttagggaacttatatctcttgatttttttttaactgtctaatgtctactgttcaaacaccttggaaaaaaaatcagtcaaatttaaacgaagaagattttaattcgtgcaccccctaaatctacgtcccttctcttctttctcaccgttacacttcaccgttgtccgtgcttgttgcccactgatgatccgacacctccacgaccttccctttcaaagccgcctcatgtctctaagttaaccaaaagactataaggagaacacaatgaggccgaccgagaaataggggaatacttcaaccgacacaagcagaccttgctccttgcctgagcatatcatacggactcctcacttcttcttcttcttttttctttttttttttttttgcgtggaaggtatgttaagttaaacgtgatttgtttgtatggacctaatttatctatcttctcttccttccttttttgcgtggaaggcatgttaacttaacgtgattttcctgtatggaccttaattatgttctctcttaatttatcggcaattcggcagagctatgaggccgtcattccctgtatcttcctattttgaaggccgcccgctcgcgcacaatgcatggcgtctattccaaaatccctttccctccacgacaccgcttccagcccacgcaaccctcgaacaatggcgagggctcgccggggacgacaaaacgccgccgcatcgccgccgtcgctggccctgcagctgcaggtggccagcctcgtcatcgtcttcgtcttcgccttctcctccgccatcacgcctacacgagctgatcatgtagaaggacgtaagtgcacttctcagctgcttcgatttcaatccccttcaccacgcacgcaggtaggagtacatagcaatcgccgatcgagcatgtcgtggcgtctggcgtttggacgacgatatgctgaaatcctagctccgttttttttaaaaatttttatccgtgtgcagacatgtcgcacgagatgtttggctacgaaaacgacgcgacggggccggcgaagtggggctcgctgcacaaggagtgggccgtctgcggcgacggcaagaagcagtcgccgatcgacatcaccacggtggagccgcagaaagtgaaggagccgctgatgcaagcctacaaggccggcgccaccaccattcagaaccgaggccacgactacatggttagacacagcgaaagcttgcatattactactccgtcccaaaataagttcagctgtggaaatccgtgtccaacgtttgattgtccgtcttatttgaaaaatttataagaaaattaaaataagttagtcacaaataaagtactatttatattttatcatctaataacaataaaaatattaatcgtaaaaaaaattcaaataagacgaacggtcaaaagtgagacataaacagtgcaaaactgcacttattttgggacagaaggaatactgtattattatttttagggaaacggtataggtacggtcagaaatttttcatatttgtgaaattaactactagctagtactccctccgtcccataatagatgacgtttttgactttttatttgcaacgtttgaccattcgtttttttgaaaaattagtgcaaatataaaaaaggataagtcatatgtaaagtatttttgataataaagaaaatgacaaataaaataaataataattttaaatttttttgaataagacgaatgatcaaacattgacaacaaaaactcaaaaagacaagtaatatgggacggaggtagtactatttagcagcaattctaatacgatgcatacagtaaaagataatcggaaacgatattatttttatggaaacggtattgggtaaacctgcaaatatgcaatgctgattgcaaaacctgcgtgatcttgtgtcttcatgtatccaacgttttggatttttggtctcagctgaaatggaaagatgggaatagcaagctgacggtccaagggaaggagtacacgctcaagcaggtgcactggcatgaaccctccgagcacacaatcaacggaaccaggtgcggatgcatgatcctggcaaaaactagctgcgcactttgttatcaaaataaaaggaattgtgaatcaattgagctgtagctagctggattaattagcggtggtgttgtatccaacaaatgtcagagtgtggtcggttcgaacaattaatgggattcatgcaggttcgacgcagagatgcacatggttcacgaggaccccagcatggcgagagccgtcgtctctgtgctgttgagcaccaaagcaggccaacccaacgcagtgctcaccgaggtagtaacaacgacgtgcctcaccgttcacctgaaatggttcgtttccatttcatctcccacggagaggccaagaaatggaaatgaacacatctagatgaattgtgaatactaactagaaagtacttgatgtcaaatagtgatctttagtactggtaagtggtactgtataacccaatatggtacatggaagattggaagtgctagctagcacggtagcacccatgtccccacaaatgcaaaatacgttcccacgaagtaatacgagaatatattttaaactctcgaatggatgttaaccgttatttcatgtagttcaaataattaaaaaaaattacaagattgattaatatataatatatcgctacataaatatgtatgttctttacaagttttttataaaaacacacacattgaactctagctactttacatatgttaacagccattttttattgtaacttatagaaattaaatttaaagtaacatgtttgtgaaccgatatatcgcatattaatttatccttttttaatatatatatatatatatatatatatatatatatatatatatatatttgaatgacatgcacgaaacaagaaggcattccttttatagtttacaatcatttctctagtaatatctgctatttttagtttattcaccagattattaaaatggattatatgctccacactttgaaaaatacatttaaaaaaattcctaatgcattgctcaaaccacttgctttaagatattagttaagtatatttcttaaaatatttaatttgttcctgcaatcaaatcaatgatccattgaataatctaaatctaaatcaaacaaaagtagtcatgcatccccactactataaacggcttatatatgctgcatatacatgcagatggcgccacatttcaagaaccttgctggtaaagagaaggccgaggaggaagtgaaggagcctgttgatccatcgacctgggtagataaaacctcaggctactacagatacgacggctccctcacaacaccgccttgcactgaaggagtgatctggacgatcatgagcaaggtatatgaaaacaatggactagatgattatgagctcatgttcttcgtttcctgtatggcatttcaccacaggaacagcaatgcatactagactaaatatgtaagcattagctgaactctctatgcttaattgtctaacagataggagatgcatcgaaggagcagattgacttgctcaagacagtggctacggtatgtacgtgctggaagagtgtgaatggctgaaaccataaataattgctctacactgtaaaattcctgacgtttatttgctaatgcagactgtggaaccaaatgcacggccagctcagaaactcaacgatcgaattgtgaggtactttgaagtttaatctaaagatgaattagggtgtgtttagttcctgaaaaaagttgaaagtttggggaaagttggaagtttggaaaaaaaaaattagaagtttatgtgtgtaggaaagttttagatgtgatgtgctgtgatgaaaagttgaaagtttggggtagttggtggtgaactaaacacggtcttaggattaaagagtgactaaagtgtgcatttactggtagacgatgcaacagaacaggtgagcattgtctaatgtctacagtatacagggtggccgacagaaaacgagaaatctagatgatcaccaaaaattactgacagatcgaactttgaaatttcaatttcaacattgaacagttctcatctaatgaccaattgtcttgactttagcatggtttgcaaaatcagtttctggattcatattgttttggtggttttgaccagttacaacccgtaacccaagaaacactataagattgaaccagctgcttgaaaaacattttgcatatttacctcacaagtcaccccaaaataaaactgcatccctaaaaccattgccattccaagttttttcactgggccggctactgagagccagcaaacctttttatgaaggagcaaacggtacaacaaggttgttgcatctactactgccaaaccactacagcaaacagcactacagcgccttgcatcagaagggcgcacagagctagcgccaccaggacagcgccacaagaaaacagagcactacgcgcagcatatgttccaagtttttatcaggtatcttaggacatcaagaggcagtagatagaccataataccataccagattgagtacagccttaagccattctgaccagaacatactaaatcccaatggcatattaacctcaaatgttgcttcaatttaactgctcggacacatccaatgaataactacgatcataacaatctaacactaaagctaaggcatcctctggaatgtactactagcatgttatagtttgctacagcgatgttgacctacagaagtacaaaatagacatgccaatgccatcacagaaatgtacgctaagagaacagagattaatagcacagttttcaaaattccaagcacaacaatcaaaattgttctaccaacaagctccagcatttgaactcaatcaggtaaacaacataatataagttactcgagaaggattgacacacatcctctattgaagtgacggtaaattgaaagaaaaaaactagttcttaaccaaatcaatttgatgaaagaatcacacggcatcttgttttattcaacccggactttcttgttgttcatgtatttgaacttacatatctcctcaaagaaatcatcagcggcatcatggcaattcttcatctgcgagattctgatgaccatagagcgcagcctcacgctatacttcacaagcgactcgagggtgttcagcttctgctcagcatttagtggtgagcgcactgtgatcaaaacctcttccaagcaagggatgcagaaccttgcatctaactgcattcacaattcacaaatattagccatctatcaataccttacataacaacctaaagttcaatgctatgccgcgaaagccaaaccaaacactcacattcttcaagctgtttttctggcacagagcagcaaacatggcaccatgaatatcaaacttgcggagattcgggtggctgttgaagaagtcgaccaaatcgacttccgggaatggctggagcgcgtcaaagtcgccactgaactcaattttcatcactaggtgcttcacatccctcgcacactgcagcacagagcttactgcagcccagctccactggacaccgcgtagagagaggtgctccagatctgggagcttcccggtgtccaccttgtacaccctccctacataatttcgtcgcaaagtaccacatcatgtcaacataatctaactacctcgcaacaacatgtcagcgtgattactgattaagaattcgctccccgcatcatttcatcgcaaaatagcatatcacatcaacataatcctaactacctcgcaacaacatgtcagcgcgattaagaattcgctccccgcatcatttcatcgcaaaatagcacatcacatcaatataatcctgactagtactctacctcacaacaatatgtcagcgtgatcaacaattcggggcggtgtgttgcgtacctgtgcttttggcgattgagaggcggcggaggctgtgaccaccgcgcagagtaatccaggtgaagccctggacctcgagtgactcgacgcggggagcggcgagcgagagggagcagttgccggctccgaggaagtcaagccggcatcgctcgagcagcgcgagttcgatggacaccgcgcccgagcagtcgcatccaagcagcgacaggtcggtgaggttggggcacgcggagatggcgtccttcacggcgctgtcctctagcggggcgccgacgatctccagcacgcggagcttgtccagccggccccacgccggcgcggccgtgagcgagaccccccagagcctgagctcctccaggcccctggccaggccaatgcagtccaggtacccgccgtcctccgccttatcggcggcggcggcgtccatccgcagctcgagcaccctgagcgaggtgctccgcagggccagccactcgggcaggcgggccatggagaaggggcagtagatgaccagctcccggagccgctcgacggacctcaccatccgcccgatggcgtcgtccgcggcgccccccgccgccgcggccgtgtcgaaggcgttcctcgggaagaagagcgccggcaggtacggcacgcactcgcgccagcggcggcacacgcaggcgcacgccgccacgtcgcggacgttgctgagcatcgacaggacgtgctgcacgacgccatccggcacggcgttcatgtccgtaccgcctccgccgccgccctccatgtgctcgacgaaacgcctcgccgctcgcgcctactcacagtcacagaagaagagacatgggggatcgggacggcgatggattggattagatagatcgggggcacgggggggtgtgggggcgcgtcggggaggatttgaaatttgaaacggcggaggtgggtggtgcggcggcgagcagcccgcccgctcggcagctcgtgggggagggaggggaaattttcgaaattgcagcgaccgtccgctcggattcgggaggttcaaatacgagtttgaaacgggagcaaagggtttgagggtttacccttttggggttggcggcggcggcgggcggctgtcgtggggaaatgggccgtgggcttggaccgattgtcaaggcttcgtgtccttcctgacaatgtctctcccatgggtttttcctctggttggtattgtagtgctcaattcccatggagtactttgtactttatagcgatggcacatcaacgtagtctaccacctaaacctaaagcacggttgctgaaacagtgaaaggggtttgtgctattcatcgtctggtttctcgatctctcaccagttttcctcgtaattggatatagctctccaataatgctagggcgatcatctgcggcaacggtaaagtgatggctcgacatcgttctaggtggtagataatagggtattgttgatatagccacgagcgagtgagctagatatggttacacccaggataaaggcgtgagaactatattgttaaaaaccgatggtgaatatggcggcatgaaacgtatgggaagctgagaggtgattttacactaacagatggaacaagtgcaggtggcgggaggttgaagaaacaagttggaccgtcagatttcaatccaacgatgagtcgaatcttcgttgtttgatcgatagtgggccccctcgagaaatatttctagtttctacttagatgaatcgttccttcttttggggtatgcgtttaaagaagggtatgcgtttgtttatagatataaagataacgtacagtataccctatttatcagtgtaataagtcgggaaagactattattaattgtagtagtgatgctgaagttaaaaaacataagggaaacattcctaattaattccacccgtcattagtatcaattaggaaactttgatcaattcctagggaattggcatcatattaattgttccaaatacgtggctagcattacgaagcccctttctctctcttttgttcgtggtttggctcttccatataggtgccaatactatttcttttttcactaatagtagtgtaatggatatatatcttgtgtgctcctatattttcatgagggtcaaattatgtaaattatcctttaaaattgcacatatactcatagttttttatttgatggtccatttttatttaccataacacaaatttagtaaaaattcaaagtttgctagctccgcccatgtaagaaaatttgtttgttatattttctccaaggaaattggaagtcctgtcattccaaaatataagtatttctaggtaaatagctagaaatgctcatattttataatagcgggggggggggggggggggcgggtattttcttggtctacgatgccagatttttttcctaatggggttcatgatttgaatttaaaaggcatagttagaaaaacagtgataaattaacatactagttcaaatatgataatatataaatagatctttcgctctctcggacaactagacactttgttataatataaattgtatacatgcatatattagtaagggtatatacttggttttttctttggggagaggggaggtgaaatcctacaataacatctcagacgttcatttttaaatcatatgatagtttttataattacattatatatgtgttttggactatatttttttctataaaattaggagttagatgttcaaatgaactcgtaaaattagttgatatccatgcatgttactggcaccttcttgttgggctgattttgtggcatagtagaaaatgttgggtggttgtgcactagtggaaaggagaaagagcaatcaagagccgtaggatggaatggacgatggatatagaataattgcacaccaccccaaagtcagatgatccggatccgaggtggtatggtacagatgtacccccaccatgaaccaagttgcattcgccaccctaaacatagttttctttttgtcaatttattttatgattttaacataatcattctaaactccagtaagtacttgcttggtcacttttgacatagaacatgaaatttgggctaaaaacctccactctgaaaactatattttatttatttcaaacatgtttttccatcgtatattatattgagtaatttgttatgaggatagctgaaaaaaattattgcattttacctagtggtgatcgattgtatagaaaattagtttattgttggctagagatattaattttatacttttaactcaaagtttgtctctaatctgccttcatcactgggtgtggtaccacaattagacacaaccaacatagaaatgaaagaaaagaaaagataattgagcatatgtgtaaaaagttatgtctctatttcttcttggaattgctctcctgcaactattttgttgagtgctatccacgatggattggacaatcatagcgacaagataaaaccgctagtgatggtgatgtttttccaaccaatggaacaaattccacctgtgataattcttcacgaatactactacagtactccatgatggttggtttcttccggaaggacgacagatttttgatggctcaccatttcaccaacatagtcttcttgaactatctactcatccatttttagttatttttatttctataaaggagtacttttatctaggtgtgtacacaagtggtcataggaagagcatgccattaaactgtcaatgataatgacacctagaaactgttccagtggaacgactaatcgtgatgaaacaaacaatcaatcacttattatttataggtaattagctcttctaattttaatgttgaaggttagttactcacaaatactttacttcgaaataacacgataagtgtgataacaaaataaaatgtgataacgacttatctgtataaaagatgaaaacaaactaagtagtacttcctccattccacattataagtcgctttgtacaaaaagtcaaagcgacttaaaatgtggaacggaggaagtagcagttatgtctagatacatagcaaaatggacctaccaaaaagtcaaagcgacttataacgtggaaagaatggagtagcatggaagagagtatctctatgttatttgtaatggtggtctcttacagctcatttgttacgtgattttcgttagggacataagtgggcaatttcattgccggcaaaaaaaaaaatccacttacaagtttattttcagatgatagtacaaaatttaaaagaaaaaaagtaaactagaattgggataagcgggaaaaaaacttgtttactcacctagcttgcatccttattttttacggaattgttgagctttcctaagtattttttagcttctatacattgtatatatagctgcatagttttctcttccctatgttctaaatatgcccttcatccatgtttataattaacaaaattggaggcttcattttttctttgaaaataccaaaaggtacttacacctatgtcatagtcgtatcatagtaaataaccattatctctagcacaagtgcacaacttaacttgctgtaaagacaatcaatcacacatccaaaatttccacatcatcacatacactccctaccacactccagctaactgattggaccaagcaaacaaatctaggccacctaatgacacagtccctgcataatcccactaaaatcagacataaccagggagctacccaacagcaggccaacacacacacagcaaaacacaaggtcagctcaccaaaaaagaaaaaaaaaacacagctgaatgcccaggttcaccaaccgaagcatcacattttttgtactactccataacaaattgacaagtgacctatctatccacatgtcctcacatgcacgggtttggttgcgaaagaggtggtgggatttcccgtcgcagttggtttagaaaaaagggcagcgtgagtgcgtgaggaacgccgatgcccaaacggacggtacaattacgaatataagagcaagtttaatagtacaactaactactggctccatatcatctatagtcaatttaatagtcaagtcatataatagtactaacatataaacatatactccatctgttaatatatggtctcatctatcatacatatatttcatcttgaagcctgtgctgtagctggctataaatctgtagcccgctgcttatctttttcttcttttatcttctcgacatgtgtttataactggcatatggtctgctattttactgctcaagtttttttttctggaagtataaatatttccgcgtagcacatggggttaagcgcgaagtgagaaaaaaaaaacagaaatgtcaaaatcccccgcatttttggccgcgatcgcgaagggcggccacgtcaaacgcgaaaaaacagaaggcgagtaaaaccaaaaaaacgctagccgtgacgacgaggacaccaccgcactcaaccaacagtcggcgcaccagcagctgaggttggaggaggaggagaaggcgccgcccctcaccgcacctcgcgcggcgcgggcgcaggcggttgcgagcgacggcctca

SEQ ID NO: 78011 - DNA, 3670 bp, Oryza sativa
taagcactgtaatcttttgcccactattttcttgtttgtttcacacatgcgaggaaacagtccctgactccctgttaacatgatctccaatgaataaggaagatagggttaactcatattataagattaacagcatcaagacaactaaaaaaatgcattccaaagaggaaaaaaccgaggatgctgaatattcagtttcttgagcttcatttgttttcttataagctgtaataaagttaatctatttttttatagaaaaataaatgaagttatgttgcatctaactcatattattgaaagtaaaatgcggttcaagttgcaaaagaactataggttacaagtcatggtagtcttgtatttggagtataggttatcaactaaactgttgggttgtcttcaatttttttagataatgtgggttgtcttcaattagacgggggaatccaattaacagcctcgactcgtatcctaacttgtctaagaactagcttcgcttcaaccaattctttcgtaccctcagctctactcatgttagctttggctatttcaagtgcctgttgagcttcttcctgatcaatgtcactacccagttccacatcattccctaaaatgatgatctcattattaactttctggcaaaactgctccacagaaccgccgttaaccattgatcattgaggaggcgattctcaagggacccatatctacagctgtgttaattggggggaggggggggtatggtttggtaatatggcaatttggccactactagtagataaaatgatttctttcacttcacaatcccaaatgattcgcttagtgcataaacatttaatttcatttcttcaatttgttctcctcttctaagtttatagctttcgtgctagcttcatcgatgttacccaccaaataaaaagcttgttcaggtagggcgtctaattccccggaaaggattagttgaaatcccataatagtttctgcaagaccaacatactttcccggagaaccagtaaaaacttctgccacaaaaaaacggttgtgataaagaagcgctcaatttttcgtgttcttgctacagttttatctacaagtttagtactattgattatcaaggatctcattatctttttcttttaatagttgtatctttcgctctccctcaactatagtgacaactgatggcagtcttgtgttctgctaacaagttcttttctatctgtgccgttcatactaatggtgcccctcattatttttaggcctcattcgcccgtcacatgtctaaccagggatttgatacatggattgtcgaagtgagaggttctggtctgagcatacgtgatcatgataattctgcttcatctccatcaggcgctttcgatgatatatctaatggcacattggctcttgataaatcaagcacattggaggttgcttcagttcaaagttctggtttctctggtattgattatgatgaccttggaatagttgcgttggatgacccacctttactgatggagatgactagtttctttgatcgaatttcaaaacttctggaagaggctagtttaaataaaaattttcatgagatcacagataagatttcggttctatctgaaatggtagaaagctctgccgttattggtccaatgagagaagaaagtctgcgtcttctgaagaactttcaagagcagattgactcatgggaacactttgtggcaactcagatgaatctaaattctgaatataattgggacttcgaccattacttggaggaggatatacctactgcggtgaggcgtcaccatccttttgtgagctataattgttgaatagttggcactgttgttatattcagtgagctaacagtgtaacagtgttttttaattattccatttgataatttcatcattagtgttataagattgtttttgtggaatatcgcttgacacacagttactacaggtggaatatattagacaacatagtagagtaaaagatgggaagctgcttgccattggacactcaatgggaggaattttgttatatgcaatgctgtcaaaatatggtgagacattacactgtattttgctgatgactgtttgcctgccctttactgttgctttttctatggaagtataattctactgctgctgctagaattggagccactattcaattatccaatgtaaagggaacattctagctgtaggcaatcaacaactactgcgcttgttttgctcagctttctggagttaacggtagattgttggacgtcttacaagttttacctttatatttattctagaaacacagtcaaattgttcatctgataagcaatatcatgatcgtttacagctcagcctactatctttcggttgtggatttttaaagtcacgacttattatttttcccttaatctcaaaggtttcgaaggagttccatcaaacttagcggctattgttactttggcttcctctgttgactacacgacatccaattcatcactgaagatgttactgccacttgtgagttcgtagtcgattgacagtttcaacttgataaagatgtttattacttttcatttttaaagtttttcttccttcattgtcatgaataaaactaatgagttcacttctcaggttcatcctgcgcaagcccttaatgtccctgctgttccattgggtacattattagcggcagcatatccctgggcatctggtccaccttatcttttttcctggcttaatcatcaaatatcagcacaggatatgatgcacccggagttgttgtccaagcttgtttttaacaacttctgtgagtactctttaattacacactgtcacactggattctgcatgtcatgcattttaagatttcagctttgccagaatgttactttaaagggtgttgccagaatattgttcaagaacacacagcactgtatatatgccatagtatccatatataggatttctgtactccagaattaattcataatacactgcattattaaccttttatgctatgatataaatatgggatgtctgtttcagcaacttttgtcaatggggttggatatgttcatttaagttgttatcatgtaatttgcaggtacagtgcctgcaaaggttgtccttcaacttacaacagcttttcgggaaggggggctatgcaatagaactgaaactttctcatacaaagatcatttgcgatattgtcagacccctgtcctagcactagctggagataaagatctcatctgtcctcctgaagccgtttatggtaagatgtggtgcttttcttgtctgctatctcagttgcttctatgaagattgctaactttttgtacatcatactcccatcttgtcagaaactgtcaagctcatacctcagcacatggtgaaatatggggtttttggaaagccagaaggccctcattatgcacactatgacttagttggaggtcgactggtacatattctcagtctcttcacataaaataaaatttgctgctccaattctgaaaagtcaaatctttttgtcatcctcttactcatgatttacacatgtttgtcccttgtacaggcaacggatgaagtttacccatgcatcatagagttcctttctcaccatgatcagtagtttatgtaacagtgaagctcctgaaatt

SEQ ID NO: 78012 - DNA, 7861 bp, Oryza sativa
ctctatacagtggtggtgtggagatggctctttcatggccatacccataacatgttatgacttcactatgtgtctggtcagatgcatctgtatgttctttggtttcccatactataatgatggcatacaggggcattctcctggtctgggttttcttgcgtggtacttagcaggcaaacttaaagcttttaaacgtgaagggcatattgcaaaactatgcctagtctttctgcctctacttgttgcatcacttgtggcagtctctcgggttgacgattactggcatcactggcaagatgtatttgcaggcggcattataggtctgtagtttcaacgcttctgtaccactttaaacattcttgctctcaagataagtacatgtaattcatctcattctctaccttattcaggtctcacagttgcttcgttttgttacctgcaatttttcccatatccatttgatgctgatggtacattcccctcctatatatcgatgatgatttagacgttgatcgacaacattttactaaagtgttatgtttctcttcatccgcagctatatggcctcatgctcacttccaactgctagccgagtcacgaagcaacggtaatgaaaactcacacaacatgggatggacagagaccgacgctttccatgaaggcgctggtgctgttgcgctgagagacacaagcctggttctagactcgatggagtctggcaggaggttttgaaacatgtgaaagggaagtatattgaagatgttcattgttctgtcttcatcagagttgaaactctgacgtgattagttaatgtggtatgtacagggtgaaactgaagtgcaggtagagtactatcattattcagagtatttggaactcactattgtttttattcacctttctgtaatgcagtatgccattgttttagtttatgcagaagcatgatatatatataaaaaggatttttgtagtttcttctgaagcacgatgatactgaataatagatttataaacagtaacgcactatcattctcaaacagctgaggttttcagggtgggtagcaactacaaattcagtatcacatcagaatgaggcaattgggtttgtgcttcatccattggcattccttgtgttgaacctgttttgtcgatgttgtcatctagaatttaccacgagtggttgattatcgtggcagatgagactaccattttagttctgacacttcatcatctaacagctcgtctgcctctgtaaacccttcctgaaccttgcgaagtgtataaatctaaacacaagagtcactgccatttgggaacttattacagctccaagttttccccacttttccagattttgttttgggaagcaaattgtttaacatttcacccaaatgtttttgctattagcaacaaaaattattgcaatttagcatgaaggctgagagaaatgaagcgttgacactaagcaatcatatcgatttgatgcacagaaatattcagaatctggtgcaagaagaacaaattcactacattttgttatgcctttttcctgtaatattaagcagtctacaaaagggtcaacaaattaatttagttggaaactgtacatgactggctgcaattgaggtagctagagtttgccatcaaaatacaaattacataaccagacacctacactagaaatctaaaaactgaatggatcacctgaaggcatccactacaaaaaaaggacccaagaagtgaggacaaaaactgaagaaaactaactcaaagcatttgctacttacaagaggtgaactaattatgtgatggatttgatttgcttgagggaactctcttcaagctctcaaacaccgccttcggagtcttctcgaaccttccaagcccgtccacacgtgtcgagcatgaacccgtgccatcgcattgcgacaacaaccttctactccttagaacagaaggttgttcatggggtgatgatgttgaagagttgcaaagaaggaagaagaggagaagcagagcagagaggatagccacagctggcttggcaaaggtagtactactcctcatggttcctttgagaaatggagaagaaagggagtttggaatattgtgtatggaccttggacaacatatttatagcatcaatctcattgatgtcatgtgaacttcatatgtgtgccttgaccatcaagtacacacaaagaaaattaatgtaccatatcaaggttggaaaaataatgaaatccacaataaagttattcctccttatatgattagctagaagttgggtactcattgagttgttaaatgtaaacacactttcagttaaagtgatggccttctggccctggtttttgtcaaaaggctgatctggttaacaatctttcctagtagtagtccacaggttaagtgagatcaaaagtgcattagagacaactagaagatagttgtaaagggtaatgtgacacttggggggaaggaagattaaagattaatctaaagcctaattgagaaaacctgcatcttagcagtagcagtctgcaggcatgcagaggaggagggagggaggcatgcttccacatgagaggtctgaacaacaaaacagcatggcaaattgtacccacatgcaatgcaatgagcaccagcgaggctggttagctcaccaacaccccccccccccccccggcgtgtcagcgcgtgcgccggcgggaggaagatctgaatgccgcgccgtgcacggactccgatgcacgtgacggcgtggaggaagaacatgcattgctttttctcaatttgctcgtagatttttggctgcagctgcctgcatcgtgacagctgattcagcatttcagcattgtgagtgtgatttgttttatgggaagacgaacggttgagcttgtgaagaaaatgtaatgccaaacctgaagaaatgtggggggtgaaaatgtttaagtttcattgcattttggttttgtatttctgttcattacattgatatggcgttggcttagagtagccgttctttttccttgaaaaaatcgatccctatcttaatgcctgtattgattcttttttttcttttgccgggatgaccgaaggaggtcatccaaatgttattaagatagagggaaaaaaaggttacaagaaagtttttcgctgtcgaggaaagatgtgcaccaaaacacacgccccgacaccacatgccaaccgcaccaacacaagctacagagaggagagccgaacaccgaaccggccgctgctatgcgaggccggtcgccaccgggcttgcaacaacaccacagagcagaaattccaaaaacaacgccttcatgaaggttgcgacgccaaaagacgctgtcgatgaaaaactttctttgcgacgccaaaagacgttgtcgatgaaaaactttcttgtatgattctttttttcgttctttcagcttttccaacctggttcatggaagatctagatccacatttttacttagttaaatgaagaagtgcagaacacctttggtatttgcatcaaggacgcacacagccatggagatctaggacacatcagcattgcaaatcttgtatggatcaagcagagctcaattagtgatgggatcacgaaattgttagttattcttcaaaggacaataacatagttggctggtcataagattccttatttgaccatgacatgcatcagcatcaccctacattcctactaaccattttcttcagtagcgacttagtgagtgatcacagtctaaacgcccctttttaggcctaaattagagaaaaaaaacatgtgttcctcatagaggcatatgacttgcatcacctgagtggaaattgcacaaatacatccatatgtcacatgccccatgcactggtttctaccctcaaaaagtagcttctctttttgcatgtgcagcctgtttacagatgaaactgctattgtcagtctgtgtattgtgctgttaacaaccattctgatttcattggtcaggggatctgtcattttgaaatctactctggattcacctgaagcttctgtagatggaattggattcaaaacaattgacttctgcaacattcagttttctgccctgccatctggtaaaaatttatcttctggtccaggttctggtcctgttgagattgtaattaattatgctcatataagaaggatataccattgccagcagtcagttatgtccagatccagatcagatcctaaaaagagatggtttgtgttattgttcatcttctgtggtcctcagatctgtcataggaaggaatattttctacatcttctacagatgttccagtccttcactgaaaagttcacttgtttgcatgtgaacataagttcagccataaactatcttcaattaaccctggtaaacgatatttcagaaattgtgacaatttatgaatgtaagaaaccaggataattctactgctccaagatttccaaaataatgtcagctactattttactacgtatggagaactctgtgaatccagtcaatttacatgcatattacagccacattttcatttgtgcatgtgcacaaaagcacatgaaaaatgctatttctccgtcacacagactataaccagtagacagaaaagcagccatgatgcatataatggcagaactctgagaatactaacatcatatacacaaattagtggaacaagggaaaaaaacatttttctggtatattagcagaaaaggaaactgcgagtcctgtgtgtttcctaagtagtttctgagataagacgaacttcatatagatcatcaccaccttttcctgtatcatcagaaacataaattgacaatggatgatatagacaaaccaagcttcaaaatctaatggagctaaagaaaaaataatacaactcaccaatttctgccttaatcccaggaccaaaaaaggatgtgaatttggcctgcgtgggaaaaatgtttgcaaggaatcagtaatgttaatatttaattctattttggatcataagcatgacgacagtatgtattgttctcgaacagctcgcccaagtacacagtacatcaaagaaatagtttatgggagctatctaggcacagaattttgtcatttttgagcatcaagttttgggttacactttcttctactgctaatttttgaacctcatcttttccacaacccaaagctgctaaaaattcatgtatttgtaacatgagattagtttagtatagagcttaagactagtacatgtatctagatctgaccacaaaggcataccacatgcatctcagtccacaatggaagccgtgctgtattatatttagaaattaggagaggggattcacctgtctcttctcaaaatcggatatctccaatgctttggcttcaaatacaagtactaaactgtacttcccatcatcagttacctacaaggggaaaactactgagtcctttaaccaagaatcgcacccagtgaacaagacattctttctgtaacccacgaagatgttttttggggtaaaactggagatatcaataaacaaatataacccattggaatctccacaaggcatttggacagtttcaaagattgtctgaattatttttgtgcaattccttcatcatgagttcagccaaaagctatatcatttacacttgaggaatatcagatgaagaacaactaggaaacattaacatataactgggccatgttcattaactgggtaaagtagaatcaactacagggcctaaggcttgtctcgaagagaaaagaaggggccgagccctctaaggcctagtactaccttgtccaatgaacaaaagttgacaataatttcaataaaaataaaatcaagccaaaggatctttggcaccactcttaccaacattggctgtgcctttgccctgagatcagtgctaacagtgtactaattgaagccattaaacaaaggaaacaatgaccaaggaaaactacggagatctagaaatagcatttgatgctagctgaaaaatctgctattaatttgacttaatatcatttgagttcatctgtcatgactttaatgatgatacaatcgattgggacaaaacttccattagaaatggagggatgcaggatttttagatgcatggtggacacagaaacatcaatgaggaattatttcccacaagaaaaatacatatttatgatattcatatttaaatttcctgcctccttttcatgtatctatagttcaagaacaccacaaattggccattatgtaacaagttgacatttgacatgctaatcactgcactaatccttttagtagtctggttagagtaaaagggtctaggccattaaaaatcgctactttgcccatttatattcttttacaggcaaatattttgaatcatcaactttgcttgatgttactgtaggaattgtttcagtaacatcctacagtccacattgaagtaacaggtgccaaatgccaattcacatgcggcagatattgtgtgaacaatttggaccggtcttggatggcatgttaagtaaatcatccttacaggattagttgggtttgtttgatatcagcttcagataaatctgaagctcacccaagcagggtctaaagtggcttcttttaaacttgatggaccaaagtaaccttttgtgaaacttgaggggtccattttgtaattaaactcttccaacgagtatgaaatataaactatgaaaatgatatgtgtgatttacattatgcaatattttggaaagactacttcacagaaaaaaataaatgtattgggaacttacttcttcccgaatgttttgtaaaataggtgcactacgccttggaattccaccaccctgtcagttggattgtgcaaaaggaaggcagatcaataagtaggataaagcaaggaagttcttgccttgcaaaacttctaataacagaacatggaattattgataaaaaatagatgagccaaaacaatgtccagttagtaaaaaagggcaaaaaaaggaattaccaaaccatattgaaagatcctcttcagtgcttcatccaggtgctgctcatcaccgtatctgtaacgtgtaacatcactcctgacctagaggtaagtaaagctggaagatcaatactattgccggtgttatctttccaaaatccacaaattcgctaatgtctactcacgcctcttcctacaattttcaacacttaaatcccccctggcaccaatggtaagaaatccactaagaggattgtactcatcatgtagccttatttttctccaaataagaagaaaacagattataaacagctcaagtacaccatgaataaatagttaaatttgagcagtggaagtggagcatatgtcctagataatggaaattgaatagtacctgattgaggataggggtagcacacttttctcttagagcaaaagcatcggcgtaggttgtgcaaggcaccggtttcagttcagcatactgcatgtagaaaaatttaagaatcagtgcacactgcaacaaagaagctgacaaccttcaacctaaactccaaactaaggacagctgctcatctgaaactccaacacagtaaactgcattctattgctgcagagttattttcaagtatgtaatatgaaggtgcaaactcaatgaaaggccaatgactgctaattgccaaaaggcaccttcctgaggaaggtcttaagttgaccagtatggtcaaacaatctaaacaaatacaattgatatgtctcaacatgtcatatgcctcattgcctctcctcttgtacatgtcacatgggggatagttcttgccttcaatgccatgccgatgatggtgagtggaaagccatat

SEQ ID NO: 78013 - DNA, 3117 bp, Oryza sativa
gtaggtcattcaacagtggcagaaaagataggaaatattacatccgtcaccaagaccaagtagcatatacacttcctaaaaggcgttgcacccagcgtcaaaatatgtgccaagtgcaccgggtgatttatgaaaaaaaaatgaattttccattcggacatggcaggcatcacctgaagcatgttcaagctagaaacaatataaccagggcaactgtgcacgcatgtcatcatgcccatttttgcaacagcacacgacactataactgtagctaccatcatcctcacctttgagcttgccatcacctcttgcatctcccactcaggtgctttctcacttagtttgtcacctccaagctctagccatctaagtatctagtcgttcctaaactataatcgaggaaaaaaaatgtatttgttcaaggaaaattttgcagtatttgcttatgctgattcttctcatcatgcttaaaaagaagaattggaacatagaaatatgtggctttcatggtgttgacctaaagccactaatatcttgcttgatagcacccttcaaaaacattcttctcttcaagacaaatagtcaataaatttaaggatctaaaaactattgaaggtcaagatcctactatacttatgccttttttaacagaacctcatggatgtatgttgataatgtgataggcctatgaaagtatgtaactctgtatgtaacacatcactttttgtaattgtgttcaagaaaaataactttgtagttggatatatgcaactaatgtttactttgaaaagacaataagttccagatttttcaacagagttagatgtattgcccccactccccagtatacatcatgcctgtcaatgccatatccatccaacttggcatatggcaaccaaattgaccctcaacttacaatttgcaggaaaattccaaacaagagtagtttcagcaaacaccatcgctctctccccatcccaaatcactccaaaaacttgagccatgcatttacatgattccaagactctggccaccacttcctaccatctcagtgtttagtttcaggcgaggaaattctacatcagcagaaaaagagttgcagtgagagaaatctctgctcaccccgggggagagatcgaacccgatggcgttcgtcccgactcccgacagaagcatcagcgggtggttcctcgccggcgcctgcacgaacacgggcgagatcaaatcaaatcaagcacggctctggaaattggaaaacaacgggaagaagcaccaccggtcgtacatgaggcggcggcctgtaccgccagagcgcgagacgccacccggcgccggagacgggcgcgtggtggagctcgtcggcggtgcagacgggcggcttcgccggccgcgagggggccgccgcggagaggtggatcgggggcggcgcgtcggcgcggatcgcgcagaggacgcggcggcggaggcgagcggtaggaggaggggagagtccctcggcggagctccggcgagcgccggcgccggcgccggagatgggctggagaagcatcggagttgccgttttgggcattttttggttttatttgaaataaatttttgggtcgttataaacggcgctctttctgcgcttctttcagccatcaacctggcataaacactttaaacagtctgttagcattaattatatactactagtggtagttgcaattttggtaatgtcggaaaaaaatcagtttacttccaaaaaaaatacactttatgtagaatttggagttaacaccttaacctttgcaattaaggtgacacatgatgtacgtgccttatggtttataatattgcaccgttatctttcagtttccacggtaacattatacggtaactctatcatttttttcgtgctaaccatgataatatcgggaaacggtaacccctaccggaacagtaacggaaaacttagtattaggtgtagcccatagccattcaatcaaaatacgagatttaaactgtttgtcgcaacaaaagtatcgtggtttaaaacatactagtatattgtatacttcggtacatagacgatctcaactcccaaggtaagaaaaaaaaaagaagttttcttgttgtgtatatgcgacacctattgtgttaattgaaaagatatatatcgtcccccgcaaaaaaaaaaaagaaaagaaaagatatatatatcgcccattttatattaaattttaaaagctttagtattagcatctttttagtatgatatatgccaatcacatgtcagattatatcacattataattttattggggtaaaataatttaaaataaaactagtgaataaaataattttaaagactatataaacatcaaaaatgtcaaatttttaaattggatggagaattaagacataaaaacagcggctctttttgagttattgaattggagaaaaaaaatagcaaccattttatatattgtgtcactaagagtaccttgtttcgttagaatggatataagggcatgttcaactattgagaccgattcaggcttataagttatccacgtcacacaagatctcttagtgctctctagtcatctcttgcaacttgttgtagtttaccaacgttgcattgtatattatgtctacaatatatgacggaagtcacttatcctctttcctcatcctcatgcataataagatagtaaagcctcgtagggctccgtttttgtccttttttgaaattttttttctcctcgatagttgtggtatgtggtttgcagatgcagaagctcctcgattgggtgagcagtggagccgttccttctttctttgtccggtttccctcactggttgtgccggtctcacgctgcatgcgcgccacgcacttccttatcattttttttatcctgagagtaaatgacgtgtgatggtgtttatgcaaaaaaagctcctcttgtttgaacggaatagcacgcacatcctcccaccgaccgacaccctattccattttatacgaaaaaccactcgtctttcagaaaaaatacaacacgaagaagggaaaattctgcctacatggatagcgctgttaaaacgaaaaacacaagggtttttcccaaaaacaac

SEQ ID NO: 78014 - DNA, 5855 bp, Oryza sativa
cgcaacagcaccagcgccttcatggaaagcgtcggtctctgtccatcccatgttgtgtgagttttcattaccgttgcttcgtgactcggctagcagttggaagtgagcatgaggccatatagctgcggatgaagagaaacataacactttagtaaaatgttgtcgatcaacgtctaaatcatcatcgatatataggaggggaatgtaccatcagcatcaaatggatatgggaaaaattgcaggtaacaaaacgaagcaactgtgagacctgaataaggtagagaatgagatgaattacatgtacttatcttgagagcaagaatgtttaaagtggtacagaagcgttgaaactacagacctataatgccgcctgcaaatacatcttgccagtgatgccagtaatcgtcaacccgagagactgccacaagtgatgcaacaagtagaggcagaaagactaggcatagttttgcaatatgcccttcacgtttaaaagctttaagtttgcctgctaagtaccacgcaagaaaacccagaccagcaaaagcccctaaagtaatgaagaaagtatcgaaacagatacatcagattatctaccaacacatagggaaggataacatgttatgggtatggccatgaaatagcaatctccaaaccattactttatagagaacaaactgctgatatggggatgcatgatagaacaaaaaaaccaaaatacaaacaatttggaagaaaacaagaatgagattaaaaaaattaatctgctggctcctggcacctgaactcgcaaatacaacctatatgcattaagagatgcattcaaatacaatttcaattgttaaaaaaaaaaaaactaactgctcaatagcatgggatttaaactagtagagaaacagttcatagttaaaccttcttcccagctttcctacatagttcccaggaagccaggagcacatatatacatgagatattaatattgcaagagcagtatcaaataatgctcaggtataaaacctgaaacaaccactagactaaacagcagtgatgcaaaataaccattggagaaaatccgtggaaacgtacatgatgtagagagtgtgggataaactgatgtaaataaatgcatgtcacaactcacaagtactcaaaaataatgaggagcaccacaaaaacataaggcataaatcataatgaaatttgaaccaatgagaaaattacttacagttaagttacaacttcaaaaaaaaaaaacctaaagcataagacatcatatctagagtacaactgtgcactgtttattacctgaagaatgcccacttgggaagctcttgtagccttccttgatgacactcctttctccatggcatatgacatcaccagtgacattattgaaattctacaaaaacaaaaataattgattacttttaataaggtaaaggatgtttaccttgtttctgtacaatttgcttaatctatggcacaaaaaataattctttaagcaagtaaatcatagaagtaaatggaatccctgtacaggtcatattaatctgcatgtccttaacataaaaggttttattttccataacttctgtaaaaaaaaaagaaataaacagaactaaaccaagtacatgtcgataggaatgaaattgcttaaggagagaaatcagaatttacaaaaggatattacaggctttccatcagggaaacaacgccaaaagaaatctgggcgtgggcgaccaacaccattcttaattgcatcagtaatcacagcagttataagcaccgaatatagaatccctgtacaaagtgtccagttcagcatgaactaaaaaagtgaaagtgtaatttgatagatatctacatatgagagtaccatatacccagaatgccatggtgcaaatcatagacatttttctttttgaagtaaattccaccaaagatggcccagggcagcacaattgcaatcagctggaaatcaagaaaaaccaaacttcctcagagacatgtcatgcaccacagacaagtcaatagatgatcttataagaaaattaaatctcacaaagcaagaacatactggaacagcccaaaatggaactgtattgcccttcagtggatatctcaagtctgtcagcatgtcacttccaacgaagcggtgaaaaggctcaattatgttgaacagcccataaacaacagctagaaagataagtatcatccaatcatacaaatggaattttgccactttaatgccatgagatcctatagtatggcaccctaactgggtatcagccattatcccctaaaattgaaaataaacagaaatgagttcatagtcagagaaggaaaattgtaaataacatgaaggtgatggatgtaatccagtggtgttaggaacatggaaatgaataaggaacaacaaaggatgtcatgatagatcataatcataaatgtgttccgagttgctattttctgtcttgacaaagcaataaaacttttcagttggggttctccagaatatatagaacgtagatgctgtttgatcaaaagtataaagtattgaaaaaaaatgaaaactacatgtttgcagcaatcagaaaacagttaatgaaattgcagtatagggtggaaaaaagtggcatcagaactcatgtaaattctaacgtataactgtatttacaaaaggcatacaccacacaagtgagatcatcttattctgtgggatccaatttacttggcacttcgaagggcatgtactatttgaaaattcagaataatacaaacaatttacgatatcgatagcctacaaaaggtagaagttccaaggctgtggtcaaacacttcaatgtagccagcaattcacaataatcacccatttcagtagcaacaattcattcaatctaagctgaagtcctgaaccagccacctgattgagtactgaagtatgagtgttttattgataagattatactcatggcccgatattaaaatttcatcactgtcatgtggccactttggactttgcttggaaacaatattcatgcaatccctgagtccagtatttacagagtatgaagtattcagtatgacaatacttaacatgacaattaatattcaaactttcaccatcagtaattttttaaattgtttgattataattcgtttggttgtacttgttgttaaacttccataatactaatagagttgaccaccccacataagtccaaacctcatatcactaaaaaatgataacagatctaaacaaaagccttatcatgttattaataaaacaaaagtaacaacataatgaagtacaaactacccctaaagcaccttaacaatctttggaaagggaaaaactaagaaaaaaaatctcaaattatcgagaactccacacggagagcacaacaggttctttctaatgaatttcacaggaagaaaagaataactgacaggctcactgccccgctggcgagataccaatggctcctcctcctccagctcgcaccgacgagatatgttacagttctgccagataaagaaaaataaaatcaagaagtaaagaacacggtcacccccccaacccaagtggtcggcaggagaatctaatctgagaatccatacatgaaatagattggaaatgagaatgtaaaaaagaagaagaaaatgcgtgctgcagactgcacagggtgctcacctgggatctcggcgccggagtcgcccgcagcgtcgcattccccggcttgccgcgcggccgcgaaagcgaatggatggatggagacgatgctgagtagcagcaggagtgcaggagagaggaggcaacgcggaagcagcatcccgcagcagaagatgaggggagaaaagtccttctcttctctgatggacacgtgtccaccgcgaatctgataaaagccattctctcttcttaaaaggccttctttggacaggacttctagtcgggagtggatttttttaaaaagttcgatataaatattatctccgtcccaaaataagtgcagccgtagatatctgtgcccaacgtttgaccgtccgtcttatttaaaaaatttgtgaaaaaattaaaaatatttagtcacacataaagtactattcatgttttatcatctaatagcaataaaaatactaatcataaaaaaatttcaaataagacgaacgatcaaacgttgaacgtgaatagtgcaaaactgcacttattttgggacggagggagtagttgtgaagaattacgaaaaatattgaaaatgttgagattcgtgatatctatctgaaatcaagtttaaattcgactaacacatcgagaaacaaaaatgacaaatttagatgtaaatagtacgttactattcctgcgctaaatttgtcctttttatatctcaacgtgtgatttgagtttggacctaattttttcagaatttttcataaccatttgaattttttttaacaaaacaaggaggtatcccctcgagggatcgaaatagtttccccttccaatctaatggattcgctggtactaagagtgaagaagatcctaagcaataggagtaaggcttattcggttttaataatttttatagggttatagtataatttaaatcttagaatttttttcatatatgcatcatttgttttataggaatagatcgtatcgaatttcggtagtcttaaaacaactttagccgtgttctttagtgggagttggcaactcaaacatataaaataaagctgttcattagtgtgtaattaattaagtatcagttttttttaaaaaaaaatcgatctatatgattttataaagcaacttttgtatagaaatttttttaaaaaaatcacaccgttgagcagtttagaaagcgtgtggacagttaacgagagagatgagttgggaaagctaaccaaagacctcagtcttgcacttcaaaagttttgtaacaaatactccctccgtcctaaaaacctaggttggatgtgattccacttagaacaacgaatctagataaaaggttatccaaattcgtcgtcctaggtaaaatcacgtccccacctaggttagcattttttgggacggagattttacctccccacctaggttagcattatttcggacggagggagtaacattttttgggacggagggagtatagtgcatatggcattataattctttactttttctatttctatgatttggaaatcctatgatggctcaattttcttcctcgtataactactacattgttatggaaatgtggaagtcaggtatcacattctcagatttcaaggaaaccaatatgctcatgtaaaaatcaagacaaattgaccctccaaaccgcacctcatttgttctgtttgtaaccaatatcttgcttcaatacaaacaataactatgagcagccttcaaaaacaaaacaaaaaataactatgagcatttacacaacggagcaactaaaactgcaataaactggatcagacaaatcagcaacatttgtaatttacattgggaccaatttcagcacaaccagagcgtaggataggtacatcagcagggtaacaaagaggactgtggaatatgattaagagtgcaaactcccactgtaatttacagccaacacccacaacgagtttaagtcagcatataacggccagcaccgagttgcaaggaactctcaatgatgagacgatcacctgagatgacaagcacaattctacctggcaaaactctacctattcttgcgcaatgtacatggaaatgggggaaccgtacgaactactcatgttgtaaaacttaaaactcagaaaggccgaagaatccacacaacattaagatacttggtcgcctcatgttt

SEQ ID NO: 78015 - DNA, 1837 bp, Oryza sativa
gcacaatcgttccatcataaaaaatcactaatcagtgatttcctagataccgcgataaccgagcggttactaataaaacccgagtagattaggacgaattctgtaaaaatctgaatttttatttttttttatttagctgatttacagatcgatttctaaatacaactggttcgataagggagactgataaccacaacaatcaagcggctgtcgatcgtcgcattttgaattatacaactatagctgacaccacaacatcgcactttcaattatacaactggatttgtgtgtggtgatccggcgtggcaaaaagattcctcaactcgtagcacattctttctgcttaatcctaggaaatcaaccagtaatctaagctaaaatcaatgtaccaaagtgggtactagccatgcagccagtggcaatgttcccttgcatttctttttcgattacacgataagcacacacattacagtatactcacacacccgtgaagcgtgaatgtgcccccctaacacatgctccagcgagacatatatctgatcccgtattacaatcctgttaaaagttcacctatacatgtataatattcgtagtcactacgatttaaactctagtgagtgaagccatgcacccacgattccaccaccgcacagccaatgcttcctcggttcccttgcatattgtcaccgctcaaatcactcaccaagatcgaagtgctttatttgtactacaaaattaacggtgtgtttagttcacgttaaaattggaagtttggttgaaattagaacgatgtgacggaaaagttgaaagtttatgtgtgtaggaaagttttgatgtgatggaaaagttgaaagtttgaaaaagaaaagtttggaactaaacacgatgtaaaggcatgtttttcctctctacaaaagtatatgtggtgaaaaagaagaacaaaagaaagaaagaaaggaagaaaggtgaaaagaaggttggatgtcctctctcaccggcctacatatgttgttgctgttgtttgtttctgtgtagcgtgtgctttccatcataccctgccaactggcttatgcatcgtctgctctcttcttttctgacgtcgacccatgctcaaagccatcgattgcatatgtgtgtacgtactgatgacaattgacactgcagtagttgtgatgtgcgggacctcaattttaaatcacgtgatccaaattcaaacgcgtctttgtgcggtggtttcttttgcgacattgttaacctcggatttcgacaacagatcgagcatcaatagatggatacgtcaaagtgaaagatgttgagttagaaatcaaagtataaattatgtattatttccctagagtacaagtttgaaaaacacgccgtcatcgcttcgcttattttgattataagttgtactccctccgtccctaatataagagattttgagttttttttgtttgaactctttcaccactcgtctgattcaaaaaatttgtgcaaatattaaaaacgaaaagttgtgcttaaagtactttaaataataaattaagtcaaaaaaataaataataattccaaaaaaattgaacaagacgagtggtcaaacagttcaaataaaaactaaaaatcccttaggtagtgtttggttgcaaggatgggatgggatgggatgggatgaacccacttttagaggtgtttggttgagaggtgagtgggatgggatggtccctggagaggaatattcctctcagatccgggatgagatggtccgccaaaatcggacggaccaatccatcccacttcgacggacaaaacggggtcaactcccgcacgcagcctcccc

SEQ ID NO: 78016 - DNA, 3659 bp, Oryza sativa
taacagtgtctaatatggaggagagagtgaagcaaatgcgcataaacagctcacaagagtgaaaatggctcagacacggctctaacacatttgttttcatttttctttaatcggaaatgaaaactggaaaggaatttcactataaaaaatcatctttgtaggtgcccctttttatttttagaggcggtctaaaaagtctcgcttgtgaaaatgtatggagaggtccctgatcaaggcccacctggtagttttcggtcgaacgcataaaaaaaagagggcagtcttttacaccgtcaccaacaaaaatcgattttagcttgcccactgctaaaatagattttcgctaacggtttgctgcccgcatgtaaaaatacattattttcaccgacttgaagtcacaggcattgctggccacttgtaaaatcatgttttgctcattcgtgattggctttttctaagtagtgattaattgtccaatagaggtacagatcgagtgaatatgagcggaagggacatgtactgattcttcattttgtactccatattttaatgtaatgacaccgttgactttttgtctaacgtttgatcattcgtcttattaaaaaaattatgtaattatcatttattttattgtgacttgattcatcatcaaatgttttttaagcacgacataaatattttcatatttacacaaaaaatttgaataaaacgaatggtcaaatgttgataaaaagtcaatggcgtcatacaaaatatgagaggaagggacaaacattgactctcaactaaaggattgtagtacaataggcatctatggtaagaatccatgggccatttgagaagggaatacttttaggtgaattatattgtaggacaattcggttgcgggaaataaatattgaggtcgtttagcttaaacgaaggagatacgtataacgtgtccatcagtaatgctcctctgtaacaactgagtataagacttttgcaggaattagttcaccttccacataaattctccattcaaaggagacattactccctcggttctatacagatgttttgagttatcataagtcaattatttttaagtttaattaaatttataaaaaatatagtaatattattaataaaaaagtactccattagttctaaaatgaagttatttctaccactggagtattatgctaaaatagagctatttttcacctatcctctcatatcaactaatcagaatcattttttatttaattttattacatattttctcttctcaaccaatcacagtctttcccaaatcatttacatctactttcttatattattcatacccaactctataactgtttacattctggacttgtaaaatatacagaatttctaaatggccattgacaacaaaattgggatcaaaatctttcaaatttttaacctcaggacatgtgtcatgattcatactccagcgaccccttctgtgtccctggcgaagttccagcaatcagaaacggcacaatgagttagggtttaagatcttggtttagggttgggttgggggaaagggaaaggggagggggggtcaagaggcttagagggatggccgtgggaggcggcaacccgttgtagtgggggacatgagcaggcgggtttagtgctgcagtaaaccgaagtttgtagttaggaggtgacagtcggtgatggcggatcggtagtggggagcccaaaaggagataagatggcgggccatgagcacttgctgtcatcacctgcttaggaaagagaagtgcgagggaaggaggctagccatgggtgcatcgctgacgccattgacaactttaggccagctggcgaggctatgcggcggcgcaggcatcgcacgctaggaacgacgagagaggagaggagatgggtcacagctagaagtgtagtgcacgaatctcaaagcgataaaatggtccaaaatttacaagattcagcttttctatcaaaataccatatagtcattccctaaaatatactatatttaatgatgaagttgatgggattaattttgtgttacagatgttggtatgtttttttttgtaagttgcacattggtctacctatggttaccaaggtttcaccttggagaaccccctcaacaaagttttcgcttgggctagatataattaccttttgttgccctttggatcacatgtgcccttcatctcccactttttctttttcccatgcaaatctctggttgacggacaatatcttgactgatcctaacttggtgttggaggtatgtgcatcccatctcaatgaaggtgagggtgaggtaacaggatctgctcatcagtgggagtatatagaagccacggtggaagtcttccgccagcgacctctatggaggttcttcaggcttctagatgtaactagccaacccctgtgctccacccatggtttcaatgtagaatcaaattggtgttggggaatgttagggatgagaaaaactagagtgaaaaagagaaggatgaagaagtaggggtagcccaaattgcgaaagataaagtaactttagctagcccaaattaaaacctcgttaaagggataattcaagatgaaacattataatgtgaaatttactctttttctctataaacgttatctatctatctatctattatcttctattatatactaaaagtccattaaacttcctacaaacgctcctaagtcgccatgtgaaatcttataaacgctcctaagccgccacatggcactctaaaaaataaccgttgattttcattaaatttggttgacccattatttataaccattagatttattttttttttaaaaaaaaatcatatcctaaactcggccccaacaggcattacatacgtgcgttgtaagttacgtacgtattccccccttccttcgattccctatttctattttctattaattatttctcctatttttatgctttatttgttaaaaaaattaagtaactacgatatgtaaatcatataattgtttttttatccatcgatatcttttgattgtttacgaccaaattcacggttaaagactaaatttcactataattaaaagttgaaaagaaatatgttacatttcagctatattttttgacttttgcatgcatttcaaaaaattagaataaataataataataataataataataataataataataataataataataataataaggaaaaagtataaattaccccctgaactatcgtggtcgtccgaattacccccctaaaccacaaaaccggacatttcttcacccccaactatgcaaaccggacgaattacccccctcgacccaatccgcggtggttttggtctacgtggcatacgtgtggcagcccagtcagcattttatttttttttttaaatgtgggacccacctgtcatagactcatagtctttcgtctctctcactcatcctctctctcgcgcgcaggacaagcggcagcggcagcgcacacggcgggcggctgcccgggtcaagcgggagcggcggcgcccaccgtgggaggcggcccgggacggccggtgggcaggggcgggcgggcgggcggtcggagcgaacggcgcggaccggggcgctcatggcagtgcgatgaccggcgggggcaggtggg

SEQ ID NO: 78017 - DNA, 2580 bp, Oryza sativa
atgtctagcggcatggaggagctgagctagtagtacacacatgcagcatctgcaggttcgtcggtgtcgacggaggcgacgactgcggggatggtggccgcgagggccgtgcaggagttgtggaacggttcggacaccgagcagaagaggacatacccaccggttctgctcgccggagagggaggggacaacgactgcggtgtccatcactggctgcgcttgccactaccatcgctggtctcgtggaagagaggagaggggagaaagaggaagaagaaggaaagaagggcaatttgataaaaacaattattgtaaatgcatctcagtggcatatctcgaatatgtgtaaaattataatggtatgatccaaatacacgaatactgatggcatatttcgaaaccggcatatttttaattccatgtatctaattaatcctattttattcgatcttacaaaatattcctcttcccaccctgaacactacctccaacgacttataattcagatctaaccgtacactgttgtgctcaaatctgttctactagttgctaaaattaatatgcaaggcaagttgatcgatcaatatatccatcgtgcttcattgtatagcaacgagggcaaatggactataataaggtacaaacatgcacggttactaatttgcattgctccgatattcatcgcaaacattgactatctcctctatatttgtgtataatttttcttccttgtgttcccccccaaaaaaaattatatcttcctttgtttgtattgttcatcaaattaacttggatcaagaactcgatgtatcatcggctagaaatgcatgtgcaaaatggacagatatattcagaggctacattcaattaatactgttaattagcacgagaaagaaaaacaaaaaaactaggaaagagtggacaagagatgaaagaagaagctaggcatggccaagctgtatggtctattttggttagaccagaatctacagggctcccagaaacctgtctcctctttcatgctagctagctctccgtgacaaatctacagacatgccatgtcacatactttcacagtgaacccataaaaaactaacctaatacgatatgatacatcctaatattacgaatctagatataactctatttagattcattatactagaatgtgtcacattcagttttagattcgtctttttaggatggagaaagtatgtctatatctagatttatacagttcgacttttttttgtagaaggggtgcaaggaataagggtagatagatcggaaaacattcatggccatttgggttggattaatgattcaggagagaaataggcaggggtaagagaaacacatcattataaattagtcaggtgctatataggtccctccgttttaaaatgtttgacaccgttgactttttagcatatgtttgaccgttcgtcttattagaaaatttatgaaatatgtaaaattatatgtgtacataaaagtatatttaacaataaatcaaatgatatgaaaagaataaataattacttaaattttttgaataagacgaatggtcaaacacgtacttaaaagtcaactgtatcaaatatgttgaaacggagggagtatcatggagataaatatgtagggaatggcctcttaaagagaagggtctaggttaactgtattaaaaaaacagagaaaaataactgattggtcgtaactttggatggacagatttgttaatcgagaagaactcgacattggtcttgtttggatcctccggactattaaatagctctccggaatcttgctatttaggattattaaacgtagattatcgacaaaaccgatttcataacccctagcctattttgcgagacaaatctaatgatgtatattaatccataattagcggctgattactgtagcatcactatagcaaattatggattaatatacatcattagatttgtctcgcaaaatagcctaaaaattatggaataagttttgtcagtaatctacgtttaatactcttaaatagcaagattccgaagagctattaaataacccttcggatcaaaacagtgccattgtatagaaccagttaatggtacgtggcatgtgtgaatataacagatctcgagagaaaatctgtaaagataaaccatccattgtttgtcgcatatcacaagcctaaatcacgagacgggttaatatatcaatcatatgtacagttaattaaaattgaatatctgctctgcttcatatatatttttaaaactccgtgaactagtttttcacgtgtgagcctataacaccccaagtaaccttacaattaccagcccacatgcacataattagggcaattcattttatgattttcttattatttaaacatttttaatttcaaaaataaactctcccaaaacttattacgattctagacattttaaccaagtcagttagactagcatgacaaaacaatgtcatgtcaactaaactgatgcgggtgcattattagatcatgtcattctgactggcgtgatagtgtagtttcctcatgtcatcatgaagtacttgcag

SEQ ID NO: 78018 - DNA, 3123 bp, Oryza sativa
  unsure (1)..(3123): unsure at all n locations
caaaatatttttcttgttatttcattttgttccagttaattaatttatattgtatatttgggctgagggggttggtacagagtcatgtggggtagttgctacaaaacgagtggttaaaatccttgaccctagtcagaacagctagcatggatagtgttttttttaaaacaaaaagaaaacatcatttttggcaggtacgtttgtgtactttctacttttgtttgaaccccggacctttgaagcgttaaacgtgtaaaacaaccccaaaagcatatacataaaaaagactttgcccactacttattattatattatatatagaaatataaaaatatatgattttattgagtatcttttaaaattaatctatacatatagtctccatattttttaagataaatatttttaaaatcacttatactaaaatatttttaaagttcgacaccagtcttatccaaaacgacaagtattatcaattttaaagtttaacatcaatcttatctgaaaacgatgagcgagtatcgtcaaccaagagggagcagctgcaatgttgacttagttatgtgatttttttttactgcatatatatgtatatattatttttcaatgacaaattaacacgcatacttgcattggagctctactttgtgaaagtatggcccaaaatgaatatatcgtttatttgagtatgtgttaagttgcattgatatttgagtacagtggatgcatctgtgttgtgtgcgacgcacaatgatgcacactatttgcgtcttttatgtaatgctccaggaaaaaaatgatcttcaacatataaaacacaataatattatcttcatcaaactaaaactattaaactacaactacttatccagttgtatagctcgaaataaagtctttatgaaagggggattaaaaaaaattatattagtcaaagttaacgttattagttataaagaagaacgagttatatattacatattgatctctgtaataaacgaacgaatcaaaatgaattctgtccaatatatccctccagctaaaagttctaaagaaaactatgtatattttcctgaagtccaaagtaaactaatccaaaagcaaattatgctccgctaatcaactaaataacgggctcgagccatcgctgccaatgcttaggctagctagctgctcaaaaaaaaaaaaaaaagaaagaaaaaaggactgaatcaatattcaggaacagttcgtcgtcgtcttcttgtagctatctagcagcagtgcgtgcgcaggttgcccctcgatttcgcgccgccgagcatctccgtcaccatgccgatcacggcgccgccgtctgcctgcagcagcagcggcctcgccgccgccgcgccgccgccgatgacgctcatgacctgcaccaagaacagcagcagcagcgccacgttcgccatcgtcgccgccgccattatcgtcgtcaggctatgatcgtaattagcttcaatttggagtgctgagctgagcatcggagcaatggatcgagcttggagagaactctgccatggcgtgctcgtttatatatagacgatgcatactttggaatttggatggatatggtcggtgtgtgcgcactgtctgcatgcatgttttgaactttgaagtcttcttctgtggcgtccattcaattcttggctgcgtactgctttttattatggttgagattaggcctagtttctgatctcgtttgtttgtggctgcacacacacggttcaaacttcacacgcgcgcagagaaaagaaagggaggcattaatattcagttttgcaggactcgttcaaatctgaattaatctcgctccactgatcgatcagagtcatttatatgcgtttttgtctcccacgaggaacgattttcttttttttttgggcgcgtccgacacatttcaactttttgaacagttcgtgcttgtagcttgtgggactggtaagcagagcatgcagcaatctgggcagagtcaactggattattccctccggtaaaggttttaaaatattaatcatgtttttctaaaaaaaattaaatcatatgtttaatcataaaataaattataacaaaataaatactacctctgtttttttaatatataacaccgttgacttctctatatacgtctcactatatattcgtcttattaaatctattaatttaattattatttattttattttgacttgattttatcttcaaatgttttttaatcatgaactaatctttttatatttatatagaatttagggtaaattgcacccacggtgcatcaacttggcaggtcggtgcaacttgatacaagaacttgacaaatgagcgttttagtgcaacaacttagcatataattgcaattaattttgtacaagaactttataagtgatcgcataaatgcaacaacttgtaagatatgtacgattttgatataataagttaagtttaattatttggaacactttttttatacatattcaatttctaagtaattttgataatatactaacgtggatttgtatataagcatatttatatttttatcttaataattaataactgatagtcaattaaattggatgtataaattattatatttcggttgagatttgggaaggtgaagaaaacaaaaattcttgaaggcaattggatgtgcggtatgattattaaagattaagttcaatattataaagtaatatccgtaggattgctatgtaatagcatattgatatcatgaaaaaaaaaactcaccaagcatatgcttagctaagttgatgtgcaccaaaatactaaattgtcaagttattatgctagattgcacccacttgtcaagtagttatactcgaacgcttaattctcaaattcttatttttaaagataaatccaacctttaaattaggagtggcaacttaacttgagatctcaggaccatcagcacgcacctttatccttcatccctataaaaaatgattcagtacaagctactccctccgtcccataatataagggattttgagtttttacttgtatcgtttgaccactcntcttattcaaaaatttttaaaattattatttattttatttgtgacttactttattatctacact

SEQ ID NO: 78019 - DNA, 7990 bp, Oryza sativa
tttttccttgatcgatggaacaacaccctgttttttttatactactccatccaaaaaaaaaataatcctagcaatgaagctgtaccgtatgtgtgtttttttgattggttgcttggattggattttatgggacggacggggtatgtatgttaggaggggtatgtaacatactgaatataagatgtctcgtgtaaatgaaacaaagtgaattatgtacatttttttcttcctaaaaagttggaaagaactatgtcctttttcccctaaagtacaaagtaaactactaaattgatccaagagcgaattatgctccggaactaggtgcagtggcgatcgagtcctcgatctctgccgatgcttcaaggaatcaaggctgctcgatcccaaatctgaaccaacaatgttcaggaatttacagttcgtcggaattattgattttgatctctgctccctccctctaggggaagtgcgtgcctgggttgccgttcgatttcacgccgccgagcatcatctccgtcaccatgccgacggcgccgccgtctgctgctacctccagcagcggcctcgccgccgcgccgccgccgccgaggacgctcatcatgatctgcaccaagaacatcagcagcaacgccaccttcgccattgtccgtcgtcgtcaagcttaatttgctctacaccgacggcagagacgacagtcagctgatgcaggttctcagacagacaatttgtgcgtgagaaattgagagctgatcagctgatctgagcttaatttggagattgtattaacccctgcaatggcgagcttatatatagatgatgagttgattttgcacacatgtattggttggtgtgtgcattttttctgaaaacatggttttgaactttgaagtctttcgtcccgttcaattcttggcacgcatgcttaccattgtcatcattgaaatttagacctaagggtctgtgtagattatagccaaaataaacctggccaatattaacaagttggcaatattgcaaaattttagcatgatttcttatgtattaccaaatttagcaacaaactaaacgtagataatttttttataactttgttaaaaaaatggtatggttaaaaataacattaatctgaacagcccctaagtttctgatctcctttgtggctacacactgcacacatacacacggttcagacttctgatctccgtccaagactcgttcagtctgaattttcttttctttttttcctcccacgagttcttgaaccgtttgtgcagtcgtagcaggcagctaaattggattactgcatactaatggaaatgcacgaccttttttgaattacattgtgggtgatgatggcttactataagtttcatggtcaaacaaaagaaaatgaatattatgtacgtacgttaatttgattttcaacgggaggttgctagggttcaaaaaatgtgttcaacgagggcgtgaaatccgatggatggatggatgcatgcgtggggttgtttggtcttggtcatgaaagggagggaaccgggaaagttgcagtatgccagtatgtatgcatgcagtatgccgtgcctgctgctgcgtacagaaacggtctttctctgcagctctgctatgataaatataacaagtcaatagatcgttaatatcattggaaaaaatctcatgcactgtagttcttgatgtgtcaaaaaaaaacttgcattagtattggttaagagtttaattcctatatttatgtctatgaagtttttttttgtaattaagagttaagttcctatatttgtctaagtattagttcttggataagagtttaaaaaatacttcatgatcttaagttcctgattggccgaagaaagattttttttttttttttgcaattctgctagtattaattacagtctgattcgtacaattttgtccatgcatgaatattaataattattttttgtgagggaatattcataggtttgacatatatataagcatgcatgagaaaggtcgacgtcgtaactcaaaagtcacctgccggtctgctggttttggcgaaaatcaaagctgctatacccaataatattttagccgtcaaaaaaatcaaaagaggtcaaagatttggaacatgtcgtacgactcggaaacagcgactgtttccacacgaccaaacccaaaacacgtaatatctcaactctagctagctacttcgcctaatctaacccatcacctatatatatatctcaccaattcatccagaattcttcagctcatcaagcagcaaaaccaatcaagaacaacgaaagctattctgaacttctgaagaacccaactcaagctcgacagcaaccaatcaagatcatccctgttgatctctctcttctcatcgatcgttaatttctgtccgatatatatcaatggcgatgacagcagcgagggcgatggcgatggcgagggcggtggtggcggtgctgctgctggtgcagatcttgggcgccatggccgtctcggcgaggacgatgaagggggaagggtggctggaggacgggatcggcatggtggtcgacatgctcggcgagctcaagtctgggggcaactctcccacacactgctgctaactgagcagggtgtagtcagctaccagcatgtgtggtagaacaagagagatgatgcacatacggtggtgtacagaaattaatttctggatgatttgtttcttgatcaatttggaggtatagggtaggaaagatgcagagatttgaggcaaatttctcgagtctgtgcttcgatttttatctgtacattttgttttttgacatcttgagaagaaaatcaaaggtgtattgtgatggttttgatgatagggacatgattacatgaattgaattgattcattcattttgttcgaaaatgttcgtttatgttgtttctcattccgatgtcagagaacaaactgctcttgacagctaaatgtcactctgtttcaattccgtacatgtcatttcgtctttgatcgatcgagtttgtttaaaatatcgctctgcaatttcataattgaattggatcacaattcactacagttaacttctcttctacctgcaaaaagaaaaataataataacgacttctcttctgaaaagatagaagcagctttcctgtaatctttttctcccattatgttgctcttcaagtttggaaatgctgttctcaaaaaaagtttggaaatgcgacgacgaaaaaaaaaatgaaaatgaccgcaaagatgttctttaggaaagaaacaaattgacctgaaagtctgaacccctgtggttgttggtcatttgccaacaaccaaaactgctgaccttttgaggtgtccttgtaaagtcaaaaagtttgacacttgaattcgtcgaaaaaatgatattacaaacaatacatgtcaaggaccatgatgctgaacggttctacacggcttgtagtgcagcgtctctgactgttttgccgggacagaataagcagcgtgtgacacgtactgttgaattgtcggttctaattaattctaattccctcccatgatttactatttataatttgtggatttggtttgtataaaataaaatatagctatattcttcacatggtttgtatcaaataaattactgatatatttatgtttttattcaaaccatgtcgaaccaaattggtataaaataaaatttagatatgttcatctaaataggttacagataaatatttgcatacatctcttcaaaaataaactacaaccaaacatcaattcgtggtgcacaaatctgatatatgtttaagacataaaagacccaacgaaaaagtttttttgtttgaaggcccattggttttggatccaaagtgacaacgctatgtagtccttccgaagttaatgggcccaaagtggcaaaacgtacaggcctgtttagaattggaataagttcacataccgttctttaactttacatcaagtctgtctaagttccctaatctccaataccagaaatcttcacccctaaactatataaaatagtccaatttcggcccgctgacgtggcatcctagtcagcaaaataaaaaataaaaaagttacagggcccacatgtaagtaagaaaggaaaaaaatatggggtatgcctatcttctttttctcttttcttttcctctcttctttttactttcctctcttctcttctcttcaccggcggctgagaggggagaggcggccggcaagcccggccgagctccaactcgagaggctccgccgccgcacccgacgacgacgacaacgcacacgcgagcggcaggcgagcatggcagccgccacacccgacgacgacgacgtacaagcgagcggcagccgccggccgaccaaccgcgtggtgaaattggcgaagcggagtggcctcttgagcgaaaggatctttgtctcgccgttggcgtacgagagctggtggtgctcgtcgtcgatggctgcggtagagtgcggcgacgagtcgccggagtcggccatggtggcgacatacggcggcggtggtccaaccgttgggcgcagaggcgtggagcatgcacaagagcggctcatacaggttcaacagcagccagccggcatcctctcctccccctccagtgggacggtctaggctggcggtggttagcggagaagctcgttggcgatggcctcctcgagccaatcctcggcagcgccaagcaagctcgtcgggcagaaatggtgctccccctcctcctccgcctgccacacccccgccgcttcctcctctcccatcggcgcgacgcgtggagagggtgggagagggagaggcggtcggcaagagatgggggaggggaaaggcagccgacgagccggtggccggctgctgctgctgtcgcgctcgcgcatagccggcgctgaggacgacaccctcgacctcctcctcgatgcatgccgtggaataaaactagaaaagagaagaaagaaaggctgccatatgggtcccacatttttttaaaaaaataaatttactgactatgatgccacgtcagcgaaaccaggtatatatagtgctatgtgatctaaattggactgttttgtatagtttaggggtgaagatttccagtattgggatttagggatgtcaaataaactcatcgtaaagttgagggacggcaggtgaacttattccttcataatataggtccccacgatggactggtcctaacgacatccacaatgtacgtagtataaaactagttcataagcaatacaatatattattggaataagttcatctaaagtcctttaacttgtcaacgaatccgattttcgtccttcaaccagaaaacaagatacaatgggttttcaaccatcaaaaccggtgcaaaataagtcccgcaaggcggtttggacggcggtttcagctgacatggcgtttatgtggctaatttgactcttcatctggcgtggcattgacatggcacatgaagcaaaatttaacaattgacattgacatggcatcatcctccgcgcagatccaccggtgacggcggcaacggatccgcacctatctagggtcttatttttggggatttttatttttatttttatttttatttttgtgtacggacaacataagagcccacacatgaaaatcggatttttatgtacgggtgcaccacccgcataaaaaaatagcgattttcgtatatacttttgggcagacaggcgggtcaaccgcacgcaaaaatagctttaatgctttttgtagtagtgatattttcatcttcgatcaggtgcataagtattttcaatctttgtgcatattacaaaataaacatcacgtgtagtacattattttaacgtaattggtaatcttcaattgacaaaaagtttgggatagatttttagcgaatccatgccacaattcaaactgccgtcattttcttccaactccagcgagatggtgggatagctcaaccaattataggttggggttggaagtaggacgttccctgagtttagaggaatggttgcgggaggcggtagctcagtggtgcgcattggaacgggtgggtggtgaggcgatagtggcagcaggtgatgggccggtgttaagagcaggggcatagtatagtgagtggtttgaaggctgggacgccgatgacgtttctccaatggtgggaggaaggaaagccagtgtggcagggggcaccttgctgatgcacgctggcttgaggaggaggaaaggagggaggtctggcgggccttgttggcaccgttgagggaatcgaaggattgatgggagttgaggctgtgagggttgcatgaatctcaaagtagattccatattctagaaaatgtaagagggtatggttttaaaaagataaagaaaacataagagggtgagatgaaactttttcagcatgtttggtaagagaaggaaagggttttttgggagttgggggagggattcgcttttggagtgagtttcatatttactcttcttgctttgtttagtcatagagatgagaatcatgggaaatatcccataaattgaattttatgtgatgatttatgggttggtatagttggccaaaaggcctgaggcccgatagcccaacccgattggtgttgggcacatgccggcatggcccgaccgttggaccatgtctgggcctctgcctcggcgcggtgggccagcccggcacaacacagtccaaagatcagggagctcaatagacgagggagccaaaatagaataattccagccatgtatggtggccgaaggagatgagggatgcaaaatagacttactccagccatataagagatggccgaaagaaatgagggaggtaaaatagactttttccaagaaggagcacaataggctttcatgcctttgggctagcccgtcatggcccacaagtcttattgggctgtgcctggccgttgatctagcaagtgggtggcccggcccgggtggcccgtttggccatttatagttagggatgataatgggttgaggcccatggtccctttcatagcccatctcaaccctttaatatttcgagcattagaactactaaatttcagttaaatcctttttttacgtagccctcatagttttttagaccaaaaatttggatcaattatcacccatatgtacagttcaaatttatctcgtcatacttataagagaaattcccttccaaatacgtggtcatatcccggtattgaaaaagtgagagtttacacttgaactctttgtcctagtctctcctaaaactctcacgtccaccaacgaaatactagacttaatggtctcaaactctcatttctccataacaattcccccaaacagacgcatgcaccggttctatataggtagccgatccttctgctttactgaggagtgaggagagtgataaacctggtcagtgtccagtggcctcgtccaccggactgcgcggacgcatggggtgcgtgcacgtgcggtgctcgcgtcggccgtcgcgccgcgcacgcacgcacgcacgcatgtgcccaccctgtctgtcccgatgtccgtggacatcaaccaaaccatatgcatatgcacgcgcctcccataaaacacaagctggcaacgatccatttccactactcctcgagatccccaactcctctccctcctcttttatactcgatcgatcgccactctacctccatcactgatctagctagctactagtacagtacacgcgtacgtacacctacaccttagctagctagcttagcttgtcgtagagactagagaggcaggatagaagctctcaagctcaagctctcatggagacgagctcgcggagcagcagcgggtgccagtcggggtggactctctacctcgaccactccaatggcggccaccggcagtattacgcgcgcaagaatcacgagctcgacgacgacgacgacgacgacgacatggtctccgacgcctcct

SEQ ID NO: 78020 - DNA, 1465 bp, Oryza sativa
ctgccacaccggccacgacgacgacgacgacggcgacgacgactccggtagcagcggcgtcggcggcggctacagcacttgtacggcccggtcgatgtcgtcgaagaggagggccatcgccggcgaacacagcgtcgtcgacgcggcggttgtagtcgtgctgcgccaccgcgagcacaactgcggcggcggcgacgacgatctcgacgacacggcgagctcgtcgtccgccgtgtcctccagcctgcagccaagctgtgctttctcggcgaggcacttgcagcaatggtcgtcgacggcggcggttcgaggcacgagcatatactgcaggccgccggcgccggctacgcaatgctacatcgcaactgactagaagaagcatagactagcctagatgacaagactttttttgtgtgtgtgtttgtgtttttctgtctatagaattttcagttgttagctctctagctgaatgcaagcagatggaggctctgtttagaatctaactttttttttctctagacttctaactttttcatcatatcgaatttttctgcacagatatcgttccaatttctttaaacttttaattttagcgtggaactaaacataatgcagcatggtaactttgattgatgcgaattttgactagatcgatgcatatattcatgtgttgcccactgtgtgtgccaatatatggtcatctaactctgaatatctcactcagcggcgaatatattatcctgttcaagtgttcatctctgaacattctgaagagaagaaggaaaatggatatctgaagaagttcgttagtttaagccagtctctattctcttctctgtttttgctcagcgtatcctagctacaagacaatgacggcgcctaaatgtactgtagagcatatgttctgtagtcaggtaggattcagcagtgcttgcgcgggagttgattttaaactctcgaatggacatcacttcattatttacatgttatttaaatagttatgaaaaataattaaaaaatgagaagatagatttatatgtgatatatcactccacaaacatgttaaaatttaacttctacaagtaaaaaagaaattcaacaatagcttgttaattagaaattcaacaatagcttgttaacatatattggaaaggaattttttcattgcaacatgtagatgctaaattttattgtatgtttgttgagtgatctatcacatactcactccgtccaaaaattataagcatttttgaactttgacacgtcttcgagatgctattttaaccaataatatctataagaagaaaatgttttaaataaagcgtattatgatagtttgtttaatgataaatctattaacatcaaatttgcattatttacattagtttgtttataatcagctgcaaccaaaatttaaatttcaaatattaattttagagttgattttgatgtctttcgtcgtagt

SEQ ID NO: 78021 - DNA, 17417 bp, Oryza sativa
tgcaagcttccaccacttttatgcattcctcaatctctaacgaaagcaactactggtactagcgtttttttctacatctcaaaagttacactttggcatgacatctccttaatttggagagacttgagtagaccacgccaccatttaaattaaagtgcgttgatcgccggtcaactaaacagtgtatgagtatgacatcagacagcgactgttaattgattagcaaacaaaatacatcaaatcgagcaagcattcaggtatacttactactctaaatctattataagttacatccacctaaaatcccttacaatttaaaataaagggagtacctgacgttcatgttcctagttttcatcagcgaatgatggcatgatcaaatcctagccacggccccacccaccctgatagaaagatttgttcttttaagagcaggtacaatagcaagctataagccagctgcaaacatattttaagaagataaataaggagagagaagagcagcgggatacagatttgtagccaggtgtagcacgggctccaagacgtaatgtgtgtatgacaggtgggaccagatattaatagtgtaatatgtaactattgtatgaatgagctattagattggctatatatgaattggagctattagttggctatactattaaactttctcttagacctgaaacaactagaattacatatgttaatttatttcgagacaggtcaacacatgttaatttgaacttgtggaaccatacagtaataaatctcctacaagattttgcaactgattttgatcgataccgttccgtcccaagctagccagtagcaatatcagttcagctgtttttcatgtgcccgatcctctactttagccctaacttaatgcagcttgactttgtaccggcagtcaaggtcaaggtcaagtatatatgtagatagagctaatttaagtctacaagtagaaaagaagaaccaaattaacaaatctccctctctttctcggttagcagaccaaaagaaactgaacgtacaaaagttccattcttctatctttttttttaaaaaaaaagtaaagtaaaacccatgacaaaagctccatttttattttaaaaaatttatcaaatcccatgctttatggtaaaaaattaaaaaaatcgcatgtattatagcttgtaatacatataattgcatgttttagttttgtggttcaagtgttacatcagtcttgttgaaatctcaattaattttagtgtgtcggaaacaatactaggttttgaagtagtgaagagttaaaataaataacctaataaagaaatcaaaaatatattttacactcaatactctaaaattttaagtaaatataacttcaaaactcctgtcaccagaagttcagaatacctgaactttgctaaataaaaatatgttctataatccaggccaggatgggccgggatggatagaagcatgcccgtatgggctggaaattgcaataggaataagttcactttaggtcccttaatttgtcagctagtctaaatttcgtccctgtttcgcaataccagatatggcacgtcccgcaactctcaaaacagtataaataaggatctaaggcagtttggatggcggtttcggctgacgtgacacttatgtggtgttgatatggcacttcaagcaaaaagaaaccgttggacccacgtatcatccggttaaaaataaaaacaatacagtgggacccacgctatcaacccatatctttcccttttatcactcttcctcctctctcatcctacccaaccgtgcgcccaaacccgcgtgcgctctttggagcgtcggaggcgacagtggcacgcccctggggtgcgcctgaccggccatcgccgtcgcgctcttcggcgttgggttcctcctccttgacccgctcctcgacagcatccactcccgtgacgcgctcatatcctggtgacagtgactcgtccatccttcatccacactccttgtccacgcagtacatggaggaaccgagcgagtttgtacactaaccgtcaccggtggtgaacgagtagaggttgcttgtggcaaacgcacccttggcagcccatccaagcgtcatctctgcggacaacatcgcaaagaagggcacggacaccacatatgtgtccctccagtagatgtcggggtcgtagttgagcgcgcgggcacggatgcgaccagtagaggtcaaggaggccttagttgggtgcgcgagcgagtttctcaacgtagaccctgaggccacgatcggcaatttgctgctgtgggaagaggagcagcagggaggtggggcgcaggaggaagaagaagagggagcggaggagcatggtggggacggggaggcacgccatggccgtcttccaaatctcgctctgcttgcttcagatggaaggagccaccatggtctcgctcattctgtttgcttcacctactctctcccgctgctcccctttttcacttccacgaccattctcctggggctttccatcatgaagttggatgtggacaagagcggcgacaacgcgggggcagctggtcttctgttgcttctagtggcgcccgctgtgtccgtcataggtatactgctttggctcgcgcgtgcgcggtcaaacctcgagcccgcctgtcctcaccctcagcttcctctccccacgcccgaccatcttcgtctcgaggcatgtcgtcccccaccgtgcgctcgtccggtgcaacaccgcgtttgccagccggccgcctgccattgtgcctttctgcgtgctcactactagccagtgcaccgtcagctccacaccgtgtcccaacatgtgggttactcactaacacgtgggtcccactttttatctaacttgaagtgccctgtcagcgccacgtaagtgctatgtcagccaaaaccgtcgttcaaactatgttgagaccttatttgtattggttttggaagctgaggagacatgttttatctagtattgcgaagttcagactcggcgacaacttgaggtacctgaaatgaacttattccattgcaatatacgggctgaacacggacagatgggcccagaaaaaaaaatatcccacactccaaacggacatccgcctctcattctccgtctcctctccccaactcctcgcctcgccatggcgccacctcccctgcacctcttctccccgtccccgcggccgccgtcgccgaccccgccgccgtggctccacggcccgcatgtcccctcgacgtccgtctccccgccggaccccgccaccgaggcccctccggctccgaagcagcaccgtgggcccagaccggcgccaagaaaccccggctccgccaagcccctcaccgccggcgtccccggcggccgcacccgccgcgcggtcctcggaatcatccgcaaggtccgctccctcgagctctccgacccgcgcacacccagccccaatggtggtggtggtagtagtagcagtagcaccgcgaccgcgcgcgtccccttccacctcccgatacatccgccgccgccggagcgggaggaggaggaggagaagaaggggattcgcagggcggtgccgtgggccgcggcgagggacgaggagaccaaggtggtgctgcggcgggagaagaagacgcgggtgccgacgcgcgcggagacggagctggaggccggcgagctggagcggctgcggcgggcggcgcgggggaaggagcggtgggcgcgggccaagaaggccgggatcaccgacgaggtggtggaggaggtgcgggggcagtgggcgaagggccaggagctcgccggcgtgaggatcgtggagccgctccggcgatgcatggaccgggcaagggagattcttgaggtgattgcttcacattgctatctgctgctacttgatttcctggacgatgagcttcttgttgtggtgatgcaaaagcatttgttgcatctttgtgaaactttggagttcatctttagcttcatgtacagcaatgtagctaagtaacttagtttcgaaaatggaaagggggacgatcttgtctctctttcttcaaaaaaaaatgtagagcaatgtagctagggtgggttcatttttggcatcatgaaccacaattctgctaggaagttgcaaatgtgaccagcattttctggcagataaaatgattgaattgatgcaggtggtgctacacccgttggtggactgctggtgcttgattcaagatttttattggctgaaattgttaggttggcttagctgatgaattatgtttggcttagttaaactatggttaaacagagaaactattttaacgacaccctctttaccttgaattatttaagtccaaatcattattatcaattcaaaacctttgatatttatttttttaattctcttttcattagattaaaacaggaggcttagttgtttggacaagagggggcatacattttgtgtacagaggaagcagttacctagaaaacgcaaagcggcatcgtgactttgttaattataatgaggaactttccccagtaacatctaacaatcctacatcccaagggaaatattggagtaaagatgaaactttaaccaatgataatgatgaagctgatgataaggacgacaaacctatcaagggaacactatatgaaagagaagtcaacagactactggacagtttgggccctcgatttatcgattggtggtggaacacaccattgcctgttgatgctgatctccttcctgaggttgtccctgacttcaagactccatttagacaatgccctcctggtgtgagaccagcactagcagatgaggagctgacctacctgcggaagcatgcacggcctttgccaacacattttgtcctaggtgagtttgctattagtccccatattctgcacttgtcagtcactttattgatagtttcaaatgaatatgctttataggatgatttaagtgttgattgtcactactatctattgtaacatcttatgcacacataacctatttccttaaagttccacaagcattattgtatattcataagtaacccatcataagatgtttatatatgtagcccaactataatcttgactaatttctggcaggtagaaatacaaaactgcagggtttggctgctgctatactaaagctttgggaaaagagccttatagcgaaggttgcagtgaaagtgggtatccaaaataccaatcatgaacagatggccagaaatcttaaggtgtgtattgttctcatgaaatatattagagtcattaggatttctttgatatccatatgttcaatcttcatctgtgacactgaatcttctcagtgcagcgtcttacaggaggaactgtcatattgaggaacaaggattatattattatatatagaggcaaagattttcttcccggtggcgttgctgaatcagttattgaacgggagtctcaggtacatgaccagcaggcgaaagaagaggaggctcgattaaagatggctgactcacttcaaatgattgttggactatcatcggagagaagttatgtgggaactttcagagagtatcaggatttccatgatagccatgcacgtagaacaactgaaaacaacttcagaattcaactagaggcaaagaagcatcgattggaaaaggaactgaaagaccaggaatggagactttccatggtatgctttgatctaactcgtcttgtaccttcttttgaattcccgaacttccaatggtaatgtaaaaatggtacgtactgcagcttaccaagaagattgaaagatcaaaccaagtgctggcaaagcttcatagttcttggagcccttcaaagaaagatggagacagagaactcttgacagaggaggaaaggaggatattccgaaaaattggcctaaaaatggatgaacatgtgctgcttggtatagccttttgtatcaaactgcaatattccatgcctatatgtgtctctatccttgaaaccaagaaaagctatttaccatcctatgatgaaaggtattcatccatggttttcccttgcagggagacgtggtgtctttgaaggcgtaattgaagagattcatcaacactggaaacataaagaggttgtgaaagtaattaccaagcagaaccaagccagccagatcacgtacacatctatgatgcttgaggttgagacaggaggcacattaatagcaatagagaggttcactaccagccatgccataatactttaccgaggaaagaattatcgtcggccaacaaaatcagcacccagtaatctcctgacaaaaagagaagcattacaaagatcaattgaggttcagcgacgaggggtatgaattgacatataattctcccttctccccttaatttccaattttctggctgtctgggtatctcatttcctcattcgttttgcagtcaatgaaatacttcgctcaggagaggaaaaagtccattgatgaattgaagagagaactggttagtttacatgctgtttatatcaatacgacgaaatgaaacttcatatgcttaagcaactggaattttatgtacttgatttatcactcttgtgttacagaggaatgtgacatgggaaatcaggaagctaaaccatgatactgaacagtcttggacagcatgatcgctatcaacattgaagattggaataacgattcatcctctcttttttttttcgtttttaacatgataactacaaagaacaaagtacacagaggccactagatctggtaggtatggtagatatggccacaatgaattatcttgcaagtgtgaagatgtttttttttttgtttatgtacatgtgatacactaaagcacatgagagcagaatcattcaatttggctctgatactacgacgaaatacgaactgattactgggtgttgattaaagctcggggagtttgctgaatatgcttagcgctttcatgttctaaaagaaaacaagtcgtatgacctattgaagagaaactaagaagattcagaaggatgctgtactatctagttctacatcactgttacaaagttactataccttttaagggcgaggttacgagggtacaaaaacatgtgctgaaattctttccccaagcaaactacagaaaagatcctgcctagcaaaagcggtactagtcacctggcccctgaggaaattttacaggatttttggaagatttgaactaagtcctgttatccggtgaaaattctgcaaaattattgtgttcgaagatcccaataaactatgcattggtcgcccaaacgagagcactcaagcagaaggacacagagaagcacaagtgctgaagaatctcactggacggcagatggcaagctttgcattcatcagcttcattgttcttgccgtcccgtccttcatggtttgcgaggctctcccctgaactgctgctgctgctgctgctgccgatgatgatctctcttgggcctctgcggcgcgttcttgggattggtgaaccaggtggtgtagaggaactgcttgtgcggcccgtcgtggtcgcagatgaggcggagcttctgcttctcccgcatccaccgcatcatgatcttcatctgcctcttgctcgtcaggcccctcagcccaacgtcctggacacgaaaatgccaaagattttctcgctcgtcagggatgcatgcgatcagggtggcaatcagaggaacacaagatcgttcagggatgacagtttccatctgtcaagcactgctggttcattttgacactgtgagacattacgtcgaacaggtggcgcgcgccaccgggggggcgagggcgaacggtttgcgaggtgaggggtgggcgcggcggacagggagaaggagcagcagcaaggatgcggcggcggcgatcgagacgggtagcatgagggcgtgacgaaccttgacgtggtcccagacgtcggagatggtgagcgggccgtgctccctgacgacgtcgaagatggtgcgcgtgatggactgcgcctgctccggcggcgccgggagctcgatcggcgccatcttcggcttccccttcttcgccgcccaccgcgccgccgtcgccagcatcctctccgacgaggggacgggaagcaagcagcaaacacgcggcggcgccggccgacgaggtgaacagagcagagcttaccgggttgggggtgggatagtttggctctcagattcgagtgtacggtcctcgctcccatcaaacactccccgtcgaaaactacaccaaactcgtatgacatattctaatactacaaatctaaacgtatgtctggatttataataaattatatcaaattttgaaataataatttttcgatattatgtcaaattgtcatatttgtaaaagttaaattgctagatgcagctacaaaataggggcaaatacataactaataaataaattaggggaaattgagagtatgaatgtcttttcgccaaaaatttaatattgttaacatgtctatttaaaataggggcaaaacttagttttgtttgaaaaaacaggagtgaaccgatataaaaataggggtaagaacgagatttccccttatagtaaacatgtaacatattacactcatctatgtatggcgtgaatatattatacaaatagcaccggtctataccactgtttatgttttttttataaaactaataactgattttagattgtatcaatgacgtgggtttagacagtgatcgatatggttttgtagagtattttccatacccaaccttaggctggcctgaattcgagagcgagccttgcctactaacacggaaaaccaaacaaagaattagtacataattaattttaattaagtattagttaaataaaaactttaaaataaattaatattgtttttttaaagcaacttttctagagaaaattttcgcaaaaaatggtaccgtctactgatagttttggaggcttgtacacgaaaaacaagatatgggagactgggaaagttgagagaagaaccgctccttgcccccgtgaaagagaagccatcctgtacaaccaccatcacaccttcacaaaaggctcactattcattagtcaactaatatttctggaactatctatctatatattggtgatttctaaaaaaaaacatacagattttttctacccttagatttacacccaaggtactataaaagaaaataacaaaaacatatttacttgcatattatttttatcaaaattactatgaacttacatatcatatcagctgaatttacaaatgttattttaatgttttcctttacaggttaaagtccaaattacctccggactattacgacagtttgaattactcccctaaactacaaaacagaacatttaacactcaacttttttggactggatgaataacccccagtacaaatttggttttgatcttacgtggcatagaacgtgacaatataatccaatttttaatcctaggtggcagtgagccagtgaggcccacccatcatcttgtccgccacctcatgacgcctgtcacctcctctaggtcatgttgggtgtgtatgagatagagagatagagagagagagagatggatatgggaggtgaaagaaaggagaagattggaagtaggttgtcaacaagccgagctcaagtgagctttcacgtctaggctcgagctcgacaaaagctggagccgagcccgaattgagcctaatcctccttcgagcttttaagcaggctcgcgagctcgaccaagtataggataatatataatttgatgataaaattttgtaaaaataaaaatttaattaataatattgaagaaaaatattaggtgtcacaccctgagaattcaaaatatgtaaattattgtttaaatggaatttttagaatttatttttaaaagcctagaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatctaaattgaaaaaggttttaaaaagtcttcttttggctttgggccgaaagtcggcccaaaaccttctctctctctctccccggcccaagtcggcccagtccgcaaccgagccgcccgcgcgcgccctcgctgccgctgacaggtgggtcccgcttgtcagtcgtcgtcttcctcgcgcagccgccgcccgaaaccctagcgccgcgccgccgccgttcctttccaaatccggccgcccctttccttctccggccgaattgatagaggggaaatgatcctcgggatctcctctaccttttctcctttggaaacatcggctaaatcgttttggaagttcgtggaatcgagttcgattcggatcggcctctttccttcaagccacgaagtttcctcctcgtcgccggccgccgtgggccttcgtcgccgcctccgagcccctttaaaaggaccccgagctcttctctacccgccgccacccttgccttcgcctctcgtcgtcggaaatgccctagcgccgtgtgccctagcgccgccgtcgccgccgtcgctccagccgtgcgctgccgccgttccagacgtcgccgtcgctcgggaaggacgtcatcgtggtcgccaagtcgtcgccgtcctcgtccgccgcttcgccaccgtcggagaccgccggagcatcgtcgccgccgtcgacccgaagagcttcgccgcttcctcctcgtcgccgtcgccgtccgttgatcttccgccgtcgctttggtcgccggtgagtccgtcgtgccgtccgctacccgttggtgccctccgttcgtgccgtagtgccgccgttcgccggcgagcgtgcgccgtccgagccgccgagccgccgccgccggtggtgacgtcaccgctgacgtcatcggggccgttcgtcgtagaccggtcgtggaccgatcgatctcggccgtccgttttggatcaagtcgatctcggccgtccgttcgtgtgaaccgccgccgtgcgcccggtccaccgcaaaccctagcctgctgacgcaataaatccccttttccttttcaaaaataattcattattgcgtcataattcaattaaaatcaatataagtgttttaatccgattaaatcttcaaaaattcatatctaattcatcttagctccgatttagttggttcaagtctctaattttttctaaaattgagatctacatgttaaaaatatccacatgtactgttcatgcttgtttatgtgctgttttggtgtttttgctcttttctgtttagattccgtcttttccggagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcccttttgttcttgattactttattccttgataccttgggttattataacttgactagttgagctttatatattggttcaactagatattagatataattgcttagccctgcttagaaacattagctcactattgggataacttatgactcactgttatttaatgatggtttaatgatagttcacgatggtcaatcgtgactggttaattaattaatgtgccaactaaaacctggtaatggtgggttgtgagcacatggttttgatggttgtgctcatgacaattaaggaccggttcacgagtttcggttgtgaaacattaaccgtgccaaccacaagccagcatgggcaacggctttatcttttgtgtagcatggttcattgcggggcaccagactgagaagtggcggagataagcccacgggggtcgctggggagtccatgccttgtttataagggggtgattatgatctaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccacaatagaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgaagcccttgtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacattaggagaacttaagattaatatatcatgccaaaatacacaatttttttcacatgaatatatactaatttatccttgagctactaacttatcatataaaagataagctcgagctcagctcgacaaagctcgtgagcttgcagctaggctcgagttcggatcattaagagttcgaaccgcgctccaatctagtatgagcctcacgagctcgagcttttttgacagtcctaattggaagtagcaatgataggtcagcctcactgacttatttttaactggactgccacgtaggttcaaaactactccagactaagttgttgggggactgtggggtaatttgcaccattgcaatagttcaagggtgtaatttggactttttcctcttttgtatacttccttttcttttttaaaaaatacagtacaaacgcaagcctttcactcccactgggtgatcatcgctaccactgccccaaccaagtgtgttgccacactccgtctcgacgacaccataccaccgccggctaggctagtcattgtgtgatcccatgtcccgtctcctaaccacaagacatgtctcagcctcaccgccaccggcgccttcttactcactcatctcctgtcacacccaaagttttcccttcccttaggtttcaaatcactaataaatggcttcaagaatttgctttggttaaccactagaaaaccctagttaacaatacatttaatagtcggaattgtcagggagaatttttttcgaaatctctttgctctaaaaatcactaacaagacttaaagagtcaatatcagatcacggaggcaatgttgctaagttaaaagtggcaagttaattcttcttcctttgcctttggtcgtgaattgtgcccaattcactcccctctcagcccgtggtcttgttttgcatgaggaaccatatacgtgtcagtttgcggaaccatttcctttcctttccgtataggtagtcgagttgtctagccgtaggtgcaaccctaggttcctaccggccaatcgtttgccgtaccggggctttaccgtgaatcgtgtctagcccgccggtttagctgcagtcgttgttgtgtcgttcactcgttcatttgaacgaggtgttccctgtggttcgttcgttcgtccgtcccgagtcgtcctttaggttagagccgttcagagccgccggctcctttcaccggtttcgattgatcatttgggtgatcctgtgtcacgtagaattgactcgttgagtcggtatcacgtgaggcacgcttgccaatcaatctatcctttgatcctatgttctttcgggcttaaatccctgtcaattgattaaggtttttctgttaatagtaatagcacagagcatcttctaaaattcataacttaataatctgagctccgttttaacccattcaaattgcagtgaattcgttaaatgtcaagaatccattaaaattggtttcttttgttgtttcagtagctttttagcatgtatttattgtgtaccttgtttgtcgtttagactccggcacttctgacgctccggtttattttgaagtggtcgccgaggtcccgtcaattgaagagcaaggcaagtcatacagatatcattgatcatattgagcctatttgcaaaaacccctgcttttctctcaaaattgcattacttttataatgtcatgtgggatggtttctacccatactcagcctttgtttaccttaattcattgatattctgggataaaaatttgactagatgattggtctaggattgcttagccaagcttagatcaactagctcacaatgggattcactataatttagtccttaatttgattatgctatgccttcttggcatatggttaattaattaaaatatgctttacttggtgggtcgtgggcacatgcatgatgatttatttggtggttgtgcccatgacaattaaggaccggttctcgggaatccctggaagatatactcgtactaatcataagccatatgggctctaggctgaatcttaagtataatattttctagctagcacaccattggcgaggatagatgtgatggagtatggatggacctggattttggtctatgctgcttccggatttacctaggcacgagcggaggctgcctgctcctggattttggagtgggggcgaaactggaggtgggcatgctggttaggggtggttatatggagggttttgtcacgatttccccctttgcagtatcgtggcggtacttggggcatggtttcatgtgtggaatcgtgtcttgtgggtaaagttgtacacctctaatcagagtaaaactattcgaatagccgtgcccacggttattgggcggtcaaccagctcaccatgattagtctcaccttaataatttgccttaatgaactagtgtagttcaggtggttttggtttgggcctgtcgcaacgtggtttagcgttggacagtgatgatgttaatactacttaattatatattgttttactgctttcaacttatgatttacaaatgatgtttttactgcaaaatatcctatgagccaatcctttgttttatccttgcatcataccttccccttggtatgacttgttgagtacggtggttgtactcagtcttacttctttttcccaatcccctagaagcagaagttggttcagatggtgagttctatgaagtttaggattgtgccagccgtcaagagtttgcctgtggagttatggaggaagcttcgcgttgctgtgaagattaaatttagttctctagttttttcgctgcgtatgagtttattttgttatttttgtaaaacgtggaactatatcaaattgtcatctgtgtactatagttgatgtctggacagaggttaaatgcacagatagccggtgattcgggttattaaatccttgggtgagacatctccaccgcccctaattgttcttccatcgccctagtcatcactataaagccgccctgaaccccctcccccccccccctccctagtaacctccaaccttgaaaccataatccggtaaagcctatcggagttcgttagggtgttagtgatgaggcttgccaaggaggttgtggtcgccattgtcgtgactgccaccatcattgtccttcacgctcgctgtttgatctgatgacattcatcatagtctattgagatttttgggaaatgtaagtaaaccaatgaaagatacaattactttggtaactctgtgaacatatcctatgcacataagctttccgtgcacaccaactagcaaatgttacgaataattatacaaaaaaaattgaacatttacttataatagtattacacatatatgcaaagtcttattttcaaattaattatattttaaccctaaaaaaagtgaaaaatctgacaactttttgagttaaaatatattagaattttgttttttttttgggttacggctaaaatataacaaatttgaagataagatttcacacttaggtgtaatactattgaaactatgtgtctaattttttctagaattttatgtgacatttgttaattgatgtgtatggaaaatttgtgtgcatagtatatattcctggtaagtcctatctacatttatcattgtcatcattcttgaggctcttgataccatccatttggccttgtttctttctccatgtcttatcttatgtttgcactgaactctcaaggtttaaggtcatacctacaacaaacccagtgaacatggagtgtggtgagctaacaagccgggttggttgtggtcacatggactcgtcggctcaacgagtaaccgaaccataaatgcatgcagtagctaagctaggcccagccacccagaaattacgccggtcgaatgtggtcacatccacagctccagacctgaaccgccgatggaaaactctgaaaactgaagcgaatagatgaacatgctgaaaaatcccagcatcaggcatcagcttcgtgcctcgagcccgtcccgatcccgaccggagtactacgagctaccactacctcctccgttgactccggcggccatggccatggctgcaagcacgatggtacaagtgtgtactggtagtagaagtagtaccaatgtacgagcacagtacattcttggcaagtgagcagtacagtggtagtaatgatggctttgctgctgctgctgctgtgctgatgatgatgatgacaagatcatcgtggcctgtagcagcgtagcgtgtcgcagtttgaggagaggagaaaagaaatggtgaatttgtgatgaactgatgatgcatgcagagtaaaactagagcgaatttgcaatttggggtcagattgattgattgggtgatggtggtgatttggtattccatattcacagcggcaaatctcctacaacaagaagtggatcaaaactaatgaaaagaagaaaccaaagagaggaagaagaagacgcaagaaacagagcaagaagaggaacaagatggggacgagcggaagacatgtcctcttcagggtttcttgatctcttctcttccgtcgttgctgctcctgctgttcg

SEQ ID NO: 78022 - DNA, 6581 bp, Oryza sativa
ctatgagcagccttcaaaaacaaaacaaaaaataactatgagcatttacacaacggagcaactaaaactgcaataaactggatcagacaaatcagcaacatttgtaatttacattgggaccaatttcagcacaaccagagcgtaggataggtacatcagcagggtaacaaagaggactgtggaatatgattaagagtgcaaactcccactgtaatttacagccaacacccacaacgagtttaagtcagcatataacggccagcaccgagttgcaaggaactctcaatgatgagacgatcacctgagatgacaagcacaattctacctggcaaaactctacctattcttgcgcaatgtacatggaaatgggggaaccgtacgaactagtcatgttgtagaacttaaaactcagaaaggccgaagaatccacacaacatcaagatacttgtcgcctcatgtttcagcctctcctaccagactccatcgtgtctaaaataggactggtgtctctcagggaaatggcaccatggccttcgtcagcaatctcaatgtctgttggtcccatgttgtatgagtttgcaatgccgttgctttgtgtgtcagctagctgttggaagtatgcatggggccatacagctgcaaatgcaaaggaacatgaatatactgtaaaatatgtcgatcaaggtccaacatatcatctatatcagaagggaaacgtaccatcagcatcaaatggatatgggaagaactgcagataacaaaacgaagaaaccgtaagacctgaaaaaggggaaagaagaatgagacgagatccatgcctactttctgacaacgagagtgttctaaatggttgagagaaaggcttcaaaataacaaacctataatgccacctgcaaatacgtcttgccagtgatgccagtaatcatcaactcgagagactgccacaagggacgcaacaagtagaggcagaaatactatgcataactttgcaatgtggcctttgcgatcaaaagccttaagtttaccagccaagtaccacgcaagaaaacctagaccagcaaaagaccctgcagaaggtgagtgagaaccacaacacatacgtcagattacagacaacagatccaccaagtaatgaaattcgaaaatatatggagaacaaactgtatatggtgctacatgccaggaaaaaattatatactccctctcctctggtcatgaaaagctattgttttgaacacccctctagcaaaactttcaaaacttcaacatcaaatctctttaattattattagataaatgaaaactatattcatagatttgtttgacaattttatagcactatactttaatctgattatacaaataatttactataaaatcagtggtcaaagttgtatgtcagatatcatgaggatgtccagaaacacatttttctgtacaggaggaagtataaacaattataagaaaaagatgagctacaccatttatttgatagcctcggagtcttaatcatagatacaacatataggtgttaagggtaccaacatgaataaattcaatttttcaataaatgtcctacatagttaccaagagaatatagcattgaatttaaactagtcaagaatttcatttattcataaatgtcctgcatagttaccaggagcacatcagattggagagcagtactccgaacaatgccctacatgaaggctgaggcaactactaaaatactcggaactgttgcaaaagaaaaaattggagaaaaatccttggaaatgtatgtagagaatgtggagaaacagatgtaaaaaatgcatgttgcaaggcatgtaaagctcgatatcaactcagaaacatacaacggtacttcaaaacttaaaagtaccgatgcgttgcatgtcttacatgaagaatgcccacttggaaagctcttgtggccttccttgataacactcttttctccatggcatatgacatttgtagtgacattatcaaacttctgaaaaatgaaacgatttgttacttcaatataacctgcagactacatgaagtttaatatctgagatcaggacactagcacaaggagattacaggtattccatcagggaaacaacgccaaaagaaatctgggcgaggacgaccaacaccatccttaattgcatcagtaatcacagcagttataagtaccgaatatagaatccctgcacaaactctatggttaaattatatggttcagcatgaaccaaagatgtaacttcaatagatatctacaaatgagagcatcgtatacccagtatgccatggtgtaaatcatagacatttttctttttgaagtaaattccaccaaagacaacccagggcagcacaattgcaataagctgcaagtcaagaaagaattgcatgcctcaaacgatagatgaaaccataagaaaattttatctggcataacgagaacatactggaacggcccaaaatggaattgtgttgccctttagtggatatctcaagtctgtcatcatgtcacgtccaacaaagcggtgaaaaggctcaattatgtttagcagcccatcaacaacagcaagaaagagaagtattatccagtcatacatgtggagtcttgccacactggttccatgggaccttatagtgtggcaccctaactggatatcaggcatttttccctgtaaaatcaaaaaggaagcttggaatcagcagggcaaatataactaacatgaacgtggtcaatatgaactagtgatcatatgagtgtgcaaacagaaaggatgagaaaggtttcttgataggctgaaatcatgcattggtcacattttacctgtcttcagacagcaataatattttgactctataaagcccagtagtctagaatacctacatctttgaagcccttcaagcatattttatcatttataaaaaaatttaatggaaaacttcctgttagattaaatacagttaaatagtacattgttgtttagaaaacgaaagggagatgcagaattaatacaaagtcaaacccagtcctagaaaagaaacacgaaaaatgagatagaacttttgtgcaggagaccaagtcttgaagtttgaatatccatgtcaaatcatgtatcgctaaaaactgagaagatgttctgcaagtattggcaagccgcaaccctttttatatgcctcacgccttgaccttgctgtatatccctcacaacttgaaagggcaaagggtatttgaaaaagtttgaacaaacaagaacatgaaagaaggttcaggattgtaatgcctaataactggacctgttgtgatatccaaaacacgacaacaaactagaaattccaggaagttgatgataaccatccatttcatttcaaacccaattacaaagctagaaaacctatcacattcacaaaaactcattcaacctaaactaaacagcatgtgattgagtagtaatctgatttttttcttctttttttttattgatgccatggtgtgcatttctaggtagaatttcccccttgtatgaaacagtaataagcagcagtttatcattattaatatgtgccattcatttttttactttagtgaacagtaaagactaggggaataaaaacaattcaacggatccataaatcagttgcaggttatatgagcttatgagctgttaaaaatccaagacagaagaatcagcagcaaatttatagaaaggggcgtaatctgtttactgatgagtcgacaaaagatgtctagagttgactggatacgtcaccagtccaaaccacagccgctgaaaaggtaaacaacaaacttaaacaaccttatccagttgaaccaaaaaaacctagcatttctagcaataacaacctagaaaacacccaataatcctaaaaataggcacccataaacgaatgagaatcactgcaaaaacaacgaaatcactaacgagaatcactgcaaaaacaacgaaatattcccaggtaagagtgccctaagagatatgtgcataaatctcacaggaagaaaacgaggatttctctttagaacaataataaaagcaacgaaagaaatcaagaaccaacagcttcaccggtcccttggtcgagatgactaacaacgagccctacagatcggcgcctcctcctcgtgctcttcctacaaaaacaaaggggggcaaaaaacaaaacaaagaaaaaaaaatccaacaataaaggttacaccaaagcaatctgcagttgcaggagaatcttccacccacggaagaaaatgaaacaaaaaaagaaataaagaaagaaagaaagaaaagacgcacctagataatcccggagtgccgcgcgcgaggtcacattaccgcggcggcggcgctggagacgcgggggagtgtggggaggggagtggagtggaggcgctggccggagagtgacggggacacggggtgaagccgcggaggggaacgaaaaggaagcaactggagaattggagatgggccacgcaccggtggctgtgatgcatctgtggccgtcggttatagaccccacgggccaccgtaaacggcagaggctaaacccctctcttttttttttggcagtcaacggtcaaaccctttttttaaaaacagaaggaaaattttcttttgcgattaggcataattaatggttttttgagcgtacccgttcgagcaattatactgtttttcactttgatcttattgattttattgtaaatttaaaatttgcactcttatttttttacttgtcaaaaacactgttctacgacttaaatgttgtgttcagctgttagggctgggaactaatccctcgtgcatgcaagacggaacaactcatttgtgtatgattaattaagtattagctattttttacatgaatttttaaaaaaactttcgtatagaattgtttttttttttcaaaaaatacaccgtttatcaatttgaaaagcgtatgtgcggaaaacgaagaaaatgaattagaaaaatagggtaaagagcataacctaagggtgtgctctttccagcttacaggattagattctcctcgttttccattaacacgctttttaaactgctaaacagtatatttcgtacaaaaacttcctataaagaagttgttaaaaaaaccaacaaatttattcataaaaaaattatatattaatacttaattaatcatatgctaatcgtatttctcgttttgtgtgcgcctaagctgtccaccaccaccgctgaaacgatcgcaccctaagttaatgcttaataaataagtcgaaaataggagatagcaagcacatgtgtataaccatatgttaatttacatctgggacatcccaatttcccaaacacttattgtggcataaactaatttctcaagattccaaagaagacaaaagccaatgttcactcaatggtgcttatgattgcaacagccagcatgagctgtgcattgcgcgtgacaagccatagtcacgttgcttccttttgtgtaggccaccgggtaactaggatccaataaaagcggaaaagaagccaaattctcaaccatgccctacctctccaagctttatgcctggacagcatcatgcttggcacaaaagaacagaaacaagagcctaagcacagttattaacttattattagtggtgatcttccatctcaaaaaagaaaagagtggtagtatatcttgtcctaagctatgtccagccatccaggatagggtggtcctggcccccttcttcaatggaagaccatagagcatacagcaatgtgccttgttagttgttagaaagcatacagcaagatctagttgagatggatatagtattggacaatgctttagcttgctcatctgagaatcactaaagtcaaatttcacagatgaacaaaaattatgacagtatgtttggtctcaacacccactttgaacttctacagcaaatgcatgtaaaatgtcagtgtaccatattacagattacatgcacaatgaagcattccattacctccagaactgttcattacaaatgcagacagcgctacatgccaacagtatatcccagtacatatcagtccatttcattttgttacaacaacagaagccaagtatttgaaggatcaacatcaactaaggaaacaaggtcaaagaatgagttcagcatacaatttcttttgaatttgttatatttctaggggcacatgtaatatacctatatttataggttttgtataacaagtggtgcactgacgcatggtacacctgtttacaaggatacatcctacgagttctgtgggtttacctatattttgcgcagctggccatgtcacatggccaaccttggaaagtttgttcagctcaactcaaaaaccatctgaggtgaacatatattgtatcattgactccgcatcgtattgaaatttcaggagcttcactgttacataaactactgatcatggtgagaaaggaactctatgatgcatgggtaaacttcatccgttgcctgtacaagggacaaacatgtgtaaatcatgagtaagaggatgacaaaaagatttgacttttcagaattggagcag

SEQ ID NO: 78023 - DNA, 20193 bp, Oryza sativa
  unsure (1)..(20193): unsure at all n locations
agaaacattagctcatgattgggataacttatgactcactgttattaaatgatggtttaatgatagttcacgatggtcaatcgtgactggttaattaattaatgtgccaactaaaacctggtaatggtgggttgtgagcacatggttttgatggttgtgctcatgacaattaaggaccggttcacgagtttcggttgtgaaacattaaccgtgccaaccacaagccagcatgggcaacggctttatcttttgtgtagcatggttcattgcggggcaccagactgagaagtggcagagataagtccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccacaatagaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcttttgcaaatgaaaccctactatgccatcctttgttatcctgttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaggtgtacagctgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccagagctattgccaataatcaagtctatgctttaatgtggtccccttttatgcactagttgaactaagcatggctaagcatctcctaaaccaacatctagtcattttaatacccaagttatcaatggcataaggaaaacaacatatagctgagtaataggacccatcccacatgatattgtaaaacaatgcaatatttaatagaaatgcgggacatttgtaaattaggtacaatatgatcaattgtattgcatgacttgccttgctctcgcactgatggaaccacagcaacgtcttcgagaaaccacggatcgacgaaacggccgaaatctacgtgacaaacaaagcacacaagcaaaacatgctataagactactgaaacagataacaaagccatttttaatggattctacacatttttatgaatttactgagacttgaatggacttaatcggagctcggatgaattagttatgaattttagaagattcactgtgtttttactaataaagaaaaagtccttaattaattattgcgcaatatattccagggctgacgtcagcacggggtggcgcggcgccgacaagcggggcccaccggtcagcggcacggggagagagaggggaagggcgctggtacacgggcccactcggcagcggctcaaggggggggcacggctggcaagcgggccccacggctccggctccacgagccgatgtaccggccaggcccggcatcaagccggccgggcggccatggcaaggcggcggcgcgggcatgcgaccgccagcgacggcgagcggcggcgcgggcggcgggcggcggcgcgagcggcgacgaccgaaagcgacggcgagcgcgcgaagagggcggcggcgcacggggaaaaaaaaaagaaggaaaggaaggggagggagacctcaccggaggggcggcaatggccggcggagaaaaacgagggaggcggcgaagaccggcgatgccgaggtgcggacgagcgacggcgacacctagggaaagagaggagaggaattagggcggaggaaaacccccacggcgaccatccatgccggccggagtcggaggggagagagaactcaccgacgacgcgagggaaatggggtttcggtggtattccggcgacgcagagcagcggccgggaagggtcttgcggcggcgaagctagtggtggcggtggcttagtgcggcggcggctctagcgacggcggcacacggccggagtgcggcgacgggcggcggcgtaagtggcggcggtgcgagctcggtagggggcacgggatggagcggtgagagcggaaaacgagagaggagggcatggggagcattttataggcggagggggaggcggacgtggccgggaggcgctccgatttcgccggtgacgtgggggaggagagagagaaggtggggggagattcaaaatcgaatcccgcccctctcgtgcgctggcgcggccgggagacgcggggagagggcggcgacgtggcgtgggcgcggcgacgtggcgtgggcgcggggaaagcggaggaagtgggtgcggcggcagcggtttcggcgggacggcgcgagcgggagaggcgggaggtgggagacgggtccgacaggtgggccccacctgtcggcgaccccgggagggagggaggcgggcggccggctgggcctcggcctgcggccggcccagcagggaggagggggaggaaaggaggagatgggccggcggcccatccgaaagaaaggaggaaaaagagaaaaaaaagaaaaagaaaaagaaaaaggattttttttcctggaattaaaattgcactttggtgatttttaattggttaaaattatttctagggctctgaaaattccactaaaaatcctgttagtgagtttcgacatgtagaactcaagaaaaattccacatgccaaatccgattattatttgcattgattaaatagggattcatctctaggttaaattaaacaatttcttcggacgatttattttatgaatttagagcaagggaggggtacttcagggcgtgacacctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccttctaaaaatattggaaaagtagaactgttctcctccctttctcttttaattgaaccaaactaatggcacatgcacttcataatctcttttaatggttctcattcaaaaatttattccagtgttattagtaccgtacatctattactgtactaatggctcattttatcagcaaaagttttacaatattgttttatttaatcttgctgcaataaaataaatttagcatgttgattttataagtttctttcatttcttttgaaaccagttattcaaaagtacaaaatttgtaacctggtttccaactgtttcaacttatctcgcaaagcttggtttactttatttacttacctttttactttgaatttctaatctttattcaaattaatccaaaaacttgtgctattaattggataaatgtcttaactccctcctttcacttgtctttagatgccgcgctacaagcctgagtacttgtttggtgttgagggttttgtccaggagttgcgtacgatgtcctttgtcattggatttgggactgcccctttttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcagttggccgacactgagtatcgctaccatcctcgccaaccccagggaagtgaccgtggcagttaccttgagactgaaggaattgagaatgatgctaccacaaggcatttggttgagatgctgtgggctatggatgaaagccgcgcggagactgtgttagcagctcaagatcgtgaagattggaatcgtggtaagatttgcaagttagaagacaaggtggatcgtttggagaaggaactagccgcattgaagggagaagcaccacctcaaaaggccaggattcgtcttaccgcaaggaagagagctctatttgtccctcgctatcaattggcgccaaaggttcgtgtggtggagaaagaagttgctccaaccttagcagatcctccggttatcatcataagtgatgatgaagaagaagaatccaagcgcaaccattccaagattgagtgggtagctacccaagatgatgaagacgagccgaacgagccttcaatcgacctccgatgctcggaagaactagagtgccatgtctagccgttgtcttagatcgttgtgttagtttgcttgttttaagtttggttgtgtgtgtgtgggtcttgcatgtgatttacatcagtggtgggatgtaagtgcatgtgtttgtttgcttttgagtgttaggaagttggtgagtttagtggtgtgagagtcttcagtttgtaataatgaaactcagttaagatcaataaaagttaaagtaattatctgtcctaagtagtttcccccggtttctcttcttgtgccctgtccatgccagatggtgaacactcgcagcaacgggaatggccccaacaacaacaacaacaataacaacaacaatgaagggaacccaacccttgctcaagttcttgctcaacagactcagttaatgaacatgatgatgcagcaacttcagaatcagcaaaaccagggaaataaccatgcacctccccagaacaagttagcagaatttcttcgtgtgaggccgcctattttctctagtaccactaatcctgttgaagctggtgattggttgcatgccatagagaagaagttggatttgcttcagtgcactgatcaggagaaggtctcatttgcatcacaccagttgcatggccctgcctctgaatggtgggatcacttccgcctgaataggactactgctgaacctatcacttggcttgaattcaccgctgctttccggaagacgcatataccatcgggagtggtgtctctcaagaagaaggagttcaggtcgctcacccagggatctcgctctgttacggagtatttgcacgagttcaatcgtctggctcgttatgctccggaagatgttcgcaatgatgaagagcgccaggagaagttcttggaaggacttaatgatgagctttcttacccactcatgactggagattattctgatttccagaagttggtggataaggctattcgtcaggaggacaaatacaatcgcatggagcagaagaaacgccggattgctcaattcaagacacaacaggggaataatcagaagccgcgtcttactttaggaccccagtctgtgccacaggggggttcttcgtctgttgttcgtccgcagcgtcagttcttcaacaacaatgctggcaacaacatccgcaatcaagctccacgtcctgttgcagctccaacacagcaacagcctgccaagagggagcaaggcaacaagcccgtggtgtgtttcaactgtggagacccaggacattatgctgacaagtgtccgaagccccgacgtgtgaaggttgtccctgtccagagcagctctaccgcactagcattaaaggcccgtgtcaatcatgttgctgctgcagaagctcaagatgctccagatgtgattttgggtacgtttcctgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctccttgcaacgtagcccctctgtcagaatagaaattcaaggagtaccatttctggccaatcttatactgttagaatccaaagaccttgatgtcatcctagggatggactggttagccagacataaaggtgtgatagactgtgccaacagaaaagtaactctcaccagcaatgatggtcgagttgtaactgttcatgtattgtcttctgagtctttaaggtcaagactgaaccaaataactttggaagagattcctatagtccgggagtatcccgatgtgttcccagatgatttacctggtatgccgccgaaaagggatatagagttcagaatagatttggtacctggaacaactccgatccataagagaccttatagaatggcagccaatgagttggcagaagttaagaggcaagtagacgatttgcttcagaaaggatacatcagaccgagttcatctccatggggagctccagttatttttgtggaaaagaaagaccatacccagaggatgtgtgtggactatcgtgccctaaatgatgtgactatcaagaataagtacccgctacccagaattgatgatttgtttgatcagcttaaaggtgccaccgttttctccaagatcgatcttcgatcagggtatcaccagttgagaatcaaagaggaagatatacctaagacagcttttaccactaggtatggattgttcgaatgtactgttatgtcttttggacttaccaatgcccctgctttcttcatgaacttgatgaataaggtgtttatggaatacctagacaagttcgtggtggtatttattgatgacattcttatctactctcgaaccaaagaagagcatgaagaacatcttcgccttgcattggagaagctacgagaacatcaactgtatgctaagtttagcaagtgtgaattttggttgtctgaagtgaagttccttggtcacgtcatctcagcaggaggagttgccgttgacctagtaatgtggaatccgtaaccaactggaaacaaccgaagacagtttcagagatccgcagtttcttaggcctcgcaggttattatcggaggtttatagagaatttttccaagattgctaagcccatgacacgactgcttcagaaagatgtgaagtacaagtggtcggaataatgtgagcagagttttcaagagttgaagaatcgcttgatatcagctcctatcttgattttacctgatccaaagaagggttttcaagagtattgcgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaagatttggcgtcattatcttttcggtactcgtacagaggtgtataccgatcacaagagtttaaagtatatctttactcagccggatctgaacatgagacagaggagatggttggaattaattaaggattatgacatgggaattcattatcacccgggaaaggctaatgttgtagcagatgctcttagcaggaaaggctattgcaatgctacggaaggacgacagttgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaagaatatgagaagaggaaaagctatcggtttcatggaggatgagcaaggaactgtatggttgggcgagagaatctgtgtccccgacaacaaagatttaaaagatgcaattctgaaagaagctcatgatactttatattccattcaccctggtagtactaagatgtaccaggatctcaaggaaagattttggtgggcaagtatgaagcgtgaaatcgcagaatacgtagcagtatgtgatgtctgtcagcgagtcaaggcagaacatcaaaaacctgccggtttgttgcagcctttgaagattcctgaatggaaatgggaagaaatcggtatggattttatcactggtctacccagaacgtcatcaggccatgactctatttgggtgatagtcgacagacttaccaaagtggctcatttcatcccagtgaagacaacatattccggaagtcggttggcggaattgtatatggcaaggattgtgtgtttgcatggcgttcctaagaagatagtgtctgatcgaggcagtcagtttacttcaaatttttggaagaagcttcaggaagagatgggttctaagctgaactttagtactgcttatcatccgcaaacagatggacaaactgaaagggtgaatcagattttggaagacatgttgagagcttgtgctttagatttcggtggaagttgggataagaatctaccttatgcagaatttccgtataacaacagttatcaagctagtcttcagatggctccttacgaagcactgtatggtcggaagtgccgcactccgcttttgtgggatcaaacgggagaacgtcaggttttcgggacggatatcctaagggaagcagaagaaaaggtgaaaatcattcaagaaagattgcgagtggcccagtctcgacataagagttatgccgacaatcgccgcagagatttgagttttgaagaaggagattatgtgtatcttcgtgtcacgcctcttcgaggagttcatcgtttccacaccaaaggaaaattggcaccgcgttttgtgggaccttataagattgtcagtagaagaggagaggttgcttatcagttagagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtattttggaaatagatgagagaaggaccaggaatcgagttatccgcttttgcaaagtccagtggagtaatcactcggaagaagaatcaacttgggaacgagaagatgaattgaagtcagctcatccgcatctgttcgccagttcttctgaatctcgaggacgagattctgttcaaggggggtaggtttgtcacaccctgagaattcaaaatatgtaaattattgtttaaatggaatttttagaatttatttttaaaagcctagaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatctaaattgaaaaaggttttaaaaagtcttcttttggctttgggccgaaagtcggcccaaaaccttctctctctctctccccggcccaagtcggcccagtccgcagccgagccgcccgcgcgcgccctcgctgccgctgacaggtgggtcccgcttgtcagtcgtcgtcttcctcgcgcagccgccgcccgaaaccctagcgccgcgccgccgccgttcctttccaaatccggccgcccctttccttctccggccgaattgatagaggggaaatgatcctcgggatctcctctaccttttctcctttggaaacatcggctaaatcgttttggaagttcgtggaatcgagttcgattcggatcggcctctttccttcaagccacgaagtttcctcctcgtcgccggccgccgtgggccttcgtcgccgcctccgagcccctttaaaaggaccccgagctcttctctacccgccgccacccttgccttcgcctctcgtcgtcggaaatgccctagcgccgtgtgccctagcgccgtcgtcgccgccgtcgctccagccgtgcgccgccgccgttccagacgtcgccgtcgctcgggaaggacgtcatcgtggtcgccaagtcgtcgccgtcctcgtctgccgcttcgccaccgtcggagaccgccggagcatcgtcgccgccgtcgacccgaagagcttcgccgcttcctcctcgtcgccgtcgccgtccgttgatcttccgccgtcgctttggtcgccggtgagtccgtcgtgccgtccgctacccgttggtgccctccgttcgtgccgtagtgccgccgttcgccggcgagcgtgcgccgtccgagccgccgagccgccgccgccggtggtgacatcaccgctgacgtcatcggggccgttcgtcgtagaccggtcgtggaccgatcgatctcggccgtccgttttggatcaagtcgatctcggccgtccgttcgtgtgaaccgccgccgtgcgcccggtccaccgcaaaccctagcctgctgacgcaataaatccccttttccttttcaaaaataattcattattgcgtcataattcaattaaaatcaatataagtgttttaatccgattaaatcttcaaaaattcatatctaattcatcttagctccgatttagttggttcaagtctctaaatttttctaaaattgagatctacatgttaaaaatatccacatgtactgttcatgcttgtttatgtgctgttttggtgtttttgctcttttctgtttagattccgtcttttccggagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcccttttgttcttgattactttattccttgataccttgggttattataacttgactagttgagctttatatattggttcaactagatattagatataattgcttagccctgcttagaaacattagctcactattgggataacttatgactcactgttatttaatgatggtttaatgatagttcacgatggtcaatcgtgactggttaattaattaatgtgccaactaaaacctggtaatggtgggttgtgagcacatggttttgatggttgtgctcatgacaattaaggaccggttcacgagtttcggttgtgaaacattaaccgtgccaaccacaagccagcatgggcaacggctttatcttttgtgtagcatggttcattgcggggcaccagactgagaagtggcggagataagcccacgggggtcgctggggagtccatgccttgtttataagggggtgattatgatctaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccacaatagaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgaagcccttgtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacattaggagaacttaagattaatatatcatgccaaaatacacaatttttttcacatgaatatatactaatttatccttgagctactaacttatcatataaaagataagctcgagctcagctcgacaaagctcgtgagcttgcagctaggctcgagttcggatcattaagagttcgaaccgcgctccaatctagtatgagcctcacgagctcgagcttttttgacagtcctaattggaagtagcaatgataggtcagcctcactgacttatttttaactggactgccacgtaggttcaaaactactccagactaagttgttgggggactgtggggtaatttgcaccattgcaatagttcaagggtgtaatttggactttttcctcttttgtatacttccttttcttttttaaaaaatacagtacaaacgcaagcctttcactcccactgggtgatcatcgctaccactgccccaaccaagtgtgttgccacactccgtctcgacgacaccataccaccgccggctaggctagtcattgtgtgatcccatgtcccgtctcctaaccacaagacatgtctcagcctcaccgccaccggcgccttcttactcactcatctcctgtcacacccaaagttttcccttcccttaggtttcaaatcactaataaatggcttcaagaatttgctttggttaaccactagaaaaccctagttaacaatacatttaatagtcggaattgtcagggagaatttttttcgaaatctctttgctctaaaaatcactaacaagacttaaagagtcaatatcagatcacggaggcaatgttgctaagttaaaagtggcaagttaattcttcttcctttgcctttggtcgtgaattgtgcccaattcactcccctctcagcccgtggtcttgttttgcatgaggaaccatatacgtgtcagtttgcggaaccatttcctttcctttccgtataggtagtcgagttgtctagccgtaggtgcaaccctaggttcctaccggccaatcgtttgccgtaccggggctttaccgtgaatcgtgtctagcccgccggtttagctgcagtcgttgttgtgtcgttcactcgttcatttgaacgaggtgttccctgtggttcgttcgttcgtccgtcccgagtcgtcctttaggttagagccgttcagagccgccggctcctttcaccggtttcgattgatcatttgggtgatcctgtgtcacgtagaattgactcgttgagtcggtatcacgtgaggcacgcttgccaatcaatctatcctttgatcctatgttctttcgggcttaaatccctgtcaattgattaaggtttttctgttaatagtaatagcacagagcatcttctaaaattcataacttaataatctgagctccgttttaacccattcaaattgcagtgaattcgttaaatgtcaagaatccattaaaattggtttcttttgttgtttcagtagctttttagcatgtatttattgtgtaccttgtttgtcgtttagactccggcacttctgacgctccggtttattttgaagtggtcgccgaggtcccgtcaattgaagagcaaggcaagtcatacagatatcattgatcatattgagcctatttgcaaaaacccctgcttttctctcaaaattgcattacttttataatgtcatgtgggatggtttctacccatactcagcctttgtttaccttaattcattgatattctgggataaaaatttgactagatgattggtctaggattgcttagccaagcttagatcaactagctcacaatgggattcactataatttagtccttaatttgattatgctatgccttcttggcatatggttaattaattaaaatatgctttacttggtgggtcgtgggcacatgcatgatgatttatttggtggttgtgcccatgacaattaaggaccggttctcgggaatccctggaagatatactcgtactaatcataagccatatgggctctaggctgaatcttaagtatatattttctagctagcacaccatttgcgaggatagatgtgatggagtatggatggacctgnattttggtctatgctgcttccggatttacctaggcacgagcggaggctgcctgctcctggatttggagtggggcgaaactctgagtggcatgctgttaggggtgtatatggagggtttgtcacgatttccccctttgcagtatcgtggcggtacttggngcatggtttcatgtgtggaatcgtgtcttgtgggtaaagttgtacacctctaatcagagtaaaactattcgaatagccgtgcccacggttattgggcggtcaaccagctcaccatgattagtctcaccttaataatttgccttaatgaactagtgtagttcaggtggttttggtttgggcctgtcgcaacgtggtttagcgttggacagtgatgatgttaatactacttaattatatattgttttactgctttcaacttatgatttacaaatgatgtttttactgcaaaatatcctatgagccaatcctttgttttatccttgcatcataccttccccttggtatgacttgttgagtacggtggttgtactcagtcttacttctttttcccaatcccctagaagcagaagttggttcagatggtgagttctatgaagtttaggattgtgccagccgtcaagagtttgcctgtggagttatggaggaagcttcgcgttgctgtgaagattaaatttagttctctagttttttcgctgcgtatgagtttattttgttatttttgtaaaacgtggaactatatcaaattgtcatctgtgtactatagttgatgtctggacagaggttaaatgcacagatagccggtgattcgggttattaaatccttgggtgagacatctccaccgcccctaattgttcttccatcgccctagtcatcactataaagccgccctgaaccccctcccccccccccctccctagtaacctccaaccttgaaaccctaatccggtaaagcctatcggagttcgttagggtgttagtgatgaggcttgccaaggaggttgtggtcgccattgtcgtgactgccaccatcattgtccttcacgctcgctgtttgatctgatgacattcatcatagtctattgagatttttgggaaatgtaagtaaaccaatgaaagatacaattactttggtaactctgtgaacatatcctatgcacataagctttccgtgcacaccaactagcaaatgttacgaataattatacaaaaaaaattgaacatttacttataatagtattacacatatatgcaaagtcttattttcaaattaattatattttaaccctaaaaaaagtgaaaaatctgacaactttttgagttaaaatatattagaattttgttttttttttgggttacggctaaaatataacaaatttgaagataagatttcacacttaggtgtaatactattgaaactatgtgtctaattttttctagaattttatgtgacatttgttaattgatgtgtatggaaaatttgtgtgcatagtatatattcctggtaagtcctatctacatttatcattgtcatcattcttgaggctcttgataccatccatttggccttgtttctttctccatgtcttatcttatgtttgcactgaactctcaaggtttaaggtcatacctacaacaaacccagtgaacatggagtgtggtgagctaacaagccgggttggttgtggtcacatggactcgtcggctcaacgagtaaccgaaccataaatgcatgcagtagctaagctaggcccagccacccagaaattacgccggtcgaatgtggtcacatccacagctccagacctgaaccgccgatggaaaactctgaaaactgaagcgaatagatgaacatgctgaaaaatcccagcatcaggcatcagcttcgtgcctcgagcccgtcccgatcccgaccggagtactacgagctaccactacctcctccgttgactccggcggccatggccatggctgcaagcacgatggtacaagtgtgtactggtagtagaagtagtaccaatgtacgagcacagtacattcttggcaagtgagcagtacagtggtagtaatgatggctttgctgctgctgctgctgtgctgatgatgatgatgacaagatcatcgtggcctgtagcagcgtagcgtgtcgcagtttgaggagaggagaaaagaaatggtgaatttgtgatgaactgatgatgcatgcagagtaaaactagagcgaatttgcaatttggggtcagattgattgattgggtgatggtggtgatttggtattccatattcacagcggcaaatctcctacaacaagaagtggatcaaaactaatgaaaagaagaaaccaaagagaggaagaagaagacgcaagaaacagagcaagaagatgaacaagatggggacagtggaggaatccatgtcctcttcagggtttcttgatctcttctcttccgtcgttgctgctcctgctgttcgttatttattcctcgatgacggcgagctccggccggccctcgccttccgggatcgccaccagcaccggccgccagctccgccgcatcagcaggctccgcagcccgccggaaccgaacctcctgcctccaccgccgcctccgcctccgccgccatgacccgacctgaagccgccaatgcccccaccttcgtcgtcatcgccgccgcggcgtcgcgccgcctccggcgacgcgacgaacagatcccgcagcgtgcggccgccgcggcccacgagcggcttcctgtactcctcctgctcccgcgcggcggccgcctccttccccccaccaccaccacccccgccgcagccgcccacgccgacgcggcgggacaggaagcgccgcagccggccgtcgacgccgccgcggcgcctgcggcggcggcggaggcggtacccggggctggccccggcgtacgacggcgcggggctgcgcgacgggctcggcgccgccgcccccgccgcgcaccgcgtcgccagcagcttgaaccgctgcggcagcgtcgccatggctgccgccgcctcgccccccctctctctctctctctttctctatctgtttcagtgtgcgtgatttagatgggacttggattccgtgcgggtgggattcccgtgtgcggtgagcgcgtggagattcgtgcgggatacgatgatggacggctgcgatggagtggactggcactggacgggggtgatcaatggagggggagggtggatcgggttgggggcttttgtttgggaggggtgaggcggaaatgatggctcaacggtggaggatgaaaggtgtggtctacacatgcaaagcgtggaatcgattcgatgggttgatgattggaattgggttttcttcgaggagattatgcctttcatgataattatttctaatatctgttttattagaatataagcttttttttaaggtgtagctatatttatggcgccgtatttttcaccaaaaaatagtcggcgtttatttatattgtaagtctctaaattacgtatataattttagtgtatttataatgtaaatatcaaaattacatatgtaaatcctaaaattacatatgtaaattcaaaaattacatactaattatatatataagttaggtgtaagcgggtgtaagtgaggtgtaattactgtgtaagtagctaaaaaaatcgactatagcatgtgtcgacataattttagctaatccgtttttaggttgtttagcaaatattaaggtttaagccaatttaccctatttagtcaattgcgtctacagtaaataaatttggtaggtgggtgcgatctagttcaaaaacttgaaaaatgagtatataggtacaacaacttggctagtgcatgcattttggttaaaagatcaatattccacaccatactttttatacaatataaaaaaagcagctaataatgccatctcgacaaggatctacatgtattatgtattgctttcaatttgttagttataataataaaataatctatcgatttgaaaccgaaagatatatgattatcaaaattaagtgcatgcaaatagcataatttccgagcgatttgattaatcaacatattcattatcttgggttatgaacatggcaaaacacgaaattgatccaatgatctactagcagttaagcttataataccaggattaatccaaggtgtgtatcaatatttttgactaaaatgcacgtggttgtcaagtttatatacaattctactcatttttcaagttcttacactaaatcgcacgcatctacaccaagttcttgtaccgtgggtgcaatttactccattctctttgtcaccttggtagcctaattttgaattttaaattactaacattcccctttcaaacgcctgattaactgaaaatgaatgaatttctgtatattcaattgttttgaaatacttgaactgtggtaagtaaattgtagagatgcttatagttagaacagatggaataggtttgttgtactctcttcggtccaaaacaatgttagacctttcaaaattaatgaaatgcaactttcaccacctaattctttcacataaattaaaagttattacatcaatcaataaatatataatgttacgaaagcttttataacaaacacctgaccatgttgcggactaagctagttggtttccttatagttgaaattgcacatcggggtttaagtgattccaagagtacgggtgcttaaatttacagataattattctttaacaagactttgttaccctcaatatgtacgtgttg

SEQ ID NO: 78024 - DNA, 1643 bp, Oryza sativa
aggtgcatgtactactagtgagtcccaattaataagtactttctccgctcctataaaaaaccaataagtattagatgtgacccattctggtaatacgaatttggatatatctctatctatatttattatagatagaatttattatattcagttatagatttctttgtttagtccacgagcgcgcaggtgcaaggatgcttcctccttttcctctcctcgtgcagggccagcaacagccatgcttgaccaggtcgtccatcgcacggcgcatgcacgcgcgcgccgtgggcgtgtgcatggcgccatgtgcgcggacatcggcaacagcgacgcccgcccgccggcgcgcggccgccgggctgcgacccacgcccatatgccacgcggctccctcccagtcccatgcagatgcacatgacaacgccacgcatacctcacgtggcaaattgggccggcatcacgtggcgagaccgaccgctcgcgcgcccgcgcatgcacgacccaacccgcgggcgggcgggcggccgcgctactattgctagctagctgcatcgatctctataagagaaggtacaataacagtttataaactagctataaccacatattaaaaaaaaaagagaagagagagaataaagtgggctataaatttatagccggctgcaacacgaactctaatacgttatgagtgtatgagaggtaggaccgggtataaataatgtagtatatttttatagataattattatattaatggactattagattagctatagataatttagagttaacggttggctatactattgaacttgctctaatatctggcttgtgcagcgcccgccgtatcgtacgtaacgtgatcgagcgagcaccgaacggcgtgcgggcaaacacatgcgcgcacgcggcccgcgccccgcgccgcgcgttgcgtgctacgtactccatccatcctaaaataactcgattcttaagcttatgtgtctaacatttaaccatccgtcttatttaaaaaaattataaaaaaattaaaaagataaatcatgtataaaatattattcttgttttattatctaacaacaataaaaatagtaatcataaaaaaaatttcatataagatggacagtcaaacgtagtacacggaaacttaggaattgagttttttttatggagtttaatggcctttatccccccgggtctgcagccacgcgcgcatgtacctgatcgggctctggttacaagcgcggatgagatgaggtcgaatccaaggaaatttagaggatgaagacggcagagccgcagagggatcgaggaggagaatggaactgtgcaagtgtcgtcgtcgtcgtcgcgggtcatatgcactgcccggacacgggcacaggcacgcggggacggacggagttcacattctctatcataacaatatactatcattataactatagttactgatgatgtgtttgagtaataagaggatagatcatgtattaattggtagctatactaatagcaataagaggatgatacccaacttttgtatatactaatgatgtctcatgctttgccgcgggattatgttagatattggagaaatgatgaaataatttacatcaaaacaaataaatgatgaagtactgt

SEQ ID NO: 78025 - DNA, 664 bp, Oryza sativa
cattcagtatatagcgaatgatatgtttgtgcccgtggattgaacaaaggaaacccgagcgcatgcataataactgcattttaagacataatacaacattatattagatgccggcgtaaagagttatttttaggagatgttacctgctataaatgctcctttaaataactgatcttatcaaataggacaaatagtgatgcatatgatgtaacaaacaactctcagatgcatactgagaaaatatcctgtctgacaccattttcctatgatgcatgaacatacagagaaaagggccatggatgcgggccatttattatcactacagatatataatggatgatgcactataaggcgatgaactctgactactgcattgttctctcatataagatgccaaaaaccacgatgctgtttcccgtaacgatcctgatattgtcaaatttctcatggtgatggctctttgcaatacagttgttcctatcaaaaggtaagtggcatcttcttcatgttacagtactgaactttgaaaatacctgctgtttagttgttccttataactttcctaatctccagcaatgatggtactataacataccaagcacaatcacaagacgaggaaactttggtcactgctgcatccaaactaaatatggcgctcgtgagt

SEQ ID NO: 78026 - DNA, 21984 bp, Oryza sativa
  unsure (1)..(21984): unsure at all n locations
gcgggacaaagggtcgcgatctcgtgagggtgagctaactccaaaaacccgtcctcagttcggattttcagttcaataatttaagctaaattgtattgtttgcgattttgaagacttttatctgggtatatgaatgtgcaagcatcattggcgatgaattacaagaaaaaaaaagttttataacatcataagacacaagaaacgacgcatcatatactatagcatggtatcggcgcgggacggcagcctcttgaagaagttgccggcggccgacggcatccggctccggaaccgcgggtggcggagcaggtacagcccggcgacgagcgccaccacccggggcggcgtggcgtacgccacgacggcggcggcgaggcaggccgccgtgaacaccgccgtcgccctcgggtccctccacgccagcagcgaccgcacccgctccccctgcgtcgccacgtcgctgaccaccgcctggatcctcccggccaccgtccgcagccggtcgtaccgcgcgcgcaccacgccgtcgggcctcgacgtcgggaacgtgtccgcctcctcgtcgaactcgtcggcgccggccgcctcggcgcacgacagccccgcgtccgcctgcggcgggcggcgcggccgccgccgatagctccaggcgccggccacggacgcgtagaggaacgcggtcggcaggatgagctccgggaagcaggcgaaggtgacgagcaggaggtgcgcgaggatcgtcgtcgcggggctcctccagtggcacacgtcggcgagccaccgcgccgcgccggcggcgccggagagcagcgccgtggcgcggaggaagttggccctgctccgccggatgctccacaggtgggagccggcgtcgagcatgtactccacgacctcccgccgcagcggcggctcggcgcggcccagccgcgccgccacgacgcccaccgcctgccgcctgaggccgtcgagctgcgcgacggcgaaggggtggacgtagtgcgccccggggaggagcggctcgccgtagaggcgcaagacgctggcgagggacaggcaggtgaggcgcacggcgaggcagacgtcgccgttcttgcgcaaccccgacgggtgcagcaccacgagccggtgcgcgttggtgtacaccctgtccatctccagcgtcgagaggcgtatcctcaccttgccgatcctctggtccttgccgccgccgccgccattgccgaggttgcagttgtcgaacacggcgagcgtgagcaccgtgcacgggtcgtagacctcccaggtgtactgctcgttccaccgcggggtggaggagtcgacgacggtgcgggtgcgcacccacttgtggccgtacttggcgacgcagtacgcgtcggtggtgccccggccgccgtcggcggcggtcttcatcggggggaggccctgcgcgccgaggacgccgacctcgagcacgccgatgggcgggcgccacagctgcctcgccgtggggcgcgtgtcgctggcgtacatggcgggctcgtccatgacgtggtaggcgccgtcgaggcacgcccggaggtgcacgcggccggcgaaggcgggctcctccggcgagtgtcgcggccggtgcacgaacggctccaggctgaaccactgcgactgcgtgtgcgtggccgcggccgcgccgcgccggtcgaggcgcctctcgaagagggtgagcggcagcacggcgcggctgacgatctcgtccttgcccgggtgcgccgcccgggcctcgatgacgagcaccgccggctcgtcgaacggctccgccacgacgaacaccagctcctcgttccacgatgggctcgtcgggcggcagcacggcttggtccggagcgtcacgccgccgacttgcaccttgacgacgacgaaggcctcgccgtgccgtcccttgtcgccgcctgcgccggcgacggcgcccgggacgacgtcctgcgcctcgagcacgcttatccggaggtaccacagcttcggcgtcacgtacaccttggaccgcgtgctctgcacggccgccacgccgtcgccgcctccgcgcaccgacgccgcgccggcgtgccacgcgtccgcgaacgcctcgtcggcctgcgtgccgacccacaccgcgagcatgacctctccctgcaccgccctgccgcctccgccgccgacgtcctcgaggcggtaccactgcggcgcgagcgggctgtccggcggcacgcgcacgggcgcctcgccgacatcgaacgcgacccttccaacgtagccgtctcgcgccaccgccgccacggcgtccttgtccctgacgaacacctcgagcaccgaggcctggacgcgctcccgcgagaaggcgaacacctggttccactccggcgccgccttccgctcgtggtgccgcgttgtgccccggtagttcccgagccgcacctccacgtacgggttgcacccgccgccgccggcgaccgtgctcgccgccgccgtgagcccgcgcgccctgacgacgcgcacgtacaggtagtgcatctgctccacgaggtcgtacgcgctcgccaccctctcgccggagccaacgcccatccaaccaccgccgccgccgccgccacccgccggccacgtctccctgacctgcggccgtgtcggtgtcgccattgcctccttggccatcgccggcggcgcctgtgcacggaacacgtacggacacgccatgacccggctcaccgtcgtctccggctcgccgtcagggcggttcaccggtcggcttttcccgtcaccggcaagggaagccatgcaaaggtggcgccatcagctagtacgacgagccaccacgcaatggttttttgtctttgctgtttctaagcaaaatctttgcagaagcttgaagctatcagtgagcccacaagagtacggcttactaaggtcaagtgtaaaatggaaaaggttggtgagtgagatcgagtgatcgcgccagtttcgatggattcggaattatgggggaataaagatgagatggtggggttacttttttttttgtgtgtgtttttgggtttgaataagaacaggagtcttggtgaagattcctgggatttttctcacgaaactgcatgtgtttgtgctgctctcctgtaacctgtcgagttatttagttttcagggtgatctgcattggaattcatgtctttttctttcatgtttcagaactaaaaggaaggtttatctgtagtatcacattttttttgtgataaatgagagtggaagaaattcgactttcatataatatcttaatagaattccatgtaatgatcaatgcattttttggattctatccttttgtcgaagtggaatcgtagaacagaatgtgatacgatgagataaaatgcaatagaaacaaggatagcgaacgggttacctactcctaagggtcaaagcaagccctttgattcaattctttattcttacattaaagaatgaatcaaatctccccaagtnnnnnnnnnnnnnnnnnnnnnnnnnnnnnnnnnnnnnnnnnnnnnnnnnnnnnnnctgaggaataagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtctaattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatctaatttggttatatcatggactcaaaaaacggatctgaatgtgattgaaatgcacgatcttcacaggtatcacttttcacgatacgtaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattagaaagttacggaaggagatccatcattttgcaatgaaaactacataaaaaactctggacaattcgaaatcaagccaaacgtcttaatacatatgcaaaaaaattcattattggcccaccattgattagaagatttaacttgtatgaatcgctattggtttgatacgaataatggcagttgtttcagtatgttaaggatacagatatatccataattcatttagagttacttaatagcctatttcttataccatatctctatcccgtgaaattcttgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaataaaggatatgagtctaccgcttacaagaaaagatctcatgatagtcaatatgggccctcagcacccatcaatgcatggtgttcttcgactgatcgttactctcgatggtgaagatgttattgattgtgaatccatattaggctatttacacagaggaatggaaaaaatcgcggaaaaccgaactattatacaatacttaccttatgtaacacgttgggattatttagctactatgtttacagaagcaataacggtaaatgcaccagaattcttggagaatattcaaataccccaaagagccagctatattaggataattatgttagaattgagccgtatagcttctcacttgttatggcttggaccttttatggcagatctcggtgcgcagactccttttttatatatttttagagagagagaattaatatatgatctatttgaagctgctacaagtatgcgaatgatgcataattactttcgcatcggaggagttgctgccgatctgccttatggatggatcgataaatgtttagatttctgtgattattttttacgagttattgaatatcaacaacttattacacagaatcccatttttttggaacgagttgagggagttggttttattagcggagaagaagctgtaaattggggcttatcgggccccatgttacgagcttctggaatacaatgggatcttcgtaaagttgatctttacgagtcttacaatcaattcgattggaaagtccaatggcaaaaagaaggggattcattagcacgctatttagtacgaatcgatgaaatgagggaatcaatcaaaattattcaacaggctgtagaaaaaattcctgggggcccttatgagaatttagaagtccgacgctttaagaaagcaaagaattccgaagggaatgattttgaatatcgatttcttggtaaaaaaccttcacccaattttgaattgtcaaaacaagagctttatgcaagagtggaagccccaaaaggtgaattaggaatttatctggtaggagatgatagtcttttcccctggagatggaaaattcgtccacccggttttattaatttgcaaattcttcctcagctagtcaaaaaaaatgaaattggctgatatcatgacgatattaggtagtatagatatcattatgggagaagttgatcgttgaaataataatagacagggtacaggtagaagctatcaattctttttcgaacttggaattattaaaagaagtctatggactgatatggattctacccattttgaccctcttactgggaatcacaatagaagtactcgtaattgtgtggttagaaagagaaatattcgcatcgatacaacaacgtattggtcctgaatatgctggcccccgggactgcttcaagctatagcagatggaactaaactactttttaaagaggatatcttgccatcccgaggggatattcccttatttagcattggaccgtctatagcagccatatcaattttattaagttttttagttattcctttgggatatcgctttgttttagcggatcttagtattgttttatcgatttgttacttgtctctcccccttctgaataagtagtggagtgtacccattgtaccgagttgaggtgatattctgccaacagcatatcatgataacaacttggctggaaattgcaggatcattcagaacaaatatttggtaactctgaaaatggtgctcgcggttcgccgctgtttaagcctggcactgaaagtgtttgccgcttgattaaagctgtaattttgtgttctgaagttttaacatataaacccagaaaatatatggccatcatttttactgaattaggcacttaggcctcactttccttgtgcgtttcgttttaaaaaagaacgatcttacagtttttgtgccctgcagtattcagcaatgtacaactgttggtagctgacggtagtctcatgtcaatcttgctctccaaatatcgtagacaaacgtaagcaaaaactcttctctgaagccagaaatgtttctatcagctgtgataattatatgataaagacgaaggtgcacattgcgtacttgtttcgaaaaagcgaaagtgattcagaggcttttggcgcctggacctggtttttgctttaaccaaagaagctcctttttttttatctcgtttcatctttattctccccagttaccatttaactatattgaccaatggctatagaagtctaatatagcattataccatttaattatttttaattttcattgggcaaatacaaagatcaatgtagggtctactatagctcttcaagaactaaattttactttgtactattatgaaatcaagatatattttttgcctactgatttgtttatcctcctcgatatttcacccgatgttttgtttttgtttttgtttctcctttcactcattgctctggtttaagtatacatgctttatcaaaggtcatgttcccagtagtagagaaatagccaatgcactacattgacttatgtagcacatcataaggcagcactattatcactttagtgccaaatggccagcagatagggtctaccatgtgaatctgaacaaaatctaataacttcacagtcttcagattttacaaagattaggtaagattgatctgaacagctttgtttaccgagttttgctgcttttattctgttctcgtcttactttcaagttgttctgtggttactacatgagatatcaaatggattgtttttttataccagtacagttattatctttcgccatatgttttctgaagtcataaaaacaactgaacgatagatgcagccaggaagtcgggcaggttttgctcggtaagcaactatagccaactacacatgtgcagatgagtgacaggtagtaccaatcttcatttagtcaagtgaatggcagcaaaaactagggtgaaatgccttgcaagtttgatcaagctttgtcagccacagccactccagttttcctctctttttcggggacaccccagtcttcctcatggcagttttggtgcttcactattggcagcaggtattgtgcattcttgctatacttcaaaatattctgcaaggaacgccatacatcaagagtacagaaacacatatgacgacagtgtctgaattgcctagaacacatcatctttgtattcaagacaaagcggtacctttatagagtacatcagcttgtataacaatgaaacgcatgaattacacaaaggtctaaaaacatgcatacagtagtggttcgtgcaatattgcagcaaaaacaagtatttctacagagttcagttgttccttggtccactgcaactagtagtagaacacatggttctacaatagcataaaccactgccagtgacagcacagctgacacggtggcacgagctacagttcagttgttctactgcagaagaatgagccattgccattgacagcacacctggcacttccagctgttaatcctagaactaggtcctcgagcagagcaccatgcaatggtaagcctagaaggagaatagcagcagcacattgagcagtttaagttatcagatatggaagcagcaggcaagagggaagaagtctgagatggactttctccccttcccaactatgaagcagagcatacaccttaacgcatcgacatgagtgtgcgcctctggatggccctcttggaaggctgagcagccgccgccttcggagttctcttcaggtttctcctcaccatcttctctatctgctctattgagctggacagtttcttctccatatcatccagaaggactggatccatcggcttggacggggtaacaagtgatgtttcagatggcgaggagaaaatcttcagactgtccttggccaagctagatgcaggggtcgcaacaatttgagttgagttgatgccaggttcaacatcaagggagtcccgaacttcagtgcaatggggagtattctgctcaggtgtctggcttcgctgctgagcagcagcaatccttaagcggcttctctgaatagcctgaaagtcttaagtcagattagctgcaccagcaaggaaaaagcaaagtagactataacattcatgtgactaacgcaagtacagctgaaaaatatcagtactcatgtcatataaattcagattcactgaaagtctatacaaatgttaatttaaattttgcagtggttagatggtggatatgtgctttgagcttaactaagaaaggccaacatcatgcccagcaaatagtaattcagaatatatatatggaaatcggatcgactagaaaatacatcacttgacttgagcaatgctatagaaacacttcaatgttttccatacaggtaataacattgtggtatagtaagatgaagccgttttgactcaaaatggcagtatcaacatatgtacaacagtacacattaagaaattatcgacctaaagcatgagtgcaagaccacaggcgctcgacacaacaattgcccaaaggagggtataacggatgccttagaattcatttgaagagagaacaaggcctcataatactacaagatcaagaaactagaaaaataattcaagatcacaaactaagctactacatgcacatacgcaaagtaaagtatcatggacacttaataggcaccaggaaacaggaaaatgcattacagaatactatgttaattgttaaacatgaaacaaaccaacgtaatgttctcagacgatcaatgcgggtaaacggcaccagaagttgccttaaaattccaactagcactttttaactaaaatatcttgttatgagtaggttactataacaaattgcttcacatggccattggttaagacaaaaatcaccatatataacgacgcggtactaaaatcttaaatagcacaaaacaaacaattccagaatcaatgtagacaaaaaataaacagcgtatcacacatttattgcattttttccattttgcaactatgatcaagtccttaacagacaccatacccactgaattgaacataccttttccgcgaggcgattaaatcacacattcacaatgtcacatcatttatactgcatgatccatatcataatctgaaagaagctttcaatcacctttgcaatcgccgtgatgtcacgcaacggcgtcctcgggtaccaatcaggaagtgggcttctcctctttgtggctgtggccttcacagcccaaaccgggggcacgttctccttgttgttcgatggccgtatgaaccgccgagccaacggcttcccggggcccctcgccgcaagagcacccggcgaggccaccctcctgatgaagaacccgccaccgccggagagctcgccaagggccgtcctcttgctatccctcatctcaggcatattgctgtaatctgcaagtagcagaagaggcaccgatgggtaagaacacgccaaacgcatcaaaagatcagggaaatgggcacatattagcctcacatccttggtcttctctctgatccttacttctactcgtatgaatcctagctagagttccttctcctcctatcccccggaaatctgcaatagcaaaatccaaagtaaccatcgatgcagcaaaacaaagcgatgacgctacccaaaaccccccaagaatctgccatacttctcacttaccctcctcagcctcctgctcagattcaaaaacctcaccagatctgcaacgacagaggcaaacagacgcatcagaacacccagcaaacagttcatcaaaaaatggacaaaacaacggacccccaaatctcaaaaaaccactcaccatttgctcgcctcttcctctaatcctgccgcttcgaacccctccacgatggcgctatgacatccaacccgccgcaaaatctctgaagcggattgctcaaataggcgaagtggagaagagggagaaattggggaaaaattttgcggcggcgatgggcgggctcctctcgaaaaactcaaattttcgattcggcgaaaaacgtggcggagagccaaaatcaccggtccacggctcacccatgggccaagaccccccccccatccagacgtccgtttgtacgacgtggacggctgagatgagcccggtgcgtggacgcggtctatcccgagcgcgccatggacggcccatttagccgagtgggccttcggcccgcgcgtggcgtgaagccggccacgcgacgccaaatttgggtaattcggggggagtgaagggggtaatccgcaagatggccaccggattcgagcatggaggaggaggaggaggagcataaaattccccaacctggcaatcgcctggagccttcgaaccctagcggggtagccgccccggatcagccgccggcgccgcccatcgccgacgcagccgacgcgggcgcggccgccatggcgccgttcaggcgctgggcggacctgccgccggacctgctgtgccgcgtcggcgacaggctggacctcaagtgctacgccagcgcgcgcggggcgtgcacggcgtggcggtcggcgctgtcgccggcgtcgccggcgctcctcgtgctgtccgacgccaggatgtgcccctcggcggcgtccctcccgacgcggcggtgcttcgacctcgcggcgatactgacggggggcagatgcgtcgggtccagcaacgggtggctcgtcctgtccatcgcgctctacggcgggcagagcgcgttcgtgctcttcaaccccatcaccaccacggagatcgtcctcccgcccctgatctacgagagcaggtgggtctccaaggtcgtgttcgcgcccagccccgccaaggacgactacgccgccgccgccatctgcgacatcgacaggatcgcctacgtcaccgcgggcgccaggaggtgggccgtcctcgaccccgtccgcctcgtcaccggcgaccagctcaccgacgtcgtctaccacgacaaaggtaaggtctactgcctcacgaggtgcggagacgtgcacctgctccgcctccccgagcgccgtcgccggaaacccgccgatgagccagggccatcagaacaaccaccagaggcaccagtggtgccgcttcctgaatgcgcagttgcaattcgagctaggcgaacccaactccaccacaactttcgcatggtctgctatgaccatcttggaccaagggatcagatgatgccgatgaagctcactgtctgttcagagacactcatccctttcaattataggaggttcgcgatcggacctctcgaaccggacctaaatgcgccggcgacggtcgagccattgttgccagaggggaacctcccgtttgatcctgccaccagtttcgctccgccatacaacaccgtgtctgcttttaccaatgccaagaacattgtgctgtgtgagggcaacttgtaccagatctggaggaatgcaagctgcactgtgactttgcagctgcccggaggcggtcaccgtcgtgtatcggagaatgaaatcttggttctaaggtactacccccgtcgccagccgtgctgggatgctgtgacagacttggggggctactcagtgtttgttgggcggaacaatgccgtgtcgatgtatgctgagggtgtgcatggtctcaagggcaactgtgtgtactggattggtgggcgtggtagggatcagggcatggtgttcgacatggaaaccgggaggtctacgccttgctatcctttggttggtggcatgccagggcctttgcaaagcacgatctgctggttcttcttgagtgatatagtgaacgccagcaacaatagtggaggaaggagagtttatcagacacgatcaaggtcccgtgcggaacgtgcacaggatatggaagagtaatgcgtcgccagattgcttggtgacatagtgggtttcaccgatcacgatgatagaagtttgagcttatgtaccatagcaaaagtgtgatctgaacgtgcataagttgtggcagagctggtgtttcaaaactgcccgtgtagccgatagtttattgcgatttgtttgttttccaaatcaattttctctgtctagttgtgcttatgtaactcgtatcatccttatatatttgtgtaatgaaacaatcgctgtcatcttgttgagcttgtattcatcatattatgatggaataagaaaatggattctgaaatatattgttgctgtagacgttctgaattgtagcaccattagtttctctgaggttccttctgtactccaagctccggttgcagaataaacccacatttatttctcattattatactaagtggattccttctccaatgtcaatcagaatcccaaactatgtacaacaatgcaagtctgaaactctgaacatctcaattcccatcctagtttctgctcaagcacaacctgaagtcctgaggcagaagtaatctgcaacctggctcgacgagctgttccactcaaggttccacagcaactccggtgaacggcggcggtggcggcagagtctgcggcgaatgcagcagctgcagcgaccggacgacctcatccatggccggtctctggtcaggcatcaccgaggtgcagagcagggcgagctccagcgccgcctgcatcccctgctgcgccgcgtgggagacggcggcggcggggtcgagtatctgcgccgcgccgccggccacgttgacccgccgccgcacccaccggacgatgtccaccgagtcgtccgacgccggctgccccgccggcttcccggtgatcagctccaggaggatgacgccgaagctgtacacgtccatgaggtgcgttggtttcttggtgcagtttacctctggtttcagcaaaagagcaaacaacttcagtgggataagtgcgcagagagccagagttttatgaaatcttgagtgcaattctgctgtggaaatagctatcctaatgaaattctgcttctgggtgaaatgtataactgaaaacacaaacgagctgatgatgcctaagtaccaaaaatacttctgaagaattcgttcaaaaaaatacactccctctatttaagattataagtcgtcgtttcaactttggccaaaatcaaactgtttgaagtttgttactattttttatataaaacttagattaaatttgaagagtttgactttgacttataatctgaaacggatggcgtacttctgaagatcataactgcattatatccacactgtcctgaactggttgcatggactgaactgtatgaatgatacgcttacctggagcgatgtagcagctgtaattcagatcagaagccaacgaagatcgatacgccttctcgccaacgacacgatcgatcccaaatccggtaactctgggctcaaaatcatcacccagcaacacattgctcgacttgagatcgcgatgcagaaagcgaggagtgtaatcacggtgaaggtacaccaacccttctgctactccgatcgcgatcctcaacctgtcgttccaccccaccgcgaacttcggcgcgcgtatcagatcctgcaagctccccatcctcaggtgctcgtagatgacgctcacctcgccgccgccgccatgggagtcgtagcagaagcccagcaatctggcaatgttcttgtgccggatttttgcgaaagttttcatgtgattcttcactgctccgaatgtttggttgcttgagcatatgaatttcttgaccgcgatgttttgcccgtcttgcagctcgatcaggtagaccttgccgaatgctcccctgccaatggcgttcttgtcgcggagtgcggcgagcagctcgtcggcggtgatcttgatcgggtagaagagcaccagcttggcggcggcgtgcagcctcctgcagacggcgaacgctccgagagccagcagcagcagcacgccggtgacgaaggacgccacggttgcggccagcgcgaggcggtttctcgacggcggcgcggccggcgcgtcgcagccgccgtccgccggcaggccgcacaggccggggttgccctggaggaacacggcggggagggcgccggagaccagcgacggcgggacgcggccggtgaggtggttgtaggagacgttgagcagcgcgagcttgaggccctggagctcggccgggatggcgccggtgaggccgttgctggacacgtcaatgtacgtcagcaccggcaggccgccgagggacgccggtatcgggccggtgagcgcgttgcccgacagcgacagcgacaccagcctcctgcacctcgtgagctccgggatcgcgccggagagcgcgttgccggagacgttgatgatgctcatcgccggggagtcgcagagggtgtccggcaggccgccggcgagccggttcgcggaggcggtgaaccggtacatggtgcggaccatgccgatgctccggggtatctcgccggagatgctgttgttgtcgacctgcacctgctcgagccgggacgccgccgcggacagctcggggagccggccggagaagcggttgctctcggcgcggaccacccgcaagtccggcagcgaccagaggccggcggggagctcgccggtgaacccgttgccctgcacctggaacctctgcagcatcacgcacttgccgatctccttggggaacggcccggagaagccattctgcgagaggtcgagggacagcagcttccggaagttgtggccgaacgccggtggcagagctccggtgaggctgttcatggagaggtcaagaacctcaagctgctccagctggagaagtgtctcggggatcgcgccgccgaaccctgacccctgcaagaagagccacctgagtccggccatctcgccgagctccggcggcagctcggactccaggaactggttcttggacaggtcgaggaagtgcagcttcgtgaggttgcggaacagcgccgggtggagcacgccggagaggcggttgccgccgaggtcgagcacctggagcccccgcagcgcggcgaggccgggcggcacctgaccctcgatgtcgttgccgctgaggtcgagcgacgcgagggaggcgagcatggcgagctggtcggggagcggaccccagagccccgcggagctgaggttgagcgacacgagcaacgcgcaccgcgacagctgcagcgggacggtctggttgaaggtgttcgacgcgaggctgagcgccgccagccccggcacccggcacagcggctcggcggcgatgtccccggagagtccgaggccctgcagcgacaggccgaccgcgacgccgccgccgccgccgccggcggtgcaggtgacgtgcgaccagttgcagtacggcgtggagcgcgaccacgtcgacagggcaccggacgggtcgttcagggaggacctgaagctgagcagcagctcctgcggctgcaccggcatcgccgccaccgccggcgctgccgccgaggcggcgttcgacggcgtggcgaggagcaacacggctgagaagaggaggaggttggcggcggcggcggtggtcgccatggacggagcggaagtgcaaggcaagaaggcgtcaggagtgtcgtagcctagcccgtgctgcggctgctgctgctgctgctgctgctgagagtgttgactccgaagcgcaatgaatgacaagtcgctgcagggcttgaccactgtccggggcgcggatcccgcgccgtcgatggacagatcaacggttgtcgactctccggggcgtccggatgagtagaccgaccatgctgacaatggagaaaaataaaagagcaagtactccaatgtagtactatcatgctagtaagcattattcatgaacatgagagaagagaggagagaaaatgggatacgaattcctagccaactgtgccctactctctccgcttcaaaaaaaaaaaaaaaagaagggaattgacctctctaacaaatgtggacatacctattcagaggaggggtccaagatttgattttatgtacgtacgagatatgagctaagtattaatggtgtagtatatatttatattaaactatcgtatgaataggttattagattagttgtagattttttagagctataacagttggctatactataaagggaacttgctctaatgctattcccagtgcatgtttcataaagagttttaatctcattaaataagatgccaagtaagccaaattgatgatatatcatgaaattcaagaaggaataagtttcatctagatgaaacatggtttacctatgccttggaaacaggatgaaaccccactgtgactgaacatttcatcctctaccttggaaacgaaaatgaaaccccactgtgaccaaatagtttcataaaactattcaataattgagtgctatgaaaccaagaaataaaattgtgcattggagacatttgtttcattcatcaatccaaacgtctttagattacgtggcacttttgaaaaccacaaaataaaatcgaatggcctaagggtgtgtgttattttttttcttttccaacttctactttcctgtttttcacaatcatattttctaaactattaaacaatatttttaatatatatatataattgttttaaaaatcatattaatttatattttagttttcatagcctttactgtacttaattaatcataccgtacgttttactacagaggaaggtatccaacctttcagataaacaaagcctaaaaatattgaattgtcagctgcggcgtgtgcagggggttgtacaatgtggcaggctgctgtggtgtcggatgcactgacattttgcactgtgctccgcttggacttttggggtggagcaggaggcgcttttggaggttggagtggcgcccttgtcctgcgcatcgggggacgacgacacgatgtgcagtgcagtgcagttcaccaccagggagggagggagggagagatcgttcgttcgcgcaaaagacgtgatggcgtcacttccttggatggtttgtagttttgtactacagtactaggcacttgattgtgctgtaccatgtacgcccaggcgcccagttattttatccgcaatgcaaatatatgaattttacggggaatttattaaaggaaatgaaccaacccttatgaaaatcatgtactccccttcaatcattggtttagtttgctccaatgcattgtcaaacaaatcatatgagctgcaatcagtgcctgtgggaaaaagttaccttcaatcattgggcaaacctgacaggatttattgaaattagtaaaacaatgctccatccgtcttcaaatatatagatttttagtgtttgaaattagttttacaatatggactccttaactcctttagaacaaaggtaaacagaaattttgaaggatttgattcctaatttcctactccgtccgtcccataatataacaatctagtaccgaatatgacacttcatagtacaatgaatctggacatgtttcctatctaaattcgttgtaccataaagtgtctcatccggtcctaggtttttatattatgggacggagggagtatgtgattgctcggaacaaaggaatagctctcctaaatttctttgaaattcctagggaatgagttgtttcatacgaattttagtgggaggctctacggttctacctcatatattttttttcaagaatacgcgaaagatttgcgcatcttttgaatacctcatgtttttcacttccaatgacaagttcctatgatttaggtgagtgtcatccaaacaatagttttaaaactttcatgtgtttttaattcctataggattttcaataaacacaacattctattcccgagttcttctgtttccgtgtgttttgcattaatgtgttccaaagcagttctttaactttttcaccaactccctcatttcaaccaatcacactcattactcattcggtttcactttttaattatcataaaaaaactccaaagtacttgctttctctgtctcaaaataagttaacctagtacatgatatgatatattttagtattatgaatctagtacttgaatatatcatatctcgtattagattaacttattttgagacaaaatggtaaattttagaacggagagaatactacactgatatttgaaaccttaatggttaacaacactaaaattgttccagcaacaagtccaaacaaaagaagtacgagtactccgtataataaattatgagattggcagataacagcaggagggggacaatgagacgagggctaagacacagattcttgtcctttgtcctcaaatcatctgccttccatgagttgagtcaacgtgaaaaatccttttagatttgagctacccgtgagttttcgttgattccaagcaaaaattgggctattctttcagagtactactagtactgtttacaattcataatagcacaggtgaaatagccagaatttgtagcctgtacagtacaaaattgcctgatttgaaggcaatcatggagccaaaagatgcagcaggatagcattactagtactacaattttttcagatgatcacatcaatcaataaataaaatgcgccgggtgaataacctaccgataatattaaatgttgcggtgttcccatcatattctacaacctttactttcctttcttttttccctgatttttcaatccacaaacttcgcgtagccagcacagcatgagcgatggccggaaaaaagcacacaaaactggtcacagaacatggctcaaattcagttccaaaaaccagcctgttactaagctctgcaactaaataaatagtatttacgagaggaggaggaactatgagataacactaattctgaggtctttctgcgagtttcatcaggagcagtcaaatggtcgcaccaacgtcctgtttttgctcagcacgtgtgtaggtgaagctccgcacaactgggcttatcaactgattaccggtaggtataggtgtgctgtgaccaggttttgccgcatcgacagtatcagcattatcacgcttccattgtaagctccgagcaccacctctgagtggtagacgcccacgcatagcaccaggaaatgctggccttgggtatgcagttctagtgagtcttgaagggaatgttgatccccgagaaccacggggccagccagactgttgagacacttcgagagagttctttctaacaacctgcagtatacacaattaattgctgagatcatgaatgcatggcaacttggcaagccatgaagaggaactactgaaaaggatctttctgccaggaattacaacactgaaaaggttttgactgcaatggcaatgatttttttttattttacagtttaccaacaggtatctataaaagaagaaaatggtggtggcagtgaatctgccacccaccaactctgttgtattttttaccacctatgcttttatgtactttaattttataaaacagtacttctacatattgttaatatcttatttcatctctagaatttaagtttaccatgcaaagacatccacagggaatcagggatgatattgttccaaaaaccttacaaacttgttccaaaatatgttagcacatgcataattcatttgtatccgtagcgaagcgcgggtatttagctagtgatctaacgataaatacacaattcagctggcaatttgtgtgcagtgaagcagctcaactaatatattctcccatacaaataaaactatagcgagcttactagagcagctggatcttgcatagcgatccacaatatttaatagagttgtagagttttagtgcacaatagaaaggtcaacatggggttttaccttgagcatgcgcgacataaaagatgtgttgtcaagagttagggcttgttctgctgactctttgtgcaagaattcaatgtacgctgagctgaatggacaacacaaagaaaaaaaatgaggataatgtctaaaataactctgctgttcaggcttcagaatgaagagaagacttggaattcataccctgttggctgaccagcaatatcagtcacaataagagttttaagcacagctccaaacttattgaaatgacgggaaagagcatcttttgtagcagcaaaatgtacctataaacacgagaacaatcgttagtaaatagtaataaaggcagcttctcagcttcacaaatgaaatggtagtacgagacacttacattggaaagaaaaactgttctagaatcagtgccaccttctggctgacctgtactgcatgatccaacagctggaagggggcaagaggaggaaaatttctgagtcattgagggtgttgaaaaaaagccacagaatcaacatgtaaaataagtaaggttaggggtttaaaaagtctacacagtagagatgttttagatgatgactttcaattaaataaaggtgtctcataatcaaacatggtgttgcgtgctgatataaaagctcaatgcatcgtgtagctgtgataatcaacactcaagtgctacataccaagtg

SEQ ID NO: 78027 - DNA, 24686 bp, Oryza sativa
  unsure (1)..(24686): unsure at all n locations
gatggtgtttatgcaaaaaaagctcctcttgtttgaacggaatagcacgcacatcctcccaccgaccgacaccctattccattttatacgaaaaaccactcgtctttcagaaaaaatacaacacgaagaagggaaaattctgcctacatggatagcgctgttaaaacgaaaaacacaagggtttttcccaaaaacaaccgcatctaccctctcccatcccatccccaaactctatcctcccctacccgtcccatctcctcccacggcactagagcgccttcgttcctcccccaccgtatggccgccatgtgtgtcaaagccggcaattacgctctgttctccccctccccctccccccaccccctgcctctctagccgccggcaatggggccggccgtggcggcggacctggccgcgagcgccagccgtccctcccgccgcacgggcaccggcgccgcggtgaccttcgcaccacgccgcacggacatggcggcaatggtgtggtttcggcgcaaaggagccagtaaatctacataacaaatgtatagatcaaccaatttaatactttgagtcgtcgataaaaatcttgacaacaaaaaatctatacatctagttatgtttacgtgtgatctcttatgagggatgccagctaaactcgggaggatttgtatacatgtttagaccatactcaaagtaataaccctatgttttcagcgccatgtgatctttattgatatatagataatatgagtataaaaggagggtatgtgttcctagccctatcttatagtctcgaaagttccgatgagatagtggttagacgatcacaagtcaaatttctcgggctcctagtggatcttgggcttgatcttggctggacgggttgtggcttgtctttcaatgtttactgtacagctgtatcctagaagaactcacaaaggtattgttggaagttttcggtatagtcctggtaaaagtccaagtaggtctcatgtagtcttttcaaggtgggcatgattttcttttatgaatacatcagttcatctaaagaactagcactgatgtgcaatcattattgccaggacatacacttatctagtagatggaaaatcttctagtagtgatgatttttaacaaaccggtacagatagagcagcactgctaatctgttttagtaatacttcctccgttctaaaatgattggcgtattccaccatggcagtgagaccaaggagcactgactccctttctcctttgattcgtactccaagctgtgcatcgagcaaggtatgctgcgccggcgcttcattatcccgcgcattaccccatgccgtcgtcgcttcgttgccccatgcatggctccacggcgccatcgcttcacgggtcgtgctcgcgcccacacgccatccaattccttcgctccatccgcacgaatcacatcgtgtcatcccagccgctcgacgaccctgcgtgaccatcccgctacggccacgatgtcgcttcccactccggccgcgaagtcgtctctcgctctggccgtggtggccgcgatccctgcgacggcgcctcctgctttgtctgctgcgaccgacaaaccatctcctgcttcggccatgtcttcatccatcgccgcctccatgtctttccaaaggtgggagaagaacagaaaacaccacggctgggttttggcatacgaaacaccgagaggtattcgtttttgaatttttttgagaattaatattatttttatggaaaatcgcaaaagtagtggtcaaccgggaaaaatcgcgaaagtaggtccctgtcgaacgggtgcagttcgataggtcgcctatcgaacggccagagcgcgactggcgaggagatcggaaggctgccgttcgacaggacctgtcgaacagcccccgttcgacaggaagggctgtgtcgaactgcccctgttcgataggatatccgtcgaactggcgcagttcgacagggtcgcgttctccatttatttgtaataagttattttttttaataatatgtaatttattttagtgtgtaagaaaggaaaatatttttgtaatgttatatgtatatgatttagggttttgataatgtttggtcagaaattgtagtatttatttgttggatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacagaaatgactaaaagtttaatacaaatagataagtcaaggacgatcagtgcccttcgcacgcttgctaggtcctcccttcttcctatgcctaatctgctcagtgggatatgtcaaattatcaggggggagcctatctctagctgcctgctgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatgacgtagttagtaacgatacatataattagaaactaaagcgtgtctatcatcatctgcttgcataacttcttgaacaggtccatcaatctcttactcctgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttagtctgttttcaacaacacacattttaatgtgccgcaaaaaccatagccagcttgatgtgttcttgctttcaacaaatgcaaaagcaacaggaacgacatggctatccgtgtcgactccgatcgcggttagaattgttcctctgtacttgcctgtcatgaaagtgccatcaacacagagcaaaggaatgcaatttctaaaggcctctatcatgcacccaaatgaccagaaagcccgacgaagaatattctccccatattcattcacctcatcgagaatagccatgtgtgtgcccgggtttcttgcctgcatcacctccaatagtgggggaagattgtgataagaatcctcatgagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaataaacacgtatgttgctcaaccctcgaacctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccacctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacatgttgtcttctgcaccactattgccaggctatagcctttctcccttactttactaacaaacttcctccaactcccagttgacgcaacctccactactctccactgccattcatgttgacccctcactggccacacggtatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattataacttatactatattgccgtgtactaatttacaactattagtaacaaacaactagtttaataatccaaataaaatataacacctttgtatctattttaacacacaacatatcaataatatgtactaactaagaactaatttaaccgtacaattacttaaatacctctaccaacatttagcaataacaaatatgtgctaaccatacatactaacatcgaacaatacgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctcccctcgctccctccggcgctcacggcgacgatgtggcgactctcggcggcggctggcgatgtggtcctcaaaacaaatcgaactcgcggcctgggtggacggggctttaaaccggcttgtcgaatgcccattgttcgacagggtcggtggagggccctgtcgaacgcccccggttcgacaggcctcgcggcgccgggtggtgggccctgtcgaactccctccgttcgacaggtgagcgtgtcgaacgccagccgttcgacatgcctttgtcgactgcccgtcgttcgataggtgccctatcgaattgcacccgttcgacagggacctactttcgcgattttccccggttggccactacttttgcgattttccataaaaataatattaattctcaacaaaattcgaggtttttggcatacgaagcggcgaggataagaaaacgaagcgcatatgcgagatgtgtcgggtgctgcctttgaagtacgacgatgataatttttggttttctacaatacgtcgattatttttaatcgaaacagagggaataaatcagtactaatagggtgacactcttatcaacactcctaaatgttgtgttaggcccctttttagcattacgtttgaattgaacaagcattaacaagttggttaatctgaattcaattaaaaacgtttgttcacgttcgcctcaatctgatgaatgcgggcttttccggaaaagccctgttcctgttactctgttaacagcaggagtcagggaccttacttacatcctgccatgcacgttgaccgtaagaccacatgcaaacaggtagtagtcgttctacgctggccaaaaggtctcacggtcaaccaattagcgcagaacagagttgtgaaacaaataaatagggattcactatgcatcctttcaaaacaagcttgggaactaacagtgctactgcctcactcgtctagcacaagcatcgtcagatcacatgaattgttgcatgctcagtggactctagcacgggcacagcagtatctcacaaaagcagattaaagcatccaaagcttaatatatgattgcagagcgatgaagcatcaaagcgcattaagaaaaacaatccaagaatggtttgcgtactcagttggagctccagtttcatagcatcgttctacaagggagcacccatccctaccgtcataacgtaaaatgttttcttcagttcaccagatccataaaagacgggatgcaacagagaaaggaattatgtagaggggccttcgattgctctaacttgtctcggctttagcgtccgactcctgggattttccggcttcagcagccttctctgcgtcttgaggtttagacacttcttctaaacaagggagcaacaaagtcaaaaaagatggcatgaggacttttaacaagcaagattacaattaaaaggtactaagatatataaaaaaacaaagataactggcactcttatatcaacttaattgacataacatagttgtttaaattgcttataattgatgcctagatgtacttcaagtctgcaatttcttggaggtacttcaaatctctagatttatgtacaatatgatgaatacaaactgatttgcaatttcttgggaatgtgcttcagttctctagacgtaagtacaatatgatgaatacgagtacacgcgacactaaccttaatctgcacctagtgacactaactttacatgcatcaaaaagtttcctaaccagtatgtaagtataatggttaagaaacttttgatgcatgtgattaaggttagtatcatacctatcacaaaatcaatgcaagtaagaaacatatcagactaattaccaccataatagttacagcatgaacaacataattcgggccaaactattccaaaatgtgcaggagaaccattaaatagcacttttacttctacaatcacaatatcaagaaacagtcctgtatgatgaaaaaaatagctttatcctattgagttgcatttatatgtgccaagcatgaaaggtgcaatattttgatcactgctgttaagagtacgaatcacacaattgcagatttttcaagaattggcctttcaattaatggcatttgtcacgtgcatgagtcatatcactcatctggtcaggcagttcaaactaaaccatactaatcttaccaaactgcaaaaataatgcttccttaatttatattttcacagaatcatattatgctatcatatagctaatagaaacaagtggatattaatgagaatctgtggacacaataaaggaagacaaaccttcatcgtcactctcgtcctcgaactcatcnnnnnnnnnnnnnnnnnnnnnnnnnnnnnnnnnacccatgccacccatcatctcagccatgccacccatgccacccataccacccatgccacccatcatatcacccattccgcccattccacccattccacccatgccaccaaaattctataaaaaaagacataaagaaaaacattagtttaaaaaacaatatatgcatgagcaaaaaggaaatctaggaataaacatgaaatctgaaaagaactaattaccgaaaagtccattccatccacgttgacatcagcacctaaaaaataaaatatatgcatatcaaaacgttggataaggaacaagggcttatttacattaataaggccagattaaatttcctggaatatctatataattaagttaaaaaataatatattataagagcagattaggtccctaaactgatattagttttggggcttgaatgtggaatctaaacgagtgagacaatgtaggtttatatccaacataacgagtaataacagtttgtcctgcgcatgatttttttttaccatgaccagttgaaaaacaaatggaatgccttaaagagaaacatatatggaacattcttcaaattcaaacatgtcattatgtgctatgatcaaatgatactccattctaacatgttaggcgcacttgcttcatctcacttgttctcattatgctgctactagttgcgtcaaacatgagaaaacaagtccacagtttatcaccgcaaaagaagtgcatagcttaccatcatcatcttcatcaacccatttgtcccagtcaactttcacaaagtgtggtgccttttgatcatctcgaacaagcttcttccaccatttggcctcagctttttctacaatacagaatatggacctaacacctacacttattttgctctcctgtagaatcaaaacaaataaacacgggataaggaaccacgcattttaatatagaggaaactgcagtcatatagctattgcacgagcatgtattacctcaacatttactttgtcgttcaactctagctttgattcgtataagttcccatcagttccagctgtagcagagaaagagaatacaccttctggttccagattgaccttagcatccttagcatcagctaattgtacagttatgtaaaccttgtcaatcctctgagcccacttcacttcagggtgccgactacaggaaacaaaaagaaaaccataaaaaaaattcaattctgagcaccttacaagaagcaaaagaatgagggttagatccctttgaggttaaactccaatacaaatacatcagcagcctacaaaaatccacaagtttactgtgtgccagtaatatccatgctatatgaacaagtgacaagtactccctccgtatcatatttgactttttttctagtcaaatttctttaggtatgaccaaatttatagaaaaatttagcaacatctacagcaccaaattagtttcactaaaatgtaatgctgaatatattttggtaatatgtttgtcttgtgttggaaatattgccatatttttctataaacttggacgaactttaaaaaaaattgactggaaaagaagtcaaaacgacttataatgtgaaacacagggagtattatacaaaatactgataaaaatgaaagttttcttaatgaatataaaatggtggtgtctggtaatcctatcataaagcaaaaccaacaaagaatccttagagaataccgagacacaattgccattggcatcagtatcagagttacctacaactgaacatgaactaacacttacaatgagaaagcactaatgcaaaaatgtattacaaaccagatttcaatctcttaaaaatatcacaatcgatagacaaaactacaaaggcacagaaatatctactaataagagatatctaggaataagagataaactaattgcctcctaacagttatcagaagctgcacgcaccatggcatgaaccaacttagagcaagtttaataataaagccaactatgaacttatagcacatattagagttgacatgcatagtagataagctataagcttatctatatttttcttctcctctctatctcatctatacaattaacttatccatcttaaagtatgtgaatggttagctcttacatgagactgagacccaaccctcttcatttttcaaactctctcttccacataagcttacatttggctacttggcttatagcccactattaaacttgagcttattattactttattattaaactcctggtcgtcagtgcgaagttatcctcgttaactataggactatacgagcagatgatcacctccaattaaccaaataaaaccctggctagctcaataaaccacacgagctacacctaaacagtagctgccgcacaagcataattaaccaacccgacacagtgggaaaccaaagcagagagatctaccaacacaccgatagctgggggcaacccgcgcacgtgcgcggggacatggccgtgaactgaggcgcaccaccaaaaaccatctaaacttcctacggccaacccccaaccccccaaccctagcaacaaacagatcccacagaaatcaaaacacgacgaaccctagcgtcaagcccacgcccgcggaagggaccccacgggccctctcgcgctgccggggatcttccccccgcgtgcacagcggctgccccctccagatctaaccgctcccggcgctggacggcgcgtgcgggcggcgcggagtatgggtttctccgccgaatcgggagccgaagtgatgatgggagaggaggaggaggaggaggggagcaatcgctcacctcatgctgccgtttaccggtggaggcgacggcggcggcggcgggtgagggccgagggttttgcgaggttttttggggaatggaagatggagaatgaaggagtggagaggaagtgtcttgaagtagggaaacggaggcggtgctgcgagggggatgggctgggcttggctgggttctcgtgggccttgacttcgctgcaaccgaaagaaggaaaaagtccacaaggactccctcgaatataggatgaatctgattcgtatcccttacccataataccagatatcttgaccctcttagctattaaaactgatgcaatatgaatcctttggtggttttgaaggtggttttcgttgatgtagcatctaagtatcgcattgacttagtcttcgtcatctacgtggcattaaaaaaataaaacataatgtgtggggcccatgggtcagacgacggcgtgaaaccaacgggaccaaggcggcacctagcgaaagaagagcataaggcggcagctacctcgtcagcgggggaagtgctggccacgcacggccggaatcatctaggcgtcgttggtcttgccttggccacggtggggaggcgagagaggacgacggtagggaggactaaccgatggtggttggggaaacgaggatgatagcaaggaggccaaggcaaggggtgagaagggtatgcaacagcaaggaatgctatgatttcccagcggcgtttgcggtgttatcttctccaaagcccatggccgcggctgcggcgtgctcaacaaagagccacttgggcatcgactggagaaggaacaacggaagttgtacccaagggggacaaagggctccgagcgtcatcgtcgtccgtgatttggctcccagggtgctcgacattgcgaatggcaatggcattcgccgagcttgatatctcccccagcaccaaacccttcctcctagcaccaatgcagatttggcaggcgagcgagcgatcccgtccttcctgctagtcctggggcctcgcggaccgcagacaagctcaccaccacctccaatttctcttccacagggcactagtgcggtgccaacactcctctacctatcgtcgtcctctccagcctccctgctgcctactcgtccttcttgctcctcccaagggctctccaactactgtagcgtccctttctaccgatgaggtctgtcggtgaaatgggcccaggggtacacacagtaaagggaaatatctttcccatctagtcgcgtggccacgcggcctcgtttccccccgcccctcgggtagcgaggtggctagggggcctcggggtgcggtggccagggggcctcggggtgccacgccacacccctcgggctttcggggcgtgctaccccggggccctcgcccggccaccacatggtggggagaggaggcgaggcgaaagacgatgctccgcgcctttaatgcgcggcgccccaaccgtcccgcaccgcattcaatgcggcgtggggggacgtgcggcgccgctcgattgacccatgtcaatcgagcatgaccggcttgtgactggtcacaggcgacgggacggggggcagtgcccccatgttctgctctgtgtcaggcggagtgggggcatgtgtgccctgtcccgtcggcacgctgctaggggcgccccacgcgcgtgatgaaccgccgaagtcttcatgcaattaatagggaatgacagggatgtcccccgtgtcaggcagaggacagcgctgggccccacctgaagataggcgaccatgttgcttccggttgaagcaaaggatagcggtatgattaggaccatgtgggtcccccctttccgtggaggggtaagtgcaaacggtgcatgtggtatccccttgaactataaaaggaggaccgttaccactaggaaaaaggacgattggaggagaactcaagctcgaaggaagaacaactaggttcccatcggagcttgaaatcccttgtaaaaactcaccataatcccacacacaggagtagggtattacgctcggtagcggcccgaacctgtataatcctcgatctcccacacagtcccgacagcgatcgagcaactagactgcaagcggaagtaggctcctgtcatcgtgccatttcccccggccgaactcacaaggggggggggtctcacgaccacctgctagggaggatcactcctcgacaaggtcgctgctgcctccggttcctctttcgtcaggcatcgcgcatggcgccaccactccctcccctgtcgtcatcctctccagcctccccgctacctacccatccttcctggtgctccaaggggctaaccggccccgctgcattccttctcgtttacgaggtcaccaccacttccggcctcttctgccgggcattggtgcactgcccttggtcccgccaaggcgccaatcgtcgccctgaccacaagagagtgggagggaaaaagaggaagaaaaatacaattgttgacctatgagtcccatggttttaatgttttttttttttattataacatgtcaatgcaacacatggacgtcatgtcagcaatacaactctcactattaccttaggagtaattttgtacaagttttaatagctgagggagtcattataccttgtttgacggttgagggatataaatcaaattcgatatatatatatatatatatatatatatatatatatttaatgtagtcaaagtggactttttccgtgaaagaatggcataggcctactcgtgctacaccaaggctccgtttagtggaaacatataacacaaacttcgcatgtatactccctgcacacaaactactaaatgtcacttacgattctcgaaaagtttacgcatataatttctaatagggttacacctatgtgtaactcaaactcattatattttagcctaaaaaatctgatgtttttaagaatataaatatttagaatttctctctgtatatatgatgaatttaataataaagtttacacgttgatgtaatagtattgaaaatacatgtgcatttttttctagagttttatgtgaacacgatatatacacgtgaaaacttgtgtgcatataacaaatttgctataataaaatggtaaaagttgaaagtataagggtgatataattacgtttatacgagtttaacaggctaacttgcgagtagagccaaacttagttccttaaggttaaaagagttgaaccgagcaggctcgttttgattttttttattttaagaataaatttcacttcgggccactttttattactgatgtttcactttggaccaccctttaagcaatattttcactttggagtgggtaaacctgcctttgtttcactttggaccacccgactctcttctcaagcatatgaacgatctcgattacatcatctcctactcgtcaatgaactgccacagctatatgtaagactatttcttcgacatattaaaaattggatgtagatcgataaaagagtaagggtggtccaaagtgaaataaaggtaaaaatacccggtccaaagtgaaaacattagtcctaaggtggtccaaagcgaaacatcggtaataaaaggtggtaaaattaactcttttatttattaaaatatttacataaataattttctatttgaaaattttacaaaactagtcgccctcgccgcccttttacaaaacttagtcacccaccgcccatcgctcgttccatgagttcagatcacctcactaatgtatgcataaataagtgagtaggcgatgacgaatgacctttagataaccttattcatgtatgcataaatgtgtagatgatgaaagactaataagcgcttcatgcgtgcctgcgatgtacacatttatatggatgaatacaattcataatagaagattccgttctacatatggatatggtctgttgcatccatgaatttcgaagtatttgaagatgcaccctcagtgagttgataaccaccattcacatggttcaaaaacacgagtgcatttgaagggagccacaaagatgatactacagttacacaacataaaagaaaatcccgaaaaagtgtccatttattgcagaagaggagtctatgtttatgatttgctagcagcttctgcctgttgaactgtggcaccaggttgagcagaaactgctgctgcagcagctgatggagaatacaccttagctctacgaagaatctcggcaacaacccagtgcttccttttgctcaagggcctagaaggatcaagcttaacctggagagaaattatccagtcatcatcaaaaaggtttttcttggagataaaaaattaatgcgctcttaggtcgcactttgtgaactacaaaagggggagattagtctccagcaagctgataaaatagaaaagtgcagtaggacagctcaagatcactaatatattcgtcataagagcaaatatgttagtcccaacatatttttttttctaaaaaaaaaatccctgtcacaaactcacagggtaaagttgaacttttatgctgtctttttatttatttatttatttattttaacaataggtggtgcaatcaatagtcagaacataaaagtttctgttaaatccagtcccttggtaatgtggatcttcgggcgcacaaaacaaattaatttgaataggcaaaatcttatgatgtgaatatgttaacactgttatcacatttgcataaagcaaaactaattagaaagtggcatgttaacattataactatgctttgcaacaaattatctttcagacctccgtccatgctttgccaagttgccatatcacataagatatgagaaaattcagaggcaaaagattatgccactattaaaatctagtacaaccatcattgtcaaaattctcatggaaagattgttttgcatctgatgaagtaactagcttactgaagttcagagcccccaaaaggggcctctcttgtctggagttgacactcctgattaaagggttggcttactgtttagtgtatcaattacgccaagaattaaacttcagattgtgccttaactttcagttgctaatgttatagattgaggctataaatacttgacatatcaaaaagctctggtcaagaactattatgtgcttatgattaaccctcaaatttctgaactatatgaaacaatgtacataactaacaccaaaatcaaattacaagaacacaatatttaagataacttatcacggtggaaaaaaaacacaaactgtaactcaaagagtaccactatgcagtagtgccctagtagctcatatatgaacatcataaatagaaagcagtagcatataatccaaacagttgttcactgccgagagtagtaaaatacaaaactaatactaattgaagttgttttcagaaatactatcatggcattgttaacgagcagatatgcaagcagacagagaaatgtcaactcttaaggattaggtgccatgacatgtaatgatgtcaaccatatggttgcaacctccctacaggcatcaatttaacagctggaactatacagaataggataacaatccacaatactgtaacaactagttttgttacaagtcaaactccttcaagtttaaccaagttcatagaaaaatgtatcatcatttccaataccaaacaaatatattataaaaatatgttcaatggcggatataatgaaattaatttggtgttataaatgttgccacattttcctaaatgtttggtcacaattaaagaagcttgacttaggacgaaatgaaaacatcttacatcctgaaacggagggagtagattataaaaatagctcaaaaagaaggcatcatgtgcactctatatattatattaccacattaattgaaggaaaaagtaaatatttacaccattagattgttatgagtccagagtataacggtgtagattgattattggatattataggcatttgagtcgttgacataatacaactctattctatgtaggcaaaatctggtcaagaaatacaatagaatccaactccagttccaaagcaattaggagtagttgttaaaacagatcagtagtcagtattcatgtactgattttctctttcctttgaaaggattcactcagggatgctcagaagcatacaaattaaaaaaaaaaaggtctctgacccggttcaaacaaactggctggctagacaacatcacttccatgtacatacatggtggttctggacttccagcagccatgcacattgagagaacagagaaaggcaggctagatatttaacaaatgaaaaaaagtttctgttgacatttaatcaaattttgctaaatggcacaatcaaattccagcttcaaacatagtagtacaactaaattttattcatgcaacaagcataatgaaaggcccgctgctaaactggccaatgccgcaaacatgagaattgtgttatttttgtgcaaatatagttcaagacataagcatgacaggtgcaatggtgagctatgcaggtaacctactgatcagttagttgagcagcttaaatatacagttgaaactgaagagaaacccccaacccaatctaaaagtacaatgcttcaaaaattcaagttataactagcagcattctggatggtgcttttgaggagtgacgagcaacatgacaagtagcaatttaagctaccaaggcatcaattactgtgttaactagacacagctatcaagatagcaacctcctagaagtagaaaaacatatacataaaaacacatggctcaggcagataatgcaatcagagcaaggcagggcaagcaacacatattttgttggctccaagtgatgcaacaacagatttgacactttaaagcaactacagcatgactcgagtcaaaagacaattcaatagctggattactgggcaagaggtgatcagtaggcctctggtggtacaattgccttcggaagttatatataatcatgtagaattcttggatcaaactcgcatttatatttgtaagttacaatacgccatttgtgatttcatattttcatgtatttcttatcttccaaaaccgggatagaaattgacttgaacatttctcagtattgtgcgaaaaaaaggcaagatctttcatttactcctttcacttctctgtgcataagggaataaagaaattttataagtcaatggtggtggcagtgaatcagccaccacaccaactctacagtagatccttttatcaacacattcctgaagttctttagtattacaaaacagtctttctacatatcttattccgcctctaaaatacaaatttataattcgaagctttacgataatgaaattgtcgcatatatatgcagtataaaagtaattttatgaccagagtaatgtaaaagttgtcaagtgcttcatgtaacttaaatgacaagttatatataaatgaagggtgtgttcaatgaaaaaaaaactcacaatcatttgtttgaaacaatattacgagcatttagctggtgaatgaataaattttagatgatatagcattatagccaaatgaacgacatcacaccagagaaatcaaatgctcgcatcacaaatcagcatggattaaaaaaaaagaaaaaagctgaaacagagagagggggagtggagaggggagctcggttaccgacccggtcgccgatgttacagtcctcggtctcatcgtgcgccatgaacttggaggtgcgcttgacgtagcggttgtacatcttgtggtggaagaggcggtcgacggccaccaccaccgacttctgcatcttgttcgacaccacgatccccaccaccggcttcatcgtccgtcccgcccccaccccacccgcggggagaccgcccgccgactggcgatgggatcggccggggactggcggcagagagggcggaggaggccgccggcgcggagaggggggcggcggctgcggctcgccggctgcgcaccgggagcggagacgataggcaagcacgacagtgagtgaggaggggggcgaatcggttcgattgattccaagggagaagctagggtttatgacttgggcccaggatgctccgatgttgggattttaagttgggtggcccgcgggcttagatgttgttctaaggggcccaattggggaacgaagcctgggcgcctccgccctttgtgctgttcgccgtacatgaaccagaatagatttctagatcatactcctccgttcctaaatatgttctagatcatacgccattgattttttaaaatatatttaatcattcgtctttttttaaaaacttttttgaataatattcaaaagcttgagtagtagtattatatttaacaataaatcaaatgatagaaaaagaattaataattacttaaattttttaaataagacgaacaatcaaacatgttttaaaaagttaacggcatcaaatatttagggacggagagagtatatattttgatttttcatctgtaaaatattgcattgcatcaaagatttgtgtacatgtagatttaacttgtagttatacccaattacattgcatttatacttagttacataaaacttatattagttatagtgcatcaaaattatgtttttgacaactattttttctctagatttatgatttttatgtgtttatccttttttttcattcaaaatgggttctatacattagttcaatattctgcaagatttagagttccaaatttgttgaaagatcaatagattagtctctttccagaatggtacaccaacttcttgcaaaggaaggaacactactgatctttcaatatatatgggcaaaatagaagtactcaacactttatcggctgcatttggcaaaatccttttttttttcttccgagaaatatggtacaaacatatacaaacacaagtacacaacatatgcgctcttaccctaaatgcaaacactcacaccctagtcatacaagtaccttcgaaagaccgaccgatatatcttgagattgacgaaaccacggacgactcactatcgacgggtatgtcgtttaccattataaaataataagctattcccatcaaataataataaaaactataaatatgagcacccatgtcaagtctataacttcaattgggtagattggtctaaaaaaaaacctaatcgattgaattacgcttactttgcaaaatctttttttttacttgcaaaataattaagggaacatcaacgtcttgcaagtgggacctccttagttgacatttgccatagtcaaacaaaaaggatctcacgtatacaacacgcaccgattttttattgaaaattataccacgtacgtagtcatctaagcaacttgggcctccttcataacaaaaggaaatttataagtttttgctactttggaatcagggtaaaactctaaacaatttttgggacatactaggatttttatcattttttgtaaaatcgctcgatttccaaggagcaatttttttttttacaaacggtaccacgagtctacgtagtgaattaaggactagcctagatgctttgcgccgtgaaattttttaccataataacgtggaataagtaataacacgatgctagtacaatttggagagagatggtgctgttggtgtttaggatgaaaatggtcggaaaaaccctctaccatttttatttctatatttctttttttccgaaaacggaatcgaaacggtataaaaaaacgataacgatatcagtatattggaaatggaaacgtcgaaacagaacctagcgatgttggttggaagaaaattcatattggaaacaacaaagtgaggcataatcacatatttaattatacatgaagataactttataactttattcttacatcattacactccacataataccattatatgatgattaatgatatgataatatgttcgacgaataatataaacaaagttcaataatactttaacatcgataagttgaagagaccaaagttcaacaaagcccacatgccacgccctagggttaaccgtgttttcccctagccacttcccttttctaatgggctacaagtccgccaggcttccaacattcatgagcttccgatgggttggactagctgagccgttggagaactttcagaattttctcagaattttgacggaaattaccggataaatacgattaccaataaaaacggttgaaaaaacctccatcccacttccgctatcatttccagaagatattaccatttctatttccaacactgataattgccgataccgactaaaacggtaggtgcagaccagaaatgatagccggaaatttccatactgttttcaaccatagggcatttgggtgaggggactaaggtgcatttaggagaagagaaaaagataatgcacgcaaaatgaggtatatcgttagcgtgtgattaactattttaaactagaaaatgactaatatagttttttgcaaaaaaattctatatttttttttttcaaaaaacactgattagcagttcaaaatgcacgcgcgtgaaaaacgaggaactttctctcctctgtttaacacaccgatgttagacttacagtatcagtttagaataggctgaacctttatatatctggtattcgaaagaaaaaaccacatgctcagttgtagtcatcttaagtcgtggatttgataaggatctataccatattctttacccccatctttctaacttctactcacttgttttatacgcacatccttctcaaaccactaaagggcgtgttttttttaagaatatatagaaaaattactttaaaaattatagtaatctattttcaggttttttaaactaatacttaattaattatgcgccaatgtataatacttaattaattatgcgccaatgtatatttcattttacatgatggagagaaggggttccgaacacaactttaattgtccgacaccaattatttttcttggttgtccaagtactctggctttccattctaaaatataaaatataaagacactattatttttctccatgtcttataatatatggcacgcagtcatgtatatagtactaactagctcatttaaatttgctttgttttaaatcatctaccatcaaacttccaatcacataattatttacatgtttcgaggtgatccaattgatgaggtgattaaatttactttttgtttttgtgttagtggtggttattttttatattttgggataaaaggagtatttgttttttttttgaaaaaaaatacactctagatccaggggcttagcccccggtacttttgttatagccaaccatttctcttggcttctctcttgaattcgcctttaacaaaagatggtccagtacaggtgatgagagtgtgaagagatctatccttttccttaaaaagaaagaaaagaaaagaaaaacaaagaaagaaagagtggatgcccccaacccaaccaagcacgtgccagccacgccgccccctcaccccatcacccatcaccggtcgctctccacgccagtacacatgaatcctcttcctcactcctcattgctgctgttcacccagactcgcacagttcatgctcatgcgtggaggaacggtcgttttcttttgctccttttgatagaggcgctaccgctaccttacccttacctagctaagctagggtctcccttcagtgacaatgatcaacgatggagtaattccaacgccatgagatccgtgctgttttgggtggtataattggacgtgtttggttgcctacaaaagcttttatcccgtttatgtttctatcttgttttgtaattatatgaataggaaatgcatgtgaaaataaaaaacggttttgttatatatttatcagcaaattttctaaaaacatattgtaacttgcatgtaattatagagtaaatttcacgaaaatagtacttcaaccaaaatattagaaaactacagatttaaggtcttctatcataaaactacaaatttagtgcagttagccgatgcttatttctcggatactgtcattgtcattgttcttctctgagaaaagaagttgacgacccgtgggctttcacctccacatgacattgctccatcaggctttcacccattgcagatgcttctctcatgatacaatccgcttcctgctgagcctcctttcttcttgatccacagaaaaaaaaatggagaactagcgctgacaatttatcgcggaagaaacaactcaccgaaccgagaacactaactaatagaatagtactactaacttgtactaatagatcccgcagaaaaaaaaacttatactaatagatatcaagaaatagaaacaaactacaagtctatataacatagaaaaccaagcagccatgatgggtacgtgtgcgatgaatcccgttccccctcctgatcttcctcttcatgcctgactcgttttcatcacctgaagctaaaatttctcacaaaactatagatttaggatggagtgtaaaaaaaactaagcagcaattttatcacaaaactataggtttagtgctaatttatcccaaaactataacatttatagctccaacataaagtttgcaatagggatttaaactctagaatttgtatccttgtgataacttcaatatgaaatatgtacttttaagataacttataatataaaatctatagttttgtggtacttggtcttaaatatatagttttgtgataattttaccgctaagtctgtagttttttgatacaacatctcaaatatgtagttttgcgtagtttggtcaaaatatctatagctttgtgaaatttactctatttataatgtagcttgtatgcaaatttcatatattttgaaccattagatttactctaagattcatgctagtgggaaagagaaaatcgtaacacacacgggtgaggggatttggtcccatgacttccgctttgcagaaatagctccacatggtgggatttttcaaagttatatccaagttatactatagttttatattataattatactataattacatttgataaattttgataaaaaaattgtcaataaatatatatatagataatcccaataaaaaaatacctctactaagttaaaaacggagtcgtcctccttccatcccctcctcccaccaccacggtgtgtccgtacgctgaaagtaaacacgacatccaatgttttatctttaatcacccttctagcttatctctatttatatgagcctggcccattacaattgttacaaaatactccatcatagcatatccctatttgttcggtttggccatgatattatcgttactagtttaaaaaaacttaggttccatgaatatctcacgtttggccggaactatctagaggtttaggccctgtttctttcagcttgggattattataatctagattattgagtcagattactataagctagattgttataatctgtagtagaataagcggttagttgtttctttcctagattattagagcctagattattgggtttgcaagtctaaagagggagtggggtggtattgtgggtaatttttcacccaataatctggaaaaagctcacctaaatgagcttatcagattataataagctgggttccagattataataagctacttcaataagttgtctgtttcttaatcccaagctgaaagaaacagggccttatatatgttctcttttagaaaagtttgtcatttttagccttttaaagtccatatatataaacgaacttttttttactacataattataatcagcttttgtttaattaacaaatttagctacaccccaaaacctatgttacaatgacactcttttgtaactgtggagagagaatattaactacctccgctctaaaaaaggtaaagtttttaatgtattattatcagatgtcaatatcttaaatcattgatagatgacaaaaataatattagtattaaaaatgtgaaagttaaattagtattttttttatgaaaaactctgtcatattatttatattttaaatattttctatagatatatagtttgaaaaaaaaaatcaaaaaatcgtgaaatatatagtagtagtatgctatatatatgtacctagagatcaagtaataaagtaatgaatgatggatagagtagtacggtgccatctcgaataagaacaaggtaggctcaaatttgcccgagagctttagccaattcagtggcacgacatcaagattgaagagatacaacaccttaatactccctccgtttcacaatgtaagtcattctagcatttcccacattcatattgatgttaataaatctagacatatatatccatctagattcattaacatccatataaatataggaaatgttagaatgacttacattgtgaaacggaggaagtatcttcttatggaaggtcataattttacgaaacatttaatgatggccccaaaaagattatacattaaatgtccttcttcgacatttcatttcaaaaggagtactaatgattttggagggagaaaaggacaaaggtcagataatgttggacattatgatagaattaatctaatagtctctatcatgtaaaag

SEQ ID NO: 78028 - DNA, 2189 bp, Oryza sativa
gaggatccccaaatggccataacttggccatttgaactcggaattggaccgttcaagtctctaatttttccttaagaagtcaagaacccatttttgtgctttgtttctgcttgttatatggagtttattagagtaaaagccttttcttttctgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggaatattctcatcacctggacactttggaatggatggattattgtggaattggattcacacttccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcctaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagttctagaatcgtgtttacaaaatagctttgagcaactaagtatctttaaatgctgtttactgcaaccctaaccctttatattataactcccttgtactcccttgcatttattatgcacttgtgggtgtgtcttgttgagtacggtggttgtactcagtcttgctcaattttttcccaaacccagaagaggagcccctggaagatgaaggctttggtgtctagctcgtgcctgccgtcaagcgcctgtggtcgtcgccctagtcttccgctgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacatgtaccgaaatcagaaggatgaaatgcatggagatcaagctatatatgtcattctttctctccgtgctcatattgatatattcatatataatattttcatgtgattacataagcatgtgagactaatgttttgtttgagccatttcttgtttagtctcttttcacattgagaacatggagatgatgaaggtatgcttctatcttagtgtacacatatgatcaataacttctattcttgtatagggtaagttcacaatcttttatctctaattatgcatacatttgtttctcacaaaaatattttgtatgcatacatttagggggagcaaatcctataccttggttatgcatgtacttgatccaagttattcacttttatttaattgagatctttacatgtgagcatataattgagtatatggca

SEQ ID NO: 78029 - DNA, 2252 bp, Oryza sativa
aatttaggtagatgcttcgctgattaaataggacaacattaggtggttttataactttagactttgggaattctcatatcatttggacactttggaatggttggcttatgttggaattggacacacacctctcttcctctttcaaaacccctaaaacctgttttcggtggggtttgggtgcatgccagttgcgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcagagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccagggtcgggttgccagttcggtccgaatcatcgtaggccttgggttaaggcaggttcgtgagggttcacggccttgattaataatattgtatagctctaggatcgtgtttacaaaatagctttgggcaactaagtgacttttaaatgctgtttactgcaaaacttaacccctatattattatccccttgtacccccttgcattaattatgcatctccggtgtggcttgctgagtactgtggttgtactcattcttgctcaatcttttcccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttgtatcatgtttgtgtggtgtaccccggcttttcctgggacggggattaatacactagcgttcgggaaaaggcaattttcccggtcgcgacaagcaattggaggatccgacttcatcaaagcaaattcctgggcatgatatttcgaactttcaattagcttaacagaagataaaagcatacttttgaggaaggctgaaatgtttgaatacataccggtggaggagggttgaaggcgttgtatggcaccactggtagcaaatgcgaatagctgaccatgatagcgtttgagaagattttgtacattctctccttcatgaccttaaaatcaagagagtctggatcttcacggttcgggtcatgcttgccatcaaactcaaaggccgtacgggatctctctttaattggagctagccggctcttgataaaatgccgggtgatctgttctccttgcaggccttgctccttcagtttcagcatacggtccattagggcaagcgcctgattctcccattggaagtgagttccaggtgtcctgataactggaggaagacaggagtactcggggagtgcaggctcggggttttgtacatagaacagtttgcatgccagcctttgtttgaggttttgaagggcatgaaaaaatatttttggctcaaagttcccctaagttggaaaccagcccccccaacaacacatggtttactcttgttcggttggggcttgaggaagaagatgcggcggaatagggcaaaatgcggcctgacgcccaaaaaagcttcgcaggcatgtatgaagttggcgatgtgaactatggagttcgggtttaggtgatgcaaactaatcctattgaaatccaaaatcccccggaagaatcttgaggttggaagagaaaatccgccatagaagaaatgagaaaataccacgacttcatgtgtgtcgggggtcgggaatgcttcaccgaacgccggatgtcatccaatgatctccttcgccggaagaacgccgtgcgccaccttctccttcagg

SEQ ID NO: 78030 - DNA, 786 bp, Oryza sativa
aaaagtaaggcctgtttgatttctagacacagctgcccttttggccagaataaaatctaagagatgctcaccaaggcacagacacatacaaaggattcagcatactgtctaaattatctaaatgtgttgcagatgcatacaaggccaagctttggacatatgaagtaacctttcaaatcataaatcaagttcataaaaattgcaatggtggataagaggaattagtgtctaaaaagtttgtgacatagcagtaagactcagttagaagatgaataaataaataaataaataacaagcaatttaaagtttctggtgatgtactaatgtggatatgaaaatcatcagaaaaaaagtttcaggtaatgtggatagaaaatcattggtacaattccaaatagaataatccatgtaacaaattgcacaagcaacagtaatagcatgtacatgatgcattacaaagaatgaatcacctttttcgacgttatgaagaaggtcctctttgcaaggtacatacagaaatggaaggacctagatacagaaaagaaaaacaactagttggaacaactaaggatgaatggaatagtctgaataactttctggggaaaagcaagatgagaaaatcaagttcaaaaggtaaatatctggtattcattcaacaacacaaattcgaaatatgatagagctaatcatcgtgtgtatatccaaactcaaaagaaaaaatgattgcacacagtattaaatattgcatataatacaagcaaacatcaaatatatggagtagagaag

SEQ ID NO: 78031 - DNA, 754 bp, Oryza sativa
attattccttatcccaggaggcaaggtacaccaaaaattgatacatttcagagtttatcaagcggaagcgtaaatagttaatttattacatgggctgcgaaggcccagcacacacaaagacaaacgagaaacagcggaagactagggcgacgaccacaggcgcttgacggcaggcacgagctaaacaccaaagccttcatcatccaggggctcctcttctgggtttggaaaaaattgggcaagactgagtacaaccaccgtactcaacaagacacacccataagtgcagaataaatgcaagggagtacaagggggtttataatataaagggttagggtttgcagtaaacagcattaaaagacacttagttgctcaaagctattttgtaaatacgatcctagagctatacaagattattaatcaaggccgtgaacccacacgaacctgctttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgaggacgcggctattcgaataggttatactctgatcagaggtgtacatctttacccacaagacacatctttctcacgtgtaaccacgtgccacataccaccacggcatacggacgaaagacatgacatagtttccaacccatc

SEQ ID NO: 78032 - DNA, 3052 bp, Oryza sativa
ggccttacgttccttcccacaatatggcccgtgtattagcacggaaagtacggctagttttaattgggctgacatgggttgggccaaatgttcccacggactccgaagtaaagcccttcttcttcggcgccggccaacttcgctcgccgccgcacaatccatttccataccctcggccgtcgtgagaaacacccttaatctacactgggatcaactcaaccaactctgaagtatacacgactttcgatccagccctaattcgatcgtgtgccgtcgctgatcctttttacttaacaattttttttaacagctgatcgccaccgtaaatcctctttgtctctgttcggctaggcgattcagttgattaacaatgcagccacgaacagagcagcagaagcttcctcatcatcatcaaatccagagcaagtacgcgctacctcaatttcatattataaggcgttttgatttttttttcttagtcacacttatttgtgtatgatcaaatttatatataaaaaaaagaaacttagtaaaatttataacaccaatttagtttcattaaatgtgacatagaatatgttttaataatatgtttagtttgtgttcaaaaatttatatattttttaaaacttgattagacttaaaaaaaatagacaacttataatttgaaattgagggagtacgtatttaacgatcttatccacaggtatgtatcgtaggctcctatccaccacctgcgtgttatatgtacttgtactatagtgcaaatgagcaatcccgctatcaatatgaaaatctgcttaggtcttattcgtttgattatattcccatgagaaaaagattataggggattaggtacggaattaatcccctcaaattaaatctcgattctcttgagtgagggattaaattaaaaaaacaagactttaatggttcgtttcctacttaagagtacaaaatttagaaggaaaaaactagaattgtgatgataagcgggaaataaaacagattacctgttgcacttgcatccctagattacgtacttgcttatacgaatgtcaatccagtactactacggtactgttatacgtacttgtgtacttacgctagtatagtgattttatccatattaaaaaaaagaagttataaacagtagtgaagtgtactagtgatggatcgatccaacatcaaaacaagctacagggatttgatcaacccctgcacttgcgtagagagcatttcggacactgtcagtcatcatctgaatttctgaaattctgaacctgacgtacgcaagaatcagcatcaagtacctgacgaaatggttgcttggctgacacttgtccagtgtgagctttccgttgaactgtcaattgcttccctcctttttcccagcttttctgtacttgttgcccatgtcgttcagttcctcatcttcttcaattttcttctccatttctcaatccattgtcagtactacatatgtgtgtacttctcgcggcgccattcttgtcatctaattgcaggttagttgtaaaatgtaaaatcgaattggacattttgaaccaggtcatggattaattgattaagatgctagaagaaattaacaagctgtgccatgcaatatatcatgcatgcatgcatgaatatgatggctaagtaggtactaatgctaatatagaagagagagagagagagagagagagagagagagagagagagagatcatctgcctaagtacatatttgaagaagctctacttaattaactagaaatggcgccaagccactcttcttgttcgatctactgctagctgctgctgctgctgctgctatactactcgatctcttgctcgatcgatcaaacgcagattgatcaagatcaactcgatctgatcatggtagacaggaaatgatatatgcatgatcgctcagaggcaaagtgcgtgattagccatgcaatgcccggtgcaactcgatcaatgggagaggaagctgaatggagagtaggagtcggagccctgcgacgaggcgaccatgtcggcggcgccgccgctcgccgggaacccgcaggcgccgagctggtccgccgcgtcgccgccgccccagaagccggcgaccatctgcgcgaggtcgtcgacgtcctcccggagccccatcatgccgtaggcgtcggcgtcggagtagcgccgcatgtcctgatgatcggccgcggcgccgccgcccctcggccggaggcagctctccggcaccacgctgctcaggtacccggagttgtcgtcggcgccggagaagaggaagtcgtggccgttcctgtccatgtccagcagcgacgacgacatgctggagcggtggggatcaaccgggaccatcaccggcatcgtcgagcactcgcccaccgacgacgcgcccgacgccgcgccatgtccgtggtggtggtggtggtggtggtggtgaccgtacgagccaatgtgcggcgccgcgcccacgccgccgccgtactgcaccgaggacggcgcggcggcggcagcggcgtactgcggcgcgtggaacggcgcgaggaacggcgggtagttgtaggcggcgtgggtgtagacgaagttggtgcgcgcctgggcgcccttcatggacagcgcggcgcggtcgtacgccagcgccgcctcctgcgccgtgtcgaacgtgcccagccagtgccgctccttggtggtcgggtcgcgtatctcggcagcgtacctcccccacggccgccgccgcacgccgaggaacctccctggctcctgcgcgcgccgcctgctgcgccccgacggcggccgctcgctcatcggcgacgacggcggcgacggctggctcgccggcttcggcggctccgagaacgccatcaggctggcctggctgctgctgctgctgctgctactgccgctgcctcgagtgttcatgaccaatgcaatattgcaatattgcaatgcaatgcaagagtgagagtgagagtgagctaggctttagctaagctaaggtatatgaatgagctcgagctaagcttagcttgtgtgtag

SEQ ID NO: 78033 - DNA, 3162 bp, Oryza sativa
tgatggaaaattttgtgctgagcatctggtgttgtgggtggtatcctagtataccctcccactcggtatttaccacttaccaggtccgattcccttcattcccagtataattcccttcccgtttatcctggaacgcagaagcttctcaagtattacctcaagtctttaatattaattttttttaactgttataggatgggttattagttgttttggaatcgaatattgttaaattctaaattcacgaacatgacggctttcaccttttaaagggagataatcaagtaatacctacaagtgaaaaatacctctgatcaacaaagcatataagatgacgtttgatagaacaggtagcggagctggaagataccaaccgtgtgaaggcgcccaaacaaccacaaactgtttattgtttagtattgcaaaactagattcataaacatcagcagaattacgagcacaagtgtgtttaagagactgcgtaaacatctctactagtctactacatccaacagaacgaacacgatatgatatccaaagtatctgaaacaggacatttgatttagagcaaaacagttcagagctgcaaaattaggctaatcctcaatggtaccaactgaccagcaagctaaagcttcttagcaactcttggctcctccactttttttggtaccctaaaacaatggaaactggcagataataagcaaacaaagaactaatagccgtgaaagagaaaaaagcagtttcaaggtacatatgctggagctgcagcagctggtgcaggttaccggtccctatttgatgaaaattgcaaatatttaacaaaaggttataatatagttttataaacaaaattgagctatgtaactagcttcagagaagaaaaaatcagtaatatctaaacaaaaatgcaaacaaggctgtagtttgaataaaagacagctggcaagcatgcactttcaacaatcaaatgcataggctgctgctgagtacgaaatgccatacatatgatagctgcagatctcaacataattgacgacaagcatccacttatcagatctttcctagaataaaatggctctagtgagtggtcaacaagaggaacatttttttaaacaataattttccaagtggcacatagaaccttatgaatatcttacctgagccaacctctcctacctcctggaaatcttcctttcttggcttgccatgctcttggcaagcttggcttcaaactggtcggaaagagttctcttcctagctttctcagcttgcacttgtggatactctccataaggtcccctcttgttgttgagcatgttacccttgaccttcatttacatgtcatggtataatacatagtatgcttgtcaatcttcttggcctcccggcacctgtgcagcaggcgcctcaggacgctttttacatcctcctcatccacagaatcttggtgggagtccaccctccctggaacccctatgattggctagtactacctccgtaggttataagactttctagcattgcccatattcatatagatgttaatgaatctagacacacatatatatatgaatgtgggtaatactagaaagtcttataatatgaaacggaggaagtacatgttaaggtacacatttataggcttgatcattttactcaactaaatactccatatccagagtggcatcccttctgttttggctaaatcacagctcaatccactcgataccaaactaaactccgcagatcagcacctaaaaacacagatctacgcaacaaaaccatggcgcatcataggcgcggccggcagaagaacgcgtacaacgagatagcgggcgagcgacagaggggagggattgagccagaccttttccgctgcgacacctgagcacgctcgccgtcggcggcgaggcgaggcgcttctccgggctcagcgacgccgtcttcgccgccggttcagctcccttccctcccttacctgcggcgaggtttgggaaatgagacgattaaaaggggagaaattctgccatgaagcgagctattatcctaaattttaaaatttaagtcactttgaagttttttcattatattctatttttaacatcagattttaaacggcaaataacacaaagtaagaaaacttttacctataaatcatttgtgatggcttagttcatttttttcaaaagcttgtcagtctttgttaaaatgtaaacgattaatctatcagttcaaataagcgcatctggtgtagtggtatcatagtaccctcccacggtactgaccggggttcgattccccggatgcgcattatttttgctctatttatgcattttttgttccatttttgtgtaataactatgctatctctttttttttgcaagtggctttcaatgcatagttttgtgtaattataattcattttttttattttttttgtttaataattatgctatatctcttttttttttccaaatggctttcaatgcatattttagtgtaataataatgcatcttttttttttgcaagtgcctttgaatgcatattctaaaggaaactaggggttggttggttcgattccccggatgcgcattattttttgttctatttttgtgtaataataatgcatctttctttccaagtggctttcaatgcatattctagaggaaactaggggccgaagaaaaaaaactgtgtaataataattcattttttttatttttttgtgtaataattatgctatatctctttttttttgcaagtggctttcaatgcatattttagtgtaataataatgcatctttttttttgcaagtgcctttgaatgcatattctaaaggaaactaggggttggttggttcgattccccggatacgcattattttttgttctatttttgggtaataataatgcatctttctttccaagtggctttcaatgcatattctaaaggaaactaggggccgaagaaaaaaaactctcattcagaatcttagaggctgttcagattgatgttattttcatccatacttttttttaataaagttgtaaaaaaatatctacatttagtttgttgccaaatttgataaatatataagaaatcctgtcacttgccaaaatttttaccattaaagtttattttaactacaatctgaaca

SEQ ID NO: 78034 - DNA, 4397 bp, Oryza sativa
cttttgcggaaaatcaattaaagatagctcacgtgcgaggaagacgccatcgcgagaggcggaaccgagcgaggaggaaaggagggcggaatctcgcgatccccaatccgtggaggggcgctccgatgcgccgattcggcgagagatcccgccgatcggggagctcccggggtgggattccagctgcgggatttgggggcgctgagcttgagctcgggggaggcggggggtgggcccagggctgcgagcggcggcggcggccgcggaggcggggggtttggttgtgggttgtggggttgggggtggatgctgtcggtgaggaggcggcaggaggatgcacgcggcgtagggctccggggcggcgccgcagcgggcggcatggaggacgacgcggagctcgaggagggggaggcctgcggggacgagacggccttcgtcgaccccgacgtcgcgctctcttacattgtgagtggtggcccgagcgaaatgcccgcggtttcctctgctcctgttgagttcgtcgcggtttctatgcttgtttggtagttgcccgatgacgatttaagcttagttgagtagtttgatcggttatattcgtttagagaacggacatgtctagcttaaattttatgcttcgtaggagtgatgctgctgatttagcatgggaatgaagtgattgcattgatgaatcatttgaagtctgatcaattcgttgcttcggttgtcggatactggaaacaattgcattggtgcagcatttaaagtttgctctttctttttttgtttgtttcgtagtagttgttgttgatgatactatactagtctatgtagatgaatcctttgatgacgctggttattatgtaatagaatgtgaatctactggttgcaattttggtattttgtgcggtttattcgagattggcagtattagcataacattttatatggtggaatcaatctctcctccttttcttttcccttttgaactgccaggctgaattcatggtgctattacttggatttgttcatgcaaggctacacgttatttttgatagcaggactatgtgcttcctcgagctacttttaatggatcaaacatcactcttagtctacaatgcccagtgaattaattaaatacgcttatgttttgaggttactgtcaacagttactttatagtaatgaaacggaattttaaactcaaaatttccaatgcatgctttatatctgaaatcctttggaccagaagaaacggaaagggaaacaaattgaaaaggcagaaatagcgaagtgtttaattatcaaaacttgcctataggtaggttgccttttatggataacttgcaacatgaatgcgatagacaccagcaactttcacttgaagacgatatattgtattgtgccaacaatcaaatctgttgaatggttccttttttgttcttgatgtgcttttttccctcaggatgaaaaaatccaagatgtacttggccattttcagaaggactttgaaggagctgtatctgcagaaaatctaggtgagcagatatgagttgctgacgtagtcattttcactttggtacactatagagagacattaaaacaggggattaaaccatgacaggatcgaagtttggtgggtatggttcattcttgcctacttaccagcgttctccgctgccccaaactagaagtccacctaaggcggcaaatgttagctcaagatctccttatcaccagcctacagaggtgcttaaattagttttgactgtaaacattcaatgttttaaaataatgttctgatgagatgacctgtaatttagagcatgtcccagaacactttggctgtggcagctccatctgtttcaaaacataatggttccatggtgccactttctgatgattcaagtaagaaggaagtacatcaaagcacaaaagttgaaagagcctctagcacccaagattcattgaatgggctatctaagtctagtgaccacaatagatttaaagttcggatcaaagttggttcggacaatggtttggcaagaaacaatgcagctatttacagtggtttgggtcttgatatttcttcaccttcatccatagaggatagccctgatggctgtgggagcctctctccagaatttaacaatgtgccaattgaatctcccaggaccattcttcaggtaaattactgcatgaactctttgcacttatttttcattatgcaaggttcatacaatgaataactgtcttcattctctaaatatatggaacagatcatgacatgcttttcagttcctggagggttcttgttatcccctctgcgagatgatcttgttcaactgacacaaaaggttgtgcctacatcaaagaaatgggaaacaaatgcaaacacagaaaatgtacaagaaagatatgaagggtatgcggctaaaagggtgaaatctgatgctaagaaaaagaaagctgtagatacgaagaggtcaaaaagcagaaatgatgtcagcgcagttatgaaaaatgagattgatatagaaacacctgctggtcaaaagatcgtattggaagctctcaacataccattgctgtctaatcccagaaccatggaggcaaaggacgggagccagtttgaagaggatcctatgcgagacaccttggtggaaaataaagatgcccgattgaaagaacggaccatcaacagtgacttaatggcaatcaaatatgaaaatgtcaaagccgaggcagcggaatgtttagagaacagtggtcctggcagttcaggaatggatttttcagcagtcaagggggaagtgaaattcaaggcagaaaaagcagagatccatgtagaagacaggaatactactagtgaaaaggacttccaatcggatagaaaacaagaaagaaaaataaaaacagagagtaagtgcaatgccacaggagttaactttgaaggtaacaaggttatgaatgaaagaacacctgttgtcggcaggagcataggaaaggtttctagtaaagaaacattacttaatgatattaatgaagaaaatgtctccaagagtgagtccagaagaagtcagaaagagcaaaacatgaatgcttcatcatcttctgatttcctggaagatgacaggggtgtcctttcttctggtgcagttaaggagaggaaaaatgattcgcaatccaaatctagccatccaggaaggaaacccaaagcaaaatcacatagagatgttagggagcacttacctgaaggatcttatggaggcaaggatgatacattggagaatggaagtgggctgggagagttacggccaaaaaaaatttggaagaatgatagtgagagggattctgatatgcctgggacatcaaaaagggaaatttcatctagtttgaagaatgataggcacacacctgctgaggagcagaggatgcatgtacctccatctgttagtgcacctactgcaaatgcagctcctatgcttcctgcccccgtcgtgatagaggaacattgggtatgctgtgacatatgccagaaatggcgtctcctgccatataagatgaatccttctctgctaccaaagaagtggaaatgtagcatgctacagtggctgtaagttcaacttttcaaatccacatataatcttcaaatttcgtttattttagtaccttatgttccctttatacttcctgctcattttgctgcctctcttattacttcattgaaccaatgagtgtatcagtattcggtagttagcataataacatgtaataagaggcaccatgtgcattgagggttgtttgattggactgcctaaaattactccatccgttctaatgcatatgtttgattattatttctcctaattatatgttctcaataaatattaaagatataatggtaacacaatgcttttaatgagaaacatactaatgccatcactaaaattgtattacatggcgaactttctttccgttctatctcgaatgcaagaaattttttgggtggagtgactagtggctacaggattggagtttgggtatactcttttaatggtttcatgtgccccctatatgcacctgaactgtttaggctgtagttcaaattaaaaatgactatacagtagttaatgttattttctgctatcctgtagctttcagtaaggtgatacattggtatgcatgagtaatgttatatttattcatgttcgtgcttatgcgggacattttgtttgtttgttgctgaaaagctacattttccaacttttgcagaccagggatgaatagatgtgaagttagtgaagatgagactaccaatgctctgaatgcactatatgtcagtccagcccctggcaatggcgttgcttcggttggacattctcatgttgcttcttcaggg

SEQ ID NO: 78035 - DNA, 19271 bp, Oryza sativa
tctcctccacattaattaattagctgttgtgtaatagcatcttgtaaaaggcttcaaatagagaacatcacataatctatactatcttcgtttcaagttaattataagacattttagcattgcacacattcatataggtcttagaacctgaaacggatgaagtatcaatctagtggatatgctgatttttttatttcttatgaaaaaaatgtttgcaattgattaattaagcatatataatgcagagtgaaattagcactgttaattcctcttgtttgtttaactttggagcatctagaaaaggcttttcttggagtgtacaaagccttgacttccatccctcatgagaacaatgagaatttggattcttatggagagctgcatttggggcaattcttgcatctaatgccttagcttcctacaaatgcaagtatagtacaatgagaggagagctacatgtgtagagtgcatgcagagagagagatcttatctgatgaccttgacttcccctactacacccctctcttgtgtgtgaatttggcatatatgtgttggcctgtgaaaatattgcattgcaagatggggtcaggtcaagccctagctagacatctgaaaaggtgtgaggaggagaaggtggtgttcaactggagatggggagaaaaaaggagaaatctaagggcaaggaggctccacacaatggccttgacaagatgtactagaaatgcataagttagttaatttgcagagagaccagattaaactgataattataattatgatggaaacgagcacagcacacaagacacatgttcttgtctattccttagggtcacacccgggttttgggggtggcctttgcactactttgactttagacctcccttatagaaccaacaagttttgtggaaaagacacacaccccaaaaaaataatatgtatgctaggacagtgtgggtgtgggtgtttgtgtgtgtgtgtgtgtatgtgcaattgtagaagtatgcaaggcagttcactaaacataatcaagggaaaggtagaaaaagaccacttggggcatgcacatttgtctcaccaagttgtggtttgaataaaaggagatcagacagagtttagtagtgaaaaggtgcactcacaattcacagaacaaaagctccacatagaacgcttactttaatcatttcgaatttgaactctgattttcaattgttgattctatgctaattccaaaaaacttccatatattagatattttggtggatatcattccaattgtattggtaccttaacaattgtcagtgcttgctacgaaaactctgtttctagttttcagataattgatggcaattaattagtactgcatcaagttcaaatcttcagctcgcagattggacaaggttattgtactggtcaaacagttcgatctcacagtgttagtgttgctgttgtctatgtgattgattactaagttattaattaaacaagcgaccaagtaccaagaggagagtgcactacagcacacttgtcccattttatatcgaccaccaaaaatgacaagcaattacgcaactgaagatgatgatttggcactgatctaacgaatgaaagattgttcccactcttcaagttcctatgatccatgttgattggtctgatcatccccaatggcattgtcctgcatttgactgaacaatgattaacataagcatgcatggtttcttgttgttaactcttttgtttacttgggattggcaggtggcaggtgatgatcagtgaagcagcatatgatatctaaactgagagtagtagtagaagaagaagaagctagtacagaggagtgtatgtgttggagctaaaactgacaagtacgagactacagctccttgcaaaagggggctcctgaccatacattgctataggctggctctacactctacacactactactgtctacacatgcaattatacacacagagatgaaatgcatcttcgtctctcccagtcccagctactaggccacttgtgcgagctttgcctacaaggatgatcatggatgcagaggcagaggcagagcacgcagcaaccactccctggaccctgcagcagcagcctgggcaaggctatgtaggtagaagaatggagatatgatgtgtggtagatatctacatactatataatagatatatatgtttttttggatttaagtaagatacatggtagaagtgtatgccatgagtgattttcaggggacatcggtgttggtcgttgttgcttaaggagaatgatggtgacaaaaaatgtatgttagagatcagagtcttggagttctattataaagccccgttcggtagtgagctagtagtggcaatgttttccttttagcatgttttccaaactgctaaccgactgctaagattagaagcttaatcagttgctaaacaatttggtatgtgttttctaaggatttgagtttaaggactcttgtatggatttttatttgttgatttcttaactaatgttgttggtttaacttaactagttttaaaagaggtattttactgttcttaaggttgtgcagtaccaaatggcaaatcgtgaccgttgatctagcatcatccaacggtcaaaaatcgtccgtacctcattgaagcggtatcgtgggtgagagggtacgtctgtactttcacgtgcggcatcactttctttcgtgtttcgctttcttctctctttcacgataggaaaaaaatcgccggggaagagcagtgagagaaactagccctaaatcgcagggctggggtggcgagaggcaagggcaacgagagatggtggcgagagcacgggcatgaaggtcacgaatcctagatggggacattcccggtggtagcctcgatgcgactgtagtgtggtgacctcgatgtgcgatggcggcgcggcgcagacggccggcacggacgacctgatgcggtagatggaacagaggagaagagagtggcacagaggatgtcgctattggctgagtgggcagtgattagcagcggtatctcattttcgttagcccgatcatacccctgctaaaccaacggttatattatattgatacctcgtgttacattgttccccgtagattcttaaggacgggaaatatgatcgtttagaaaacattgaaacacttacactgtaacataaaacatatggtttcgtaaaagaaaaaaaaagtatatgcatgccattgggattggtgagatgataaggtagaggcagtaaaaaagaatggagacggctacgccgacgccgtgtacaagggaacagtaggtcgtgcgagtgagagtggcctccccgtgggacgacgtgtcgccgccgcattgccccgcgggacgccagccagccacagccacagagccgagccatacggccgcggcgcgcacgagagacttgtacaccggctacggcgccgacaacgctagctactatagcgcgcgctctgggctgccgcgccgcgccggccgctcccaggacgtgggcgcgcgcgtgcgcgtgcgcgtccgtgcgtgcgtgcgtgacggcgtctgcgcgcgcgccgcgccgatcgatcgatcgttcggctagctagctgtggtagctgccctgcgcacgcacgccgcgcgcgggctatgtatgcaccaccggcgcaatgcacaccgccgcgcgcgaccggccggcgccatactctcccccggcgcgcctctcgctttgtactcaactacgacttgcttctggtgtcttactacgtaggagtacctgttttcttttctttcttttttacacaacatttaacaaccctagctacaacattttttaattttctctcttgttaccatacaaagcatcaataataaggaatggaaatggtgatagctagaaattcttgttctaaaaaggagaaattatcggccaactgagcattgttttcatatcgtttttgaccttttccatttctcccatatagcatttttgtttttcttttccaacgacattttgcagtcgttaataaatagttaaattggtaaatatgaaaaaattttgaccggtcaataatcattttcataatgtctctgaccatttttcatgtgttaaagatacagctatgagcaggtttcaaaaaacgatcggttttcacgagaaccgcttggttttcgtgaaactgcccacggtcaatttagggttacatatcagttttaggctagtttccgtagtacattgattgaaaatccccgattttatcagtttttgggtaaaccggtgagaagggtttttttatttccaaaacgaaaaggtaaatcccggccatgagcgagtgaaaggcatgacacacaggtagctagatagcaatagcatagcaagcagctcgagtcactactcactagtagacgactaccagtgtgtcacacactcacactagtctatatacatatagctgtcaaatgtatacatgtgatgggtatagctagctcagctcttgaccgaccgggcatgcagtccaagtgtcgtgcgtgtagaggataagaagagtcgagatgatgtacacagtacagatggatggaacgggggtagaaggataggatgatatgtgtaggagtagagcactgttcacgtaagcacattgctgatgatgatgatgatgcatggtgtggtcgtagacgagagagagagagagagaggctaacttcacttgttctgcagaggaggcgacgcgtcagctgcctctgccagcgccccccgaaatggtaaccaaggattgtgtttggtttgctttggttgtgccttttccaccggggaaatggtaacatctcctcatacttctcctcctccccaactggccaaaccaacaagaagtatatacactagtagtagactactagtactatactgtactattggagtagtactagggctagtgctagccgtatagtatgagatattgagatatgacaacatttttttctcctgtgttttgggcctctttggatcattgcccaaaaaaaatggcattcaaaaatcgtcactcatttggtttagataagaaaaattggcattgccaaattatttagcatcctttctatgccattgcatttggcttggctaagattggtatctgcaccagtactgtaaaaaaacaatagtggtcaagctctatttttgtgttttttataagttagtctacgatattttctaatattatgtaatagtctaatatttaaataagtatgaacaaagcataggatggcattttacagcaacagagcccaacttttgggcctttttttttgccaggattcgagacgtacggcagtggcagtgtgcaatgcaatcgcagttcgacactcaaaaaggcaaggatggccacaagcttgggagatcatgctactgtagcacagctacagtaagacggcctacagggaggtatgatgagtttttaagacaatgttgactcctcgggaaataaccagcctgtatgccagattcattcgcccaatcactggatctcataatcccaggaaaagacacaacaagcaggaattctgcaagcaaaggtccagacaggttttgccaatcgtttgagagatggaagaatatccagttcagaataacaccatcatttcattttccccccgacatctcaagctgaatcatcatatcagcatcatcgtacaaccaaaagaaagaagaatcgtatagaatacaacgaaattcgtgtttgactgagttcaatgccccaggtgaggaaacagcaagccagcacccataattcagttttgcagcactggatttcacaggttttgtattgttcactgtaaattgtatacaagtgctagtcttgaggtcttgcctctctcgacaaatgtggcttccggtcatcatgtgacaggcatgcagcccgcaaatgggatttccagtgtcaaaatgccaggaagagcaagtgcttacaatgcttacaagaaatgggactcacaaaaaagtgaaatcaagaaaaatgacaacagcaacgccttcagctccctaataccagagaagttaaagaatcatagggatttcaactttttcttcttcgatgctttttgggacttggaatctttagcagcctgcatcccagaatcgttcatcagtattttccaccaagcaaaaatatgtaaaactaaaaatattcaaactattttccacggtatagctatgtgtggctgtgctattatgaacggagtatgtccatctggtaagccaagaaggcagtacttagaccctgatttttaccaagtagactatgcaatgacagtaacccagaagcttagtctcctgattctcctctttcttgtgaaggaaaactagtaaaagggtattacagtattattacctttagatttttctttttatttttcttctttttcttgctctgttctcctccgttttgaaaactcttatccttctgagcaatatgatatgactgtcagatacatgtcaaaaaactttcggcgtatggtatataaaagcagcaaaattgaaacaattcacagacattctcaagtgaatgttcatatacttgccttattcttcctttttcttttgacccccttggtttcttctccatcttttgaatcatcagaatcctgatagtcttgaaattgtaagcgcggaaatcaaataaacaaattatatatgaaagttatcatcaacatatatacctcagaagaatctccgaatgatgaaacgtgccgtactattcttcctgaagttgacggttcacctagattgacagaataaaatggtaggtcaaattcactggttcacataaacagttaataatgggcaaacattgggaatgagaaaaacgctggtgtaggtcaatcctaataccttagcagacaatgcagaaaccaagcaaccttagcattagctggtggacaaaataaatgtatgatcaagtcttataaccgtttttactaattaaggtttaaattgtttgaagtttcatgttcctatataagacagatgtgcagcccacctttgagccattttctatcttaaccatcaatccatcatatcatagaaaaaaaatatcgagcagtcatgtaataacaaatgctccaaattacggaagaagaaatgggaaaataaactgtaagacaaggttaattttcatgctcttatagttttatgagtatttgtactaaaatgcacaccattactggtttacgtaaatcattacataatgtaatctataatgacataggacacgcaatacatgcattccaaagaaccagagtaccagacatatgacagtgagatgataagaaatccgtacccttgctagcctttattgtttcttttgcatttctcacagccaatttgacaaggtctgggttcagagattccagcccatcaggctgctgaagctttctctcaaggaattttgctaaagcagcagccttgtttgtagttagtggtcctccaggatgagccatcctatttaaaggagtacagtatttgagcctttcagggtcatgtcatgagcataacaaagaacaaaaacccatgaagatcatactttacatagagcaagcctacaaaataaagtccacagagctagactccttggtcactcgtgcatgagaaaaacaataacacaatatattccaagttatctgctatgatatctaccatagtttaaacctaatattatgtttcaggcaaaatccaccagaacttgaaccatcgctcttttttacttccaaaagcgagcatagatgcaagaggcactgattaattcatagtataaacacagctataccataatccaaacatgatagttgtcaaacatatagtatttcgctatctcagcaatacagatttcaaatatgtgatccaaatttctgctagcaatatattcagattagtttcctaggaggacttgaaatctttccctattaggagtcttatcttttatctcctatatatgctatattgtaagccacatgggaaggggtgacgtcccattgttattcccctgcgtttgtaaccaactcctcaatagtgatcattgccaatagacgctcatggtttttccccgtaagtgttttctacgtaaaaattcgtgtctccgttgtgcatatattttcataacaagtctactttgtcatttttggcttatgtgcaggcaacaggcaccagaggcaccttggggaaaagaaggcgcagaattgcaaacctcctagcttaattgcttaaacagtgagaaattgctataaagcaactcaaaatcccagttcaatcaacaagcctataaaaacgcacataaatgatactcctaacgtaataatttgaacttcaactacacgcaattccttcctctgaatcacacaaacagcaaaacgaccaaaccctaatccgcattcgcaaggaaacacacctagcttagctcgatcaatctgctcacgaaaaaggtatagaactaatcaagtagccgcttatacgcgggaatctagctttccccacaagtgacactagacgaatcgcttgaatcagcaaactccaagctacgaatggatctggagtcagggaaaatagaaggaaaggggggcgacggatacgatacgacacctgggctgggggcgggaaggggcagtaggcgctggaagcggcgcgaacttgctgccccggagcgcgcggcgctcctcgtcggtgaggtcgccggccgccgccatgacgccggccgcaccgcacgatcggcggcggtcggtggaggtgtgcgaagaggaaggcggcggctcgactcctccggttcagttgggctcttggaccttctttgggcgcggtcggagtcggaccggactggaccggagcgtgtgttgtgttttgactttttgagttcaaacgggaggagtacttctgtatgacatacaggtgggtccgggtataaaaattcacgcttccgcgtaaactttgacgaatttttgtactccatactgttttggcttctacgatagaacattcatatggctagtttatccaaaacttggacagctagttcaaaatttggcttttaataatttccatgtgcttcagacattcatatgatgcaggccaagggtgtgtttagttccacaccaaaattggaagtttgactaaaattgtaagtttaaagaaaaaagttgaaagtttatgtatgtaggaaagttttgatgtgatgaaaaagttagaagtttaaagaaaaaattgggaactaaccaaggactaaatagtgcgagattctccgaagaaaatctgcaaagcatgatcaatgaatacaattcatccaagattcagaaataggggaatccatttcccaatcccacgacatgctaagaattgatgtagtagtattaatgtagcacgcattacacaaagctcgtcggatcgagaaatcacaaagatgctccaaacttataatgccaggacaaaagatgttcagacttattgccatgttatgtgctatcattgaacattttaacagttgaactggatgtattcacaagatcaccgaagccccggagttcagatggtagcagctaaagctagttctgccagcatctttacatcacatggtaactcggcaactacattacatgtataaaagagcaaacaaaatgacgtacacagttgaggatgaccaacagaagattcagctcaaaacaaagctagtattactgggtagtacggcaagcatgatcagaaaaatcgatttagacatagtagatcatgccgacttcgacgaggctaatgtggggtatgtgcagcgccaccgcgggacccctgcagttcttgcggaggaacgagtaagcgtagtcgatggcgaacgtcttgaggaagttggagttcttccttgccttcacgtaggagtggccgatgatgtaagtcacgccggcctccttggcgtccaggagatcagccagctcgtcccgcacctgggggtcgatccgctcctcctccgcaatctcaaaacggactctgcgacgccggctgagactaccggactcctgctcgtagatggactggaggctccggagcgtctccgacctgctgctccttgtcagggacgtgcctgaagcctcgttattggagtccctcatcaccagaccggtgccggttgtgtcctctgtgtgtatgacagccatcctcccttccgaagattcgtagctcccagaggaggctgcctcctcggcttccatttggatgaacttggcaatgctcatcaccaagtggttctcaaagttctcgtcatctttctgcacatctttgtagccatacctcacgatgcaccggtacatacggtattccctggggccgatccgtccaatgaggtaccgttcgtcctctggaacgaacggcacaggtacggacttgacgcaaacgaagaccagaacctgatggaaagcaggcaggttggtgacaaagtgcgagaagatggaaggcaccccggtgaccagctctgtgtagatgagaccgattccaggcacccgaacgatcccaaggctcggaccaagtgtcaggatccatttcattgagaccttgttctggagatcaaacaggtacttcctccgagagccgtagtgccatacgtacatgacgagcatgaacacgaaggcaaatacgattggtgcccatcctccctgaggaactttagtgactgctgccgacaggtacaccacttcgattgacccaaacgccacgacaaataacaaggcgagcaggatgtttttttgccacacaaatatgataaccaatgccatcaaccaggtggtaacaaacatcacaacgatacacgcaagacctgaaatcggcagaggaaatgacaaatgagttgcaataggagtaacataatactaaatatagcatgagaaactcctttgttttttgagaatcagataagagagctatcatctctcaggagaaaacaagaaagctaataaactagtctagttcaaaaagatgcaagcatacattggcatgcatcgccaaattaagttgaagagtgtcactattaagtagtgacctattcagaaaaataacagctggtgcacctattatgccccatgaggaggaaccaggtagctatatgaatgtgattctgaattacagaattgttgtctactataattaataatgcacattcctttaaccttttaattattcaacattggaatataaattcaaatttacatggcatgctggtaataggggatctaaactgtttgaatttataacctaaagcagtcctatagtccatactgttttcttagctactgcagtattgaagatctgagttgatcaaagttaagagtataaagaagtgttcaaacttaccgtaagcatttccaataactgtcgtgtctcggaaaccaagtgtcacagcaagacaaagaaccatcagaatccaattaatctcaggtatgtaaatctgaccatggatccaccttgatgtatgcacgaccttaacccgtggaaaacatcccaaagaaagacactgcttaacaattgaaaaggtagcagatatgatagactggctgcccacaaccgctgcaagagttgcaatgacaaacactggccaaaacagggatcctgcaaatatgatgcaatatgaagcaagaattcttggcaacatacaaaacaaattattccaaaatatgcttggagttatgaagattacttggtacagattggtaaaagctatcttctacagctgacatgtttctggaaagaaatgcagcctgccccatgtattgcagcacaagacagggatatatggcaccaacaaaagccaactacaagcaggacaagagctggagtcacaacgatagaatgacaaataccaccttaataacttaggatgcaatatgcatccccaaaaaaaatgggaattttatgttgcaacttgcagcataccctaatagatgcagcagtgaagtggccaagatcagcaaacatagcttcagtacctgaagtcacagaaattattaggaaacccattcactaaaattgtaagataaatggcttgagccacatagaagggctattcaaattcacctgttatagcaagaagtactcctccaagagaaagccaaccatcttttcctgtcatcttgaagaactttataacataatgtggagaaagagcaagaaatattctgtggttccagtggatgatattataaagcccaataacaccaatactcaacagccatactacaacaatgggcgcaaacataaatgctaccctatgagttcctcggtgttgcagtgcaaacaggccaacaagcacaatacatgcaatgaacaccacccaacctgcacaacagcaagttagttaaggtagtgaatgctgttcactgaaagaaacccctagtaatggctgctggaataggtaactgcactaaaaatcttgtatggtctcctaaaagaaaattgtatgagagagagattgagagagatctaacaggttaaatctacatcaactgtagtagcctgcaaattcagttagaattaagttctcactatatgactcgatcagacaaatatgctcctaatatggtatccagatttaaaactttaaagcagcttgatgatactaatgaacttcaaataagaactgggtattttgattcaaataagcatcttgtatggatgttatttccaggggagatttataaggccaaaggccaaagcggatccaaagtttaggaagttcaacttatgacatacagttagcaaaaaaagcaggtaacttacaaatagccaacaatttgcgacagtgtgtaatgattagaaaattagcaagactagatggactactttcttaaaacagcttgctacagaaaatgaaatgattagaaaatgctggtgctagggaatatgttgagcaaatttcttagcagctcataagcagtagaaaagacagtgctaaggcataccatctggtattcctcctgggccagggtcttttaaaccagagatggctgacaagactgcagcagacacaacaagagaatttattagcaaaaccatccaggtgaaaaagcatgcgttgaataattgaaaaaaaaaagaaagacgaagctaatctaatgtacatgccaggcataccagagatagcaggtgtgaaaacaccatcacctatcaccatgcatgcgccaaacagaacaaaaagtagtaaacaagtccgtagcttcctgtgcttctccaggaatcttttgagtggagaggaaataatgccaccaactccaggctgatagtacgttgaaagctcttcgtctgccgattgctggtttggaagcaggctgaactttgcatgcctgcagagaagtgagtataaagcaaatgttccacctacataaacaaaaattataatcaatcaaaaaacatgataaagatgactcttaaactaactagacagaacaatgcataaattcgttaaagaatggagtagcatatttattgacgatgacatatgtgagttgttacagaatatgatcctctatatactcctgatcggcttaggcagatgtgcacgatcaaaactcaagcacttttgggagttgaagaacataagttaaaatacaacgtatgtgtttctgttaaatttctgataacccagcatatagtactatgaagttactcaccttccccattatcatctgcgttcaatacaattattacatacttcagcaacggaagaagtgtcaaagtccaaaatatcagcgaaaacaatccaaatatggttgtctcatcacggtaattattcagcctcccagaaaatgcacttttgtagacgtacaggggtgatgtactcaagtctccatagaccacaccaaagctctgaaatgctagcagagagatagttctgcaataacttttccattggtcctgcaaaagcacaatcatcagtacgccgaccctgtgattgtgaatagtaactattactgagaaccgatcagtacagtccagtatgtaaaacaagagagaaagcagatattggtagctgggcatgtattaaacagattattaatttgatattggtagctcatacttttattagactactcttttgtcgaggggaaaaaccaacaactatagatcacgcaaatttagaattgtcgggattaaaagtggtagctgtacacgtctcaataaaaaaaatgtgatgccaatgcgtcaacgcagcaaaaatgtgtaatactaatgtactagccaaccccatccccaaccaaacaccaaccaaaagcacagttgacttgattcatcaactacatatggctctaaaaccaagctggttctcagtttcagcgaatttaagcgaaacaagttcaccggattgatcagcacgaccgcaccgtctcgtattcgattgcaaacagtaactcgccgcaccccgcttgaaatcgcgaaatcaaaatcgaacgagaaccctctcggaatcaaacgcgagaccttcctgacggtaaaaaggcgagcaaaatcgagacgcgcgcgttatcacctcggcgtgacgaccacatcggagtcctaaccactcgcggagtcacaacacacaacccacccaatcgccttatccaaaaaaaaaaaacaactcctcccaacaatgaacagatggggaaaaaaattcacagccccttctcgaaatcgagcagaatccgatccaccaccggagacgggttgggggaagttacctgcggcgcggccgggccggtctctgcgtccattgcgctcccccccccccacccaccgtgacgacgggctgcaccgcgaagcaagcagccccagatcaaatcagatcaaatcaaaaccaaatcagctaacccgcgccttggcggccgtggggtcgcctcgccggagcaggagagaccacgacgacgacgacgacgaggaggagggggtggggctagcaagaggagagaagcttccacgcggcgcctggttttatagcggaggagagcgcgcgcttggagagctcacgtcgccgtctcgacgaagaacgcgtaggagcagcgtggtgcggcggcggggaggcgggggcggggtgggccccggcgcagtgggttttagggcggggcgggtgactggagtgtggggtcaggagatgctgccgccctgcgggatggtgggccaggggtggcagcgagacgtgtgttgccagccgggccgagaggagcctgcccggtcgtggcctggaccgtggggccccgtatcacgcggacacctagacgcacgggtgcaattttgacacgagcggctgggatctggtgtgccgtagctgacagtggaccaacttgcggtcaggatgtactccctccgtaaaaaaaaaaacaaaaaaaaaacactaaacgatagggcacagtacaatgaatatgggcaagacgccaaaaagcgacctcttgcgccatggctgcgacaacctcagaccaaatgcaccttccttttttttatagggataggcttcgtggttcatctagataataatcaaacacccgaataaattgtgcttggtggcaccttgtatagtttattaaacacctctctgtagctatactcccttcgtggctctgtcctagaaaaaaaacttgtgaatacgtatttagatatggttagaaattggtttttttctgaataaataattgttaactactacagttgtatgactgtagagtcggttgaggatgctcgtgagagcttacatcaaaaattggcgttactcatctgccaattaccaacgagcttataatggttaaaacctacttccttggtccaaaaaatcgaatctaggactggatatgacatattctagtataataaatctgaacataggtatgtccagatttttagtattagtatcatactagaaaaaatgcccgtgcgttgcaacgggtaaaaccatttttgtattgatatacattgtaccttttggttttggataaaaacttattttcttccttcctattcagtctcggcccaacccgctacttctctctacttggcttacttcttttgaacctagaccacaagtagagctataggcctatctcgtatagtcgactgccgtgttcaacctcgaagataggaccgtgtagtatgatgccagaaccaatactccccatcaaatacgatccaatctttctcaatctcctaaaattggttgagtgctcttattcactcgatcttttctttccgtttttatcaaaaccgcagcgaatccataaaactctaggatataaatggtgacttctaaatatagagattgaatctgataaattaaagcggaaataaaagaaaaaattatggggaaaatgatgatggagtagtggagaattgatttttcaatcaattggaggagggaaagcatgagaaggccgatcgatgtggcggtggtgctagagttcggcccgacgacgaaaaaaccgggtagataaaaaaaaagaatcctcacaatgtgcacagaccctttctcatgacaaaaattgcgaataaaatataaggacaaaaaaagcggatgggaaaaaaataaaagcggaaaaaaagaagaaaaaaaaggcggataaaagagagggacttttttttgctgttttataatgtgtttttttctctggtaatttttacggtcttttttctacaccgttttttagacgacagtttcttttttcgcgtggctttctttattttttttacgatcggcgacttttatatttttgtacagtcggctttttctgtttttttcagcttttttccgccacattatttttcccgtttccagtccggatcggactttttttcgctgtttttctttcgcgtttcattacgatgcgttttcttttcccgcatgattttttttcaccctttctaaaattatggaatttaagtagtagagattaaaactgaaaaaagtattaaaacctactcaaatacagatgacgtaccaaaatattggcaaaaatatcttaaacttttataatatgtaaagattaattactaggttattttttataggagagggagtactctacatagttagtgtggacgttctaatacgatggaagtatgatcctcggttgctgctaccaacagaacttgcaagcatattcaatccgacacctcgtttgagcacttgaagactagggctgtgtttagatataaagtttagatccaaacttctatcacatcaacatgtcatacacataacttttcagccacatcatctctaattttaacaaaaatttaaactttgcgctgaactaaacatagcctagaattattaccaaaccaaatccaatcgtgtctctttaatatatctgcacgtttattctacgaattcatagtagtagctctataatctacgtacggcttctttgccacggaatattatgatgaccattaacgatcaaactaatttcaacctgtggtcaaaaggccatcatattccgcgtgaattaattgagctgctttttcagatgaaaacgaagataaaaggtgttaaacactcagactccgtgactatacgtgcgtgtactgaactccaaagtccaaaaacgtcctatcttaagggcgctcgggactgaatcgtgcaaaattctgatttgttcatttagtttttttttttggtcctagcggaacttgattcgaatagtcagatggcgtgtcctaaccaccttgtcaaaaacaattccggccacataatgaccccagtgactccaagagccgtgatataattaataataagataaagtacagtgctcgtgagattgactacaggatcgcatggaaccaagccgatctcacaaattagattggaaaactgcaattattgagttaatatatgcacagcatatgtcatctaaaaaaggagtatacagcacaggatccttattttaaaacccttttgacaatgaccagcacgtttcactctactacaattctcttacctccgtcgttttccacgtcgtgtataatatgttcttggtcaaaaaaataacaggtgctcgctgatttattttataccaacatttatatattcttcaagagtttcgagcagctcatatatcctttttagggtgtgcttaaatgaagtgttcggcagcatggcaatatagaagatttgtgttgttttcgcgtgcacgcttttcgaattaagatgtattttttaaaatatctatggaaaatttgattaaaaacatatactaaaaaattttaaataattaacactcaactaatcttttttatcaaaacactcaattaatattgcactaatgcctaacctcgttttacttattttcctaatttttttattttattacctctcgtacacacactaaggctatgttctttcctcatgattgggaacactttcctccagcacggaaaacaaagtagtccattatcgcgtggttaattaagtattagccatttttttcaaaaatggatcaatatgatttttttaaacaacttttgtatagaaactttttttaaaaaatgtactgtttagcattttaaaaagcgtgcgcgcagaagacaagaaagaggggattgggaaccctcaggaaggaacacaacctaagaagctttaagctttaggccctgtttagatcccaccttaaaatttttcaccctgtcacatcgaacgtttgaacacctgcatgaagtattaaatataggctaaaaaataactaattgcatagattgcgactaatttacgagacgaatcttttaagcctaattgctatatgatttgataatatggtgctacagtaaacattactaatgacggattaattaggcttaataaattcgtttcgcgttttactgacgaattctgtaattagtttttttattagtaccaaaatacctcatacgacaccctatataatacccgatgtgacacgtaaaaactttatgccggtgattaaacaccccattagtgccagtacatactacgtgcaagtggagtaaacctgttctcctggcaggaataatgaattaattagttgcacatgtgaccagtgtgtgtgcacgtgaaggagtagatcacagctaactgaacgacggctgggccggggcaacaacgcgattggcacgcggaatctgcaggggattggtacatgaagagatgagagagcccttgtcgccacgacgagacatgcattcgcgtgtgacgtactctcgcagtctcgctcgctcgcctcatccgtggaagccaaccaccgagcagggccgtgcttccggac

SEQ ID NO: 78036 - DNA, 25130 bp, Oryza sativa
tagcctatgtgagttcttcatacattgatatatataggcagttcaaaaagttctggtttcgagagtggtttatcttttatagtgtatcggatgagttcacaatctgttatctatgtaataacaaattaaactgttcactatgatggtattagcaaattgcacccaacaaatctagattggatatcataaacgagcatattggatagattttggcaagtcataattaagtttggtttgaaggtgacttgtgaaatgtttgtcgggaagatcttttttctgtcttaagtactatacttgttttacatcctgttgtgatgttgctcatgaattctgctgcataaccttattgctacatattcaaatggcaatgccgttatgtggagtcatatggtgatgaaccaactcattccattccccaaaaccaaaaagggttaggtttgggattagaatctaatgaccctaaaaccctgaagtgaacacctcataacttgatagtacgttacttacagtgcgtcatgccatcgattacagttatgatctgatgactctgtttatattcttagacaaatgatgtcaactgtgccttcgatgcaactcggaaatcacagatggcaattgcttcggctgctagcaaccaagaaaatggaatagatggtctttcttcagtaaaaacagttttggattttaacttccaaagtgtgaatgatctactaaggctcgtgcggctttcaatggagtctatcagctgctgacatgttcagaatccaggaaaatgacatccctttacaaggtgctgttggatgtgcattccatatttgagtaatgtcccagacttgccagtagcatttggttgaaaagttcaactgtgcgaaattcataggtcttctcatttaagtgtgctggttaatttgtacatgaagtgtttgtcttatcttctattccggaggcctgtttttacccattgctagcatctagttggatggttttatccatgagggaggttgctgaagatgtgctttgcagattgcactgatcaacttgattttgggcaagactgcctagttacagactgcacttgataagcttatacacaatgctactggacagcagctcctttgtagataatcttctttcctccatgctgtaaatgatgtattttcgtcatggagttgacttatggttgaatagtatcatatgttcctttgagaagggcaaaatggtggtttccacttagcaattttgatggtacgtttcagttacaaataaattaagttcaacacactctccgcaccactaatgcttatgtaatgtttgattctttagcaggtcagaggacaaaagtgttaattagtgtgctaaccaagaaatcagccagtggtgtctctttttcagtgccacttctggataaagttcaagcaggtaccttcactgatactatagtaccttagtacattcaaaccttgcacctcatgatagtgcggaataaaatgacttcttgaatgaattggtctcatgctattctgcaaaggtgaaaatgacctcttcattgataccatcctaggttgtataggtaccctgtgacttttgcagtaaattagactatatgcttaagtgctgaaataagaacattgtaattccttggttcttctttctgtaatgctttctactctgtagggttatactataatttacatatgcatgcacagcaccaccactgtaaggttcttcgacccaaaactagaactgaaagttaggaacttccactatacagatggcagcacctgaactgaaaatacattgattaccattttccactccttactcctaacagtaatcagtgatgtttgtcttttctttttcagatttcaaacaagaaatcacttggaccatcacatgtgtatgaacaatgtacaaagattttcatgtacaataggctaactcgttccttgactatcagtacgacgactataaccagcgcgtgtacatgtatatatacccgaatggtcgaagcgtttgtcttgcgtgctggtacactcgtgacaccaatgtacttttagtccacatttttcttctggcaaattttgttagtttcacattagtcgttgagatgtgatagaacttatctggactgagaatgtgttgcagaatgcaaaataagctctgtattctgtactgtttgtatcgcgaatcgcatcttcagttcagttgagtaaagtgatgctaattttagttatgcaattatcctttgtttattctgcaaatgaatactgtggcggcaacgtaaatctgcatgtccacgaaatcatgctaaaaactactcacatggcattctatatttaaaaaatgtgcctgctcgatcgtatgctgcaatgcaaatgtgtgtgtgtgtgtgtgtgtgtttttttttttttggtgggggggggggggttacaatttcgatcagaaaaatcatcatatgctgcattgcaaacttgttaaatttggggttggtttcgatcagaaaaatcgtaaaaagacagttatgcaccacagttcggtttcgattaattttatactgatgtatcagatcaagatcatttccatttgcgaacaattcttcagaaatttcatctcccagcctaacacatcggccactgcgtatatctcttctgtacgcggatgcgtcgtgtcgtccgacgaaaacttgtgcaaatgcagtgcctcgccagcgccggcgtccacccagctgaacccgatctccttcttgacgcctctgtccctcatcttcctcctcaccttggcgacgccgtcccagtcgcccacgtcggcgtagatgttcgacaggaggacgtacgcgccggactccgtcggctccttctccgtcaaaattctggcgatcctctcgccgatctccgcgtcgccatggattctgcaggctccgagcaagctctgcagcgccgacacgctcggccccgccggcatccgcatcatgagctcctcagcctccgccagcctccctgcccggcctaacatgtcgacgacgcaggagtagtgctccggccacagctcgacgccgcgatcggcagccatcgagtcgaagatgtccctgccggcgtcgaccatcccgccgtaccggcaggccgtgaggacggcgaggagcacgacgccgtccggtgcgacgccggagcgcgccatgtcgccgaagaggctcatgacggcgccgtagctcccgtgcctggcgttcgccgagatgatcgccgtccaggcgatgaggctccgctgctccgtctcgtggaacgccttccgggactcttccaagttgccacgcttcgcgtacatgtcgatgagggcgccggcgacgtactcgctgtcgccgaagcccatgctgagagccctggagtggtacatctggccgtacgccatggacaccgtctccaccgcggtcaccgcgctgaggacgctcgcgaacgtggtctcgttgggtgtcaggcacctggccatggacgagaagagctcgagggcgtcgttgcaccggccgttctgcgcgtagcccgagatcacagcgttccacgcgatgatctcccggcgaggcatgaggtcgaacaccatcctcgcgtcgtccatgcgacgcgccttggcatacatggtgatgaggctgttcgacgccgccgcttcgccggacacggcggccttgaggcacgccgcgtggaccatctgcgctcccctcgccggacagtccgctggcagcgccgacatcagcgccacgaaggtgacctcgttcggcggcacgccgtctcgccgcatgccattgaacagcgtgagggcgtcctcgccgtccatggagatggccgtggtccatgacacgacgtcgcgctcgctcatggcgtcgaacagcctccgggcgctgccgggagcgccgcacttgtagtacatcgcgacgagcacgttgccgatggagacgtatccctcgacgcccagcttcaccgcaaagccatggacttgccggccgagctcgagcttcccctcgccgccacatgccgggatcacgctgcagaccgatatccggtcaggctggacgtcgccgtccctgagcatccggaggaacacgccaatcacctcggccgggcagtcgccgtcttgcgcgagcccgcagatcaacgcgttccatgagacgaggtccctcgccggcatatcgtcgaacacactcctggcctccccgagagaccctccacgtgagtacgcagtgacgagcgcgttgccgacgaacacatcagccgcgagcccggaccgccaagccagcgcgtgcagctgccgcacgaggaagccctccccccggccggcggccagcgagagcgcgacggtgcacgtgacggcgtcgggccgcacggcgccggagcggagcatccacgacgcgaagtcgagcgcctcggccgggtcagggaacgcggagaggatggtgttgtaggagctgacatccctcgcccgcgccgcggcgaacaccccgacggcggaagggaacgacccggtcttggcgtagcgggcggcgagggagttggtcacggcggcgaagccgtggaggccggtggttacggcgacggcgtggagcgccgggagggaggccgggtcggacgccctgacggcggccgagaaggcgatggggttgacgcggcggtggcgggcgagcgacgggtggggaattccgtcgaacgggtggtgggcggcagcggtggagagcgtgcggatccgcagccgccgtagtggcatctagtgtagtttttcaaccacggatttgagatcctctcactaaagtcacatgattttgagtcactgacatgtgggccctctttgttatggacccacatgccagagactctagtaggataaaagcccaagggccaaacccctcctcttcttcctccggtctctcgctcctcgcgcaaatctccggtcgctgcagcccttcggccatggcggcgtcgtccgtgctgcagcctgcggcggccgccgccgcgtggccgcgcttcctcccctctcctcgccggagcgccgcccaggtactaaggtttccttcacttcttaggcctgcaactcctgtttcgtggcgtggggcaggcaattcgtcgaatggcttgtggttgggaagaaatcaagaaattgcagcgcagcgacagtaaaattctagggtaattggctaaggtagtgaagatgctacattctcgggaacgaatcacctgaccgggctgaaatctgtgtagtgtagttcaaggcgtactgtaactttgtaggtgcagtttgtggtgaaaattttccatctcgtgtgttgtttgaaacatgaaactagctcagtcttagcttgaaacaacaacagaacttacttcttggtgtagaaacgttaggtgtgttgtgactactgactagtttcccataattctgtccccctttttggccttatccagttgcaatgtaatcttatcagatgtttctttcaggaagagttgcttgatacactaacagttcaacacaatatccttttgatgtttatgttccttgtatacaattactctgaatgagaaaccccccatttcatattataagatgctttgatttttttctaagttaaacttccataagttcaatcaagttaaagaaaaatatagcaactcttataacacgaaattaattctattaaatctaacatcgaatatattttgattatatgtttgcttgatgttaccatgtttctatgcttttctataaatttgatcaaatttaaagaagtttgatttagaaaaaaaaatcaagtgtcttgtaatatgaaaatggagggagtaacaccctattagcatccctacaacaaatcactgattcctgaactattttgtggttaaattaaaggcttctgaatagttcttatttatatccgaactctcagatgtgtcatttattcttggaacagacatatcaagttctttccatgcacaagtttgagtggaagcgccctttcagcggtaggtaccaacattcgctgcaatttacaacattcagtgacaggactggagttgtaaacttgtaattcaaactttggtttcacatcgttgccctgaagtgttgagataaattttgtgactgcatctgcaggttcacaccggtccggtattcttcttgtttgcagaagttcaggttcctctgtaaaagcagctacttcaagcagacccgaagctgtttcctcttctcataacgatcaatccagcaaacatttatttggttctgtttcagatgcttataccattatctctggctattggattggccctgatatggatgatggctgtggtaatgttgtggccattctccaaagaattgtatgatactgcatttgctgttaaaccacatgaattttctggcgtttgaagataatttttatatgctagatcatcctccacattaaagtatatccataaccttttccaaacaatgcctatttgcccggcgaaaaaaataatgcctatttctgatcgtattatttcttatatgaatcaatgtgccactgcaaatggtttaatcatgtgtcattattggtatgtttgcaaaatgtattgttagattctattccagttggcctaaaagtgcaggcaggcttgtttaaataagatctgagtgggatagaactagcagagtcttttgttacaagctacttgacacaaattcacagaatcacagtgatatttacatggtactattatgaaagataattaagaaacgacttgccaaagcaagtcttctcgtcaacttagcatatagactagtcactgaaagtgggcccactcacctcctatatagagcagtgtacacctggagctggagctcaagctatagctcaggtgactgacaatggcgtacagggccttggaggtgacgctcatctcggcgaggaatctgaagaaggtgaacttgatcactcccatggaggtgtacgccgtcgtctccgtctccggcaacccgctcgcccgccagtgcacgctccccgaccgccacggcggccgcaacccgacgtggaacgccacgctccacctcgccgtccccgccgccgcgccgggcgcgttcctccacgtcctcctccgcaccgagcgcgccctcggcgaccgcgacgtcggcgaggtgttcgtccccgtcgccgacctgcagctcgccgccgccgcgcactaccagtacctggtccacaaggtgcagagcaccaccgagcactgcggcgtgctcagcctgtcgtaccggctaggccccgtcgtcgtgccggcgccgccgctggcagcggacaccggcgctgtcccggcgtacctggtggtgccgtgctacgcgaacgcgccgccgtacgtctacctgtcgccggccaatcctgcccgcggcgaggccgcgtcggcgtcgccgtcgccgccgccgcggcgcaagaggagcggtgactttgggcagtggctcggcggcgccgtccggggaatgttgtccggcgaggccatgtcgccggacacggcggcctacgacgccgggtacaaaaccctgatcggggtggctgatggcagacgtgtcaagttctagctagtaggagtactattccagattagcgtggcttgaataaaatggaaaaggtttcttatgtactttttgcatggctgggagactaacttttgtacgaggaagtattgggtggaaaccgtggtagaaacttaaaacttggaaactaatgttggatcgaaaaatggacgtccgagattcgtccacgtcatcattagtaaaaaaatttactacttatgaataaatctatgagtaaaatttttactcgtgatgacgtggtcgaatctcgaacgtctatttttcgatccaatagtagtttctaactttccaccatatatatggtttccactgtatatttttcctctttttactaatcagtagcacgttttcttttctttcttggaatatttatgcattactcgtcattcaacaaacatactctgcatgaaaattcatcgccgatttatttaggtcagtttggacgccttaggtggacaaacgagaatcgacagtcccttgttgatgccgttattccaaggagcgcttctgatagttgtgattttttttctactctacccattctaaaatataatatttttatgttatttagcaaataataaggttaggttaaaaaaattccttttcaagtcatttcatttgttaatgttttttatattttgaattggtcagactttctttctaattggcttcaaaaaaaatgatgagaatcatgagaataaatgcataaatgcttatattgtgatatactccatccatccaaaaatatattagtatctagcctttaaaattgatcttaaaatataacaacttctccatctgcattcttttctcagccaatcataatatttcaccattcaaatttcctacacactttccctcaaaaaaaaaatttcctacacacatccttttctcaaccaatcataacattctccaaatttaatttcatcaactttctaaatacccgtgttcaaccctaacaatctctaattttatgacagagatagtaaaatttgaatcctaaaaacacctatattttactccctccattttatattgtaagactttctaatattgcctatatttatatagatgttaatgaatctagatacatacatatacatatgaaaaggaggaagtagaacggaaggagtagttgttatagtgtaagttgttgcaagataattttgtatactcatgttgtctagtttttttcctctaattttttttggggtacatgtatttttttagttgatgcaaagggtggggaatttttattcgaccattaatgaaatatttcattgtctaaaacaattcaacagatatctcaagatttcaaacgtattttgaagttgtttgattcacgtatatccaccggtgtcaatgaggtttaagtaaggcttgagcaggctccagtgccactgagtaattaactgaccaaaaccaatcaggacacagaaatcaacctgctaaaccacatcagaaaaaataacaaattgaaggagacagcagaaacaacatgcatatgttcttgcccgctcagattatttcctctggatatagatgaatcaattctgtccatcttgcatgagactatgtacagtcatacagattatatctgaagaacttgctaataataccgcatcaacattattcacgatcgagcatacgcaccccggcactaatctgccgaagaccggtcaggattcggtggttaccaatctgtctcgatcggtttggcattattcccagtgcagtgttaccttgagcatctatatcattctcatgtaattaactggattcaataaaacttccttcatcttaaaaaacctggggaatcttcagttttgcatcattcatgatgtcatgatgatgatgactcaattggaagtttggaaaaagttttaagataaacacagtaattcttcctgattcttttacggttactctctagactccagtggatttattctcaggagatatttatatctctcatcattcaagaaaagatatttctgacgagaacatcttcagttaaaacaaaaagaaaagcagttacactttcactacttcctatagcacattcgagcagtaaagccggttaaggaaaacaactccaagttaaaagaaggaaaagcagttagactttcacttgctacagcacattcaaaggctgagtagtaaaaaagccaaaaactcgcatcttcagcaacacgcgaaagaagaataaaccatttaaaaactcgaaaaattgagccagacaaagatatggtatcgatcctctgctatgataatcatcgaaaattatggacacgcagcactagaaaggccagtcctgcaagaactatatcctcaagctatcatctatccagcatcagatgcctcctgatctatcctaccattatattcaaacttatttgataaaaaatctaactgcaggaaacctccccaatcagggagagtgatgataatatgtaggctgctcgattattctccattgaatatttgaatggctcaacaatccggaggtgttgctttgtggatcttttaggaaaaagttattccgatctctacactaattagaaatacacatgttgtttaattatagacattagaattcaaacctagtaaactctgcttcactaatagtgcgcttttatgtacttaaaatggtccgttgaattatagatattagaatctaaacctggtaaactccgctacactaatagtgtgctatgtacttaaaaaggtccgattggtggctaataagctcgcaccaataagttattactcaaattacgtagttacatgtatttctaatataactagtagtactagcaaatatgatacattatcactcactagtaattactattatagagcatcttaaatctcatctcatataaatatgatacgcataattatatcaaatcatcatcccgttcacatcatttacacagtatctcaacatatatccatctattatttcaataatatttgtcataaattgatccatacatatcatagtaaagcgtgggtatcatctaattacattaggttgaacattcatatttccaacgatactcacttggaacatgtttgaggatgattctagttgttataccgtcttttaaaatcttcaatcaccctaaacagtttagattctcccgtagatatcaaattctataaatatgtaactgtacaatctagaaaataagctagtaaaaaccaaaagataagaaaccctctttctatattctcgttagctgattaccgataaattgcttctcaatatttttgactccttaagacatttctaacccaatgactaagatagtattcatagtattaaataagcagccacctaaaatgaaaaatgatgtgacaagtgaataaatgaggaaagagaagaaaaccatgtcttacatgagacagagtttctacacaacatccaagacatcatgtgatataatttgcattaaatttgagtatggaatagtggtatttgcattgaaagagtagtgtctagtattagtttcttgatgatgtgaagtttatgaaaactgtgtctagtgtcatgggttaggaatggccttataacaagtttctagttcctgctttaaccaccaactttctgccaaactttggtactttaggtagttttggaatattacaagtgggtcccactccacctcttatacatacacctgcatgctgaagctgtgaagcataccatcactccactccatcacctcctgcttgagcaagcaagcaagcaatcgctgcagccaactgttcgaccagagcgagttagccatggcgtacagagttcttgaggtgaccctccactcggcgagggacctgaagaacgtcaacttcatctcgcgcatggaggtgtacgcggtggcgaccatctccggcgacccgctgacgcggcagtgcacgccgccggacccctacggcggccgccacccggcctggaacgccacgctccgcttcaccgtcccgcctaccgccgcctccgccgccggctgcctccacgtcctcctccgcgccgagcgctccctcggcgaccgcgacatcggcgaggtcatcatcccgctcgccgacgtcctctccggcccctacgacctcggcgcccgcccgccgcagttcgcctcctaccaggtccgcaagctccatcgctccgagacccgcggcgtgctccacctctcctaccgcctcggccccgtcgtcgcgccgcagtccgtcttcgcctacccggcgccgccgccgccgccgccgcagctgttcgagaccgctcctccctcgccgccttacgttcccccaccaccggacgcctaccttcgtaaaccgtcgccgccgtctccaccacccgccaagctgtcgccgccgccaccgccacagacacagacacagccgctggcaaagccgccggcgccggcgacgccgtcgcgagctggcgggcacgtggcggcgctggcgccacctgcggtggcgaaggccgacaggcacgtgtcgacgccgtcaccggcgaaggccgactggcagatggtgggcacgccgacggcgacgaaaggggcgagcaagcatggcagcctggagttcgagcgggggctcaacgccgggctggtcggcggcgccatcggcgggatgctggtcggcaccgagatggtgtccgacgcggcgttctaccacgccggctacagggccgggctcgccgaccgcgacggatgggccgtctactaaaccgtcgtcgccatggctgcaggtgcagcgccatgcatggtcggtcggcgaagatgcttagctgaataaaagtctctggttttctttttttggccttttgagattagctcaataaaagtcgatgaaatttactttggctgagagtttgtaactcttcctcttcggctagtgaattaatcgacttgttgtatatattttgttactggttatgatgtaatatatggccacgaaaatccaagaacatgacatgctcattagaatggcttttgagaaattaaaaaaaagttcgaagaaaatctttgaaaaggagtcgggagttcctgcttttttattatggaagaaagaaaagaggtaacccaatttgttaagaaaaatcggaccctaaaactttatcattgtacgattaacttaagaaaaaccggcaagaatctcaatgaagaaaataacaggactactcaaagacggcataccactataacctagcacccttaggactaaagtaccgatataagtcatcgttgtcaagcttaaagtataggagtacaagcaactccgacttcctattacaaacaaaagccaacgatcacctaatgtagggagcgtgcctaaactctaggaccatgaaagaaaaaccgcaacgacgcatctaagaaggaaaatttatggtgccggtgacatcgcctctaaggaagaaaggagggaaatataaggtgccaatagacgtcgatgtcaaaggctttcatccaatattctccctgccaactacaccattcacaagtgcctcctctatatcaggaggagttaaatgttatcattaccaagctcatcaacccacccccatccatggtcatgacctagtctcgttggatttgtgcaccgctcccgactggctttctacaacattatcgctgccaccaacccgagcaccaagagtcacttagagccagggaggggagagtcgaggcctttgccgtcgccttccttgcaaccacagtggtttccggcactctgctccggcggtggtgagaccccgggcggcaaaatttaaatttgaaacagtaaattcgataaattcgatcaaaatcggttcaaatttcctggctcccaaccccgatatctcactcccccgccgtcgttgtgaaccctgctctgctgttcatcagttgtagacaaattcggactctgttccaaaatcccagtcgatcagttaatccgagacagttcagtatagtgccagcaaaatcagctaaactccgtataatagcaatcggaaacagcaaagcaagcaagcaagcccgaaatcgacatgcttaccaacacgagttcgagtccacttccatgcacgaagctatatatacatacatggatgcatcgagcttttgttgccaaaacaacggaactttccatcgacgatcttgctgagaattgctagctcgatcagctccgatcgagatcatgatgacggcaactactccccccgccgtcgccgtcgccggcgagagcccgccgccgctcgtgcacctcgcatttaacctctactccaccggcttcatcgccgcgacggccaccggcttgcgcgtcttctcctgcttcagctcgccgctcaacaaggtgttcgccagggacgtcgaggtgtgcccggaggacgacggcggctgcggtggcggcggatggaaggtggcgatcgccgagatgttcaacgaggcgttcgccgccgtcgtgttccggcgggagaagggcggtggcggcggcaccgtcgacaagatctgcttctggagcatcccgaacgggcggatgtactgcatgcacaagacgctgccgttcgacggcgccgtgcgcggggtccggctggtgggggagttcctgctcgtcgccggcgacgagagggcggcgctgtacgagctgccgcacgccagcgcgccgccgaagaaggtgaaggtggtggagacggcggcgaacccgctggggctgggcgcggtggtgcagcccgacgggaacgcgcggttcgtggccgccgcgccgcagaggatgaaggggatggtgcaggtgcaccgcctcgccgaggaccacgtctacgtgcgcgcgcactactcctccctcgccgccatcgcgctctccgccgacggccgcctgctcgccaccgccggctccaagggcacgctcgtccgcatcttcagcaccagcgacggcaagctcctccaagcggtatgtgcatatatatggccctgtgctctgcttcgttttcaactttggaatatactcccccgttccagatcattagtccttccttttttattttggtcatagttaaactgctttaaatttataaaaaaataataatatttttaacctaaaataaatatattataaaattatatttaattatatatttaataaaataaatttggtgttgtaaatattgctatatttatttatttattataaatttgattaaatttgaagtagtttgattttaatcaaagtcgaaacgactaataatatggaatagtgggaatatatcgtatatctttatttttttccccttagattgtttattttttcaagtttcatattacagtattgaaatatggtttgcgaataactttacaagaccgttttgtcctttatttttgttagttttttaagtatgtgaaattaatatggcgtttgcgaatatgaaaactttttgggttaaatttgctttagttaactgatatttagttttaatgagtatacttactaaatatgccttgtttgcgaatattttggtttagttttcgctagttagttgatcggtatgaaaatgggatactaacgatctctgtgatcgttacatttaataaccaatataaaatcttaaccggccacccacaactaactaaatacaaacaaccacgcgcggcggcggcgcacgtcgctctgctatggcgtcccaaaacccaggcgacggcggcgacgagcaatcgccaccgccggctcctccgtttccggcgcgccccacctacctatccttcagccacgacgcttcttgcttgatcgccgccgacgaagcctccgtccaatggcgctgctgcgagaccttcaagctgcgcgggctctacgaggagagcggggccaccgccgccgccggtgacatgcgcgaccggaatcagtcgacgtgcgccgtcgtccgccgcgccggcgcggggtttgaggtcaggcgtttcaggccgggctccctcaactacagctcgcgctacgacagcgtgcggatcggcggcggcgacgacgacgacgacgtgcggtcggtgcacgtccacggcgaccggaccgtcgtcgtgcacgccggccgcgtggacgtgttcggcctcgacgacgggaggaggaaggcggcggtgctgcagcggcgggtggagaccggggacaaccgggccggcgcctgcgccgtgtcgagggggccgcccggctcgccgttcgcgttcgcgtgccccggcgtgaacgacggcaacctgcgcgtcgagcggtgggtcggggggttcacgccgctggtcatcggcgcgcaccgctggcgtgtcgcgagcgtcgccatgtcgtggggtgctaagctcgtcgccacggccagtgtcaagggcaccattgtgcgtgtgtttcgcgtcgccgacggcgaattgctccaggaggtgagattggcggcggcgccggcggctgaagcaactgctaaaaaatctaaaccccacaacactgaaacaaaatctctaaccaaatttagagcatgcgtaaaatatttttcaatattgtttttatgaattttaggttttttatttattacatttggtttattgttttgtattatatgcgcaatatcgtttaatttagctatattaggattgcatttttttatgatacggaggggtatgttactgtgtttaatgtaaacacctctttgtttagtccatttcttgtattactatactataattttttacattttattgttcaccaagtttttcttattgtttatatattacatgcacaatatcattttatttggtaacaaatatcataatgttaaaagatgcttttcatccatttctagatgaaaagaggcttcgatagagctgatatctacagtattgtcttctcccccgattcagagtggcttgctgtctcgagtgataaaggaaccgtacatgtttttcatatcaatgtttgttcgccatcttcctccaaaactggttgccaagatacaactcaatcatatgaatcatatggtgcaaaagcaatgaaaaaatatgtttcttctataaaaggtaattttaattttgaaacttgtttgttagctttacttatcgtaaaaggtaaattgtattttgaaatttttgtgtattattttatttctgactcattgatgattttaatatgctttcagatttacttacattaggatatttcgatccagaaaggtcggtagctcaattccatctatgtgataatgtaaaataccttgtcgcatttggtacaagaccaaataaaaatattgttcttataatcggtatggatggaaggtgagttaaattatgataatattttctcaactttttctttcttagtttagatgaaaaaaaatctgacctctaatgtttgtgcagtttttaccggtgtcagtttgatccagtaaacggtggagaaatgaaacagcttgagtacacgaattttttaaatatgtagggatgatgatctgttcaaaatcagaatatgtattgatattatcatagttgacagagaagttatcatttttttcacttgtcttatttcgatttgtagttaaaagatatttttgccttcatagatttgatttatttgtgtatatagtgtcatcgtattattctctttatagtgtagtgacacgataatatacaataatacttagcacacttgaatcaaacttaattctcttaaactgattgatttaattttagtatatataagttctatttaagttaaaaaaatgatattttgagaatagaagaatactgggataactatgaaacatgtaacatgtagcttgaactatgatgttcttattattaccactctcttcctcgggcttgtttgtttggatattattagtgtatggcgtcgtgatagcgggctattaaaacgttgacacatgtcaaatctagctccgaaagacaagcaaacagtcgattcgcgacggttgccgagaaagcgacgatctatcaagcgcaacgccacgcctatcaatcctaaatggctacgaaacacaaatatcccctttgatgtgtgcttgtgtacgtatatgtatgcacaataatgttaaacgtgaaaaacgtaaataaatgtttgtgttgtactatgtatcttcctaacaaccagtcgagtgcaagtgtgcaacaaccaaggggtcattattactgtagattaataataaccgttcctataacaagattcgacacgaaagtgttcctctaaaaaaatcgacacgaaagagatctataataaccaaaaaaaaatagtaatattaattggcgcccgcctcctaattttgctggtaaaaaaaatataaaaatgtttttttcgattacatggcagacgcagatgcgtgcgcaccattatgcacgtgacaccacactcggatcctaccgattaaatatgtggttttatgatactccatcttaaatatgtagttctgggataaatttagtggttaatttgtagttttatgaaacatcaccttaaatctatagttttgtgataatttagctaaaatattatgaaatttaatcaaaactttaacacggccaatcaaataactaaaaattttgttcatcaacaacaataagcatgtgctcttaaaaatataggcgtaccaatagatacactgattttctggtaggataaaagggatgggagatgattttctggtaggataaaagggatgggagattgagatataggaaaatggatgaagggttaagatgtactacaccgaggttagaagaatgagtaagattaaaagataccctttagccttgggatttggaatattttaatcctatagataaaattcctagaaaacctggagaatttcaatactacaggagaaattcataaggtctttgaacaaacatttgaattaaatcatttcctttataagtattcctataaaatagataattccatatagattacggagaaaaaaatatctcatgtttttttttcttcctgcaaactttaaatcatttttttgaacattcaatatattgaacattaaaagcacaaaacgtgcactggagatacatgattgtttttccaaagagcagcttgtaagagttgctttgtaggataagtattgtcattacaagtatgactaatattttgataattcagcacttcagattcaactttaaatcgttgcgttcctcatttgtgtcaagtagaagtttcctttctttttttttaatttcgttaggaattcaataagcatgttattccatttctatattttcttctattttatgttttttacatgcgttttacagggttgcttagtgggtgggatgttaacgattccgatatggcactaccgttccgaaacttggcggtacgacgtatttcacgtaatccggtggaaaaccaatatattcctaacaaatttcgtgaactaaaatttaaacacaaatccctaaacttactgatacattaaaaaatcgatcagcttcaacgaaatttcggttgaatccatcgaaatcagatcgaaatagacagactctgatcgactgccattatccaaacaaagtctgatctagggctgtcaacgagccgagcttgagtgagctcgtctgcctaagctcgagctcgacacaagctcgagccgagctcgagcctattccacattcgagcttttaggcaagctcggttcgagctcgttcgagctcgagctcggctaccgagctcggtcataagtagtataatatatattttaatgataatcttttgataagtataattattttctagttaatcacactaataaaagagtagaaaatgattaaaataaatatattatgctaacacatgctaatttattgtgtaaatagatactaatatatatatttacctattagtttattatattaataaggtgagctcgagctcgtcttgttaaagctcgcgagctttgctcaggctcgggttcggctcgtttgaagctcgagccgagctcgaatcaagcctagaacgagcccaagctcgagctgctcgcaagccgcgagctttttttttgacagccgatcgattgccatgccatcccacccaccgttcgttggtttgatgatgatccaacggccaccaattaaaaaccttgtagccaaaaaagaaaaaaaattataaaaaccaagaggtcgcgcacccaaagccctagtcctcctccatccccaaactccgccgccgccgccgtcaccgccgctcgccaccgccgcggccgccatgagggcgctcgacgagaaggagacgaagatggtgttcgagaagctgttcaagttcacggggccgaacctgaagcacctcctggagcggccggcggtggaggggcccgacccgcaggccgggcgctactgcctccgcctccacaagaaccgcgtctactacgcctccgaggcgctcgtccgccgcgccaccgccgtcgcccgcccgcgcctcgccggggtcggcacgcccatcggcaagttcacccacggcggcgcgttccacctcaccgtccacgccctcgacctcctcgccgcccacgcccgccgccgcgtctggctcaagcccgacaccgagcgctcctttctcttcggcaactccgtgcccaagtcctccctcgcccgcatcacagagaacaccaaggccaacgacggcgtcgtcgtcatgtccatggccgacgtcccgctcggcttcggcatcgccgccaggtcggcgcaggactgcaggaaggccgacaccaacgccgtcgttgtgctgcaccagtctgacgcaggcgagtacctccgccgggaggaggagctcatgtgaggtgagggctgaggcttcattttactcttgtgggctgattgtatcgtaggacttagctaaccttacatattatgccttcttttgtgtgcaacaattttgtcatttgcttagcatgcgcctaattggttgagatgagaggattgtagatgccaagtttattcaattgcaatgctaattggttgctaaatgaggggtgcttgccccagaatttgtgaaatcaatcttgccaaattccgaggtcgaatcgatgttttgatttcagagttagctaaatgagggagtgtttggaccagactatgtgctaaattgtgtgaaatcaagcatgctgaattctgatatcgaactgatgtttcattggatacttcatcgttttgactgtattttgtgtattagtattgattacatttgtcgataaaccttgtgagttacagctgagttgcattgcacagacattgtcttgaatttggtaatccaaagatcatccttatgcggttatgtctgtctttgtaatgtgttcacctgccttcattgataacttggaacaggaaggattcactctcctcctgtagcatgcattcttcagattagatatatgaagtgggttagaaagacatgttttcagttttccatataggacattgggtgagcttggctgtaggcagcctttgggcgatactgtttctgttatatacctctttttttgttcatccatagtggatcgatgtagaagttagactgatcatgtctaatctatgttcaacatgattggttggatcactattttcttggttcagaatgaatcaaaaggtttcttttttactattcagtgctgatacgagctgtgcatagcattggagtccctacaggcctacactgggattgtgattgtaggtttatggtttgaatatttttttgggtccacgattttattttagttgtagcatgtgcagactatttggttggcctgaattgctgtaactacataaaacagttgtcacccaccatgatactctgcttcttttgttcccaatagccaccaaaaaaaaaaagaaagatatggtggtacaaccaaacgaccctatgacctgactgtgcagtaaactattctttgacgccacataacttctttgcttgattacatggtctgtagaacagtttttcgtacaagaatgaagacacttgtagccatgtacattcggcttaaaagcgattccgattgtgaatgcaattctgattttccagctatccttcttgcaggtgttgaggtttgacacattggcgtgactgcaggactgaaggatgcgcttcctcttcatgcgataattcgaagtttttctaccaccagtaaatgtgcgatttttacctagttttaagatagtggaggtctgttgtatcatctatctagtagaaaaattttgttcccaggctgttctatgggcctaaaagtgttctgttaagctgtaacttatcggtaagctactgcatgactgaatgctgcaggcctgcagtaacatttgatcgtgatcaatgatatacttgtcttatggaccctacggataaaccctgtctgtccaatcttcatcagtttacgttaaaacctctggatttgtacgcattttggctttgataagcagataaaacttacaaataagatatgtatttcctttataggaataatgtgcattgaaagagagacacaatgactgaagggtaaatactgatcgatcagccacagaaaaaaaaaatcagaacgtcacttggcgacacaatcgtaagttcgtaacgcagcgtccgggcggttgaaacttgagaggcaaaagggaaactggagttgcgatgtcataaaccgagtgaaaatcgtcgtcttcttgttcactgcaagcacaatgttcagagtgcacacatacaccatgaaaagaacggcctccccatctcttgttcacatcttcaatatgctcctctgcagaggccagtatgcaagggattggaagctaacgagaaaatttaacaggtaatgtcaaggatacgatcatatcttgctaaaagaccggaaaattttgacaggacatacatactttatgtagtagtataaaattgcacattcctgagaggtttcagcactgatgtacgggtagtggtgtataagtgggtaagccacgaacccactttagattaaaataatcaattcgtgatttattttcgtttataaatgggtttcacgggttagccttagccccttgcaccctgcctacgggtgttaaattaattttcagtctaacatgtaacagcgatgaggctggccgccagcggcgtcggaggacacgacgacaagcacgggaggcaatacagcgaagatatctcgaatcctagccgcacgtttttaatcctccgctctaatcctagccgcacgtttttaatccaacgggagagggtttgcgcgttcgtggtcttcaatatcatgggacatttaattatttgccagttttaagatgtgccaattaatgatttgccacttgctgtttatgacatgtggaccctcacgtgacaaatcatttaaaaccactcataagagtgacaaatagttaattattcccaatattggagtacggtgggggtcggagttttataagcccatgaagcggcccaatatctgagcccaataaccttgaaaccggcgtcctcaggttatccttgcacggaagagaagtctgatgagccaattaaaaaaaaaatcagaacatgagtcattcacaaaggaacactacccaaaaaaggaaaagaaaagaaaagaaaagaaagaggattgagacattcagtatttcagtgctagcatgttgtaatgcagagtccaacagagagttatttttgctgcttttttattggcaggaaagaaattaaacttaatggcgatttcgcttctcagaacagaagaaggcatgacatgcaaatgcaaagactagaggataaccaaacaacatggatgcattcaaggcgctaatatagaggagaatctgggggccttgggggttcggagttttattttccgacctccttcataaacagttgcatcttgctgcaagaaattcagataagtcattgatgacgtataccatgcattattaaatttcatataatcatgtctgagaggtttcagtagtgaactagcgatggatgtcaaatgctgagtctcccgtgcaacagagatgttggctttgccttcgccggtgtttcagtccctttgctgatcagccatagaaaaagttcagaacatgaactcattcacttggttctacgaggatgaattcagacattcagtgcgtataccgtgccgtaaactcgtaatgcggcgttgcggtgcccaacttagaactgattttgctatatctgaagtctgcacatctcacacatagaaaaaaggggggaaaaaatctgtggacgagggggttctgggttttgttctccgacccctgtaaattgtaagacagccaactaaactcgcagtaatctgcttatgttgtgttcgtatgtctactctctcagattttttttggtgtctgctttcatttccttgcaccgaagactgatcagcaactgaaaaacaaaacaagttgagaatgtgatttggttctacttgtatcagaggggaacaaggggaaagaaacaatcaccgttgctccactcttacgtcaaaaaaaaaaaccgttgctccactcgaatgtgacgattgatcatcatgcaactgatgcctcgcttttcagaagaaggcaccacatgcaaagaagctctgaatctctctgaacctgtgaatggggttcggagttttattctccgaaccccctaaacaaatcgttggattaaaacgtgcggcgccaaatccttctccgtcgccggcggtgccaatctcacctctactcctgaaatactgaaggtggccactctccctgatttttattttgttgctgtttgttctcagtttcatgcgcagaagactgataaccaactaaaaaaattacggtgactttgtcaatctcaaggacttgccgattcagttttcgaagatgctcataggggtaggatttatgtgcgtgcgttcataggggtaagtgtgcgtgtgttataagtgtctgtattatactgtataattctaaaaagaaaaaaaaaatcagaacatgacctggtaattctatcataacttcgctgataattaatcaactgctcgaacttcgctgttcagaagaaggcatgagtgcatgacatcaacttcgctgttcagaacttctatcagtgatcggtaggaggggttggggtttgcttctcccaccccgagcacggatagtctttaagggcctgttcagattgtagttaaaataaactttatgctaaaattttggcaagtgacaggatttcttatatatttatcaaatttggcaacaaactaaatgtagatatttttttacaactttattaaaaaaaagtatggatgaaaataacatcaatctgaacagcctctaagattctgaatgagagttttttttcttcggcccctagtttcctttagaatatgcattgaaagccacttggaaagaaagatgcattattattacacaaaaatagaacaaaaaataatgcgtatccggggaatcgaaccaaccaacccctagtttcctttagaatatgcattcaaaggcacttgcaaaaaaaaagatgcattattattacactaaaatatgcattgaaagccacttgcaaaaaaaaagagatat

SEQ ID NO: 78037 - DNA, 642 bp, Oryza sativa
tgtttttaatccagaagttctcttgactcctgagataaggaactccactgcagttttaaaatgatgaatccttaccaagctgtcaatcactattgaaatatctgtttcgtaagctgatatctagcatcagaagaaacattatcttccattgtatactgccaaatggcttccatgcatactcatgggggaaggcataagatcattgcagaatctcccctgcaagtcatatgtgattgcacttcttgatcttgccagtacatgatatagataataagataaagtgggaaacagctgcctctagaacataagctctcatcaacaattacaatttcagcaacggtttgctcttctactgctagcttccgcttagaagcaatggacgtgagacggatgctcttgaaatcatcatcaatctggccacactttctactgccatcacccaatggaacaccttaggaagggtttctcccagctcaaaatatattggcaggaaagtctttcaggctgcagagtaatagccagattccttaaccagaggcataaaggaggataaggaccctgcatcatgcacattgctttgcaaagttacataaaatcaacagttccagtgccaaaacacaagtaatagatgcaatcatgaaa

SEQ ID NO: 78038 - DNA, 630 bp, Oryza sativa
ccagcgtcgcatccggcgacgggttggggtggtcgggggattggggggtaggaggaggaggggcctatgctgttccccgggcttagagtgatggccggggaggtcgcggcttggcggtggaaggggtcgtcgacggcgacggcgagggaaaccgtgtaggcggcgggctgcgccggtggagacggggaaggcgcagttgcgcagctaatcgatcggcgaggggagggagagagagagagagagagagagagagagagagttcactgttctagaggtagaagatgcacagaacccgttggatcttagaaccaacggcccaaattttggctgagatcttgcgaagaaaacaaacaagtagcagcttaatttgttttgtaagatattagtattatgtaagatatagtgactaaagtacttccacttttgaaactttgtcctagatatgctatagtaggctgcctgatttctctgttcagacagatgtttatgtttctaatctgatttctctgtacaggctgcgattgttctcggcatggaagatctcaaggatgaatgctacaataggatgctgcaagatcatcagatgggaccacagcaagtgaagctgtttttgcagaatgtgctgggaca

SEQ ID NO: 78039 - DNA, 2343 bp, Oryza sativa
agagcttgaatagatgcaagactgcaactctgcttgctcagcacatatgttgaagcgactttgctgaattgcttgctggttgctgttgaagtgagttgaaataaggagtatcaaccaattgcattaggcaactaaatcggagccgtctaaatatttatggacaaaatttcttcaaaaaatttaacatatacaaatatagtataataatagtgtatttacattttcactcttaataaactttggccggcccggaaaaaaaagtgtacttacattataatttgaatataacaacaaaatatatgtaactttcaaaaatgccatggtatcacgcctattttcgtgaagtggacgtctccggacgaaatcctctcacaactacgcacaccgtgaatttttccttccccgtttacatgaatcttcaagcaaatttgacggttcaaactttccacgatgtagttacactgcaattatatcgtatttacatttataactgggccatggcctgcttgcagctccccaacgcgccacggcgatcaacgaaattggcccagcacacgccaagctcaagcaggccataaaagctggaaatattgtcattctcccagcccaccgcccgtaagtcgcgaatgagcccatgatgaggaggacgaccaacgatgccggcccaatttcgccctggatttatgcgaatcggcacctggttcagatggtagcgatcctgatttttcatgcggcagtgtttgttcattttatagccatttttaacctttttaaaatttaatattgctaaaattttagcaagttaacaatattattaaatttaggtaggataagcttgttgttgtcaaattctctagggatgaccaatactctatttgataacaaaatcatcatatatttgttaattttatcaaacaatgatatgctttaatctgaatagacctttaggaccctatttaggatcggtacctttcatgcccatatttccttaataagttaaaacatcttattaagaaatataaattaatttatagttaaaacttttatatgacttaaaaaccaatgtaaaaagatacactgaaaatatatcaaaatcaacttaaaagtttgaaaatttaaatttaggctttagtgtattagtgcaatcaataggctcttattcacttaagccccttagggatcctaatatatgcagttattatgaccattttttgactttatgcaatttagcccctaatctaggtcgaatttgtacaaatcaccacacaccgaagccgcaaaccccaccaatcccacaaaccactctccagccctctctgcctcctcgccgccgccgccgccaccgccgccgctcgccggcgcggcgccagccatgctccccttcgtccgctcactccgtaggctcggccctgccgcggccgatgggcgcctccttctccccctcgctccgctctcctcgaaggcggccgcgccgccgccggagtacgagatgccgtcggtgacgtggggcgtgatccaggggaggaaggagcggctcgtctcccgcgtgctcgcgctcgacttcctccgctccgccggcgtctccgaccccgccggcgagctcgaggccgtcgagctcccctcctccctcgaggtgctccaggagcggctcgacttcctcctccgcctcggcctctccaccgacgacctctccgcctacccgctcctcctcgcctgctccctccgcaagaacgccatccccgtcctctcctacctcgagaagctcggcgtcacgcgcgcgcgcctcgccgccttcgtccgcgcctacccggcctgcctccacgcctccgtcgccgtcgacctcacccccgtcgtcaagtccctccgcggcctcgacgtcgaccgccaggacctcccccgcgtcctcgagaggtaccctgacatcctcggcctcaagcccgatggcaccatcagcacctccgtcgcgtacctcgtcggcatcgtcggcgtggcgccgcgcgacatcggccccatggtgacgcacttccctttcttcctcggcatgcgcgtgggcaccaccatcaagcctctgtgcgagtacatcacttctctcgggctgccaatgcggatcctcgcgaggattctcgagaagcggccatacattcttggctatgatcttgaggagacggtcaagccaaatgtggaggcattgctcagctttggcattcgaaaggagatgttgccgctggtgattgcgcagtatccgcctattcttggattaccgctgaaaacgaagttagcagcccagcagtacttcttcaacttgaagctccaaattgaccctgatgcgtttgcctgtgctat

SEQ ID NO: 78040 - DNA, 1578 bp, Oryza sativa
ttagtggaatgaatgaataaaaaaaaaggacaattgaattgatttccttcgcattagcaaggagttatttagaaggctcctaccgaatattggtaggctggaagctttttaaaaatccagtcttattttttaaaaataaatcctattgtgaataattcagtcattcctattaaaaatattcatagatggatataataacaacttccacaaaactaattccagtgacacatacctgcttaaaaaatccatagaccaacgcaacggtccacaaagtacttccaagaaaattacgtatcccttgtgtgagaaattcattccacacaaaagttgactcatatatgttccagccttcctgtggatcactcaagttcttttgaaggcttctcatgatatggtatgagtaactgaaaaagaagtcctttctaagatcaagtgtattcagtatcttcttgtacctgcagcatttcataaacaatcagcttctaatttaagaaatgcaatagttaaccggaaatgaaaaactaggaacagttttcccataatatattatttggtccataaaaacaatatctaatatcataatcagagtgcttttcatggggttgggtgtcgaaccgaagaaattcccatcgaaatgtgaactttggaactagttgatgaaatggatcttcatgtactgattataaagttttttatgcataaggacagaaaagagaaaaaaactcaaggcttgcagctggaacaaacctgttctcatccttggaatttagaaatctggatcgcgtcttagaattcgctaactcgaccatcgaagtcttaatcacctggtatactggatgatcaaatatctccccaatttttcgctgctcggtaataattaacatgtaaaatggtccaacaaactttatgaaacctgcgaagatatttcatcatcaagtgcattgtaatacaattaaattttgctagggtataaacaaaggaggaggggttggactacttaccgattatgccataaaattttgtaacaaactttacaccaccagtcaacctgtggtcttcatcaagattttttaacagttcatgatattcactttgagtatacacagtacaacactcatgtaagtcaaggtccgatggctccgatctattaatcttcagtaatctccaatgtgttttgccagtgttagttccaaaaatataaaacctctgcaaagcaaaatacttggttaagaattgtgaccagaagcacaagttactgaacaaggaaattaatgaaatctctggatccaagaacgttgagcacctaagctgcaagcatactgaccaacagagtgattgtgtacacaggtgaaatacttaaaaagagatattgacaatattttcaccgaacacccagaacatatgaggccaagtctctacacaggaacgtgattgccaattgtgctaatacgttttgtcaccaatttcatatgccaacaatctaccatagcagagtttctagcgatcagatcatagcaaaattccaaacacaagaaaagcatgcagactgcagagacagtcagcccttctgagataaaa

SEQ ID NO: 78041 - DNA, 2678 bp, Oryza sativa
gcaggcggcctcctgctccaccgccaccgcagcagccatggacgggggtgatccgggcggatcacccgctcaaatcaaccgccccaatcccccccctccgccaccaccgcggagaccgtatcaccgcccctccgtcacagccgccgccgccgccgccggccggaaccctaaatcccgtgccggaagcttgaggtagagcattccccgccaatcaccgcagcatcagccgacgccggtggcggcggagaacggcacggggctcgaatcgcgagccgtggaagcttctaggaggagatccgcgggagaagcgtgggtgggaaggaggaggaggaggaggcggtggcgacgaggaggagaattcgcctcgcggaggaggaggagagaagaagaaatccgtgagttggcggaggaggagggcaacaagatacaggttgttacgggaaatattttgctctccgtttaaatttagctttttgagtccgtttccctgtggagacggtaaactggataagcacgcacagggctgatttgtctccgtatcatctccgtgttgtactgtcgtaccgtgcagagaactgatgcaaaatagtgaaatactcatccctccgtttcacaatataaatcattctaacatttcccatattcatattaatagtaataaatctagactgtctagatttattacattgtgaaacggagtgagtagtatgctattgcgagcaatttttttcttggccggagtagtttttatataaagcttgcgagtagtttctatacaaagtttgcgggatactagtagaaatgtatagaatgtaaataaaaaaaagatttggaatgctagacatccctctaaacatttttaataagaaagtgtgaaagtgtggagattgaacacgacatttccaaattgaaatcacacggccatcactgcactatcaaataacctaacattatttgtgcttctcatttattgccaattcaccgtgtgagatgagtagtccttctctaactattctcagtggtttgtttacataggcttggtcgcgaaaaaggagagagaggggttgggaaaaaaagtgtcgaacaaaggtgataagaaattttaaatgtatgaatatcactgccgtttcggacatatgaaaatcccgttttggacatatgtaaatcatactgatcccatgaaggaataaaatttatctgatcatacatggtaagtttaataatggatacagtctgtgattttttttactttttgaaatttttaattttaaaaataaacactttcaaaaattatttctaaaatctgaaagttttgaggcaaaataatgttaccacgccagtctattattacagcgttgtcttgttgtcacgccacctaggttagcgacgtagtcaaaagatttagattttgaaaacaagtgttggaaaggttcgtttctaaaattataaatggttaaaaaaatatttaaaatatgctgtttgtatacatgacaacactctaataacaatagattagattcaaaccgctcttccaactgtcaaggtataaaaacacaacaaactaagcacaccatcaagatcccagcgacgtcatccaagaacaaagaaaacgcacagcttattgcgatcgagacgctaacctacttccttccataggaaggagcatctggttcgcggaatcgaagctgtggtcgcaggttttgcagctggttcgcgcacgacgtcaacgcatacgcggggtggatttggcgcgagccaccagagaggagagagagaggccgggcgattgaccgggtggacgtggagggatccagttggacgagtgcctcgggctcggggtttgcgtgcgtggtgcgggcgcctcaatgattggaggcaggcgctacgttgcgttggtgcgatgcaccgaaaactttggagctttttttcttgggtccacatcctacacgagagccacacacggtgggcgccaattgtatttgtccctagatcaaagaatctatagctatatatgagtatattttttctaggactttatctgcatatatacagtgatgagtttataaagactcgtaccataatttggggtttaattatagcaaagggcttagggtgtgtctagttcacgctaaaattgaaagtttggttgaaattggaacgatgtgacagaaaagttagaagtttgtgtgtgtatgaaagttttgatgtgatggaaaagttggaagtttgaagaaaaaatttgaaactaaacaagggcttattccaaatgtaggataggaagacacaagaacattatatagttacatgagcaaaatataatagcgtccatcctatgccagccaacggggtcggagtagctgttttgagtcccgcgaaattcctattttcacataattgctacagtattccttcgaaattcctacactcgattcatgcgaaccaaaatacataaacagttaaaaaaacaaaggaattgccagctctacgaaaatcctatgaaccaaatgagttctaaatagaaagagcgattattatatgagctagttgttgcattggctatactccaatatatgacaaatttatagtaatagaatgtatcacatctaatactatatttgtttatttaaaaacagatggagtatatatgttaggtgacatatactgctatggggcgcagg

SEQ ID NO: 78042 - DNA, 7307 bp, Oryza sativa
ggtggctaaatctaaagccgatgtattgcacgagcatttgaaaggagttgtcgagggtttgctgagctggcaaactgatacaaagaattccttcaaagcgaaggtactggctatttgcttttgatactataaagcaatggcatttctggtggtatttatataaacgctcacaaacaatgatatggttgtttttgtcctgtggaacttttactattctaataactagatatattcatatcaactcatatagacaatatatgacatgggagaaactaaaagagtgaaatatgcatgatatatcacattacatgtaaactgctgctgttttcttggagcttgctattcatctcttatcttattgccagataaagtcactgatggaaattctagtgaaaaaatgtggtttggatgctgtgaaggctgtgatgcctgaagaacatataaaattgctgaccaacattaggaaggtaacttacagtattttttctttgctcttctcttgaagaatagacagttaatgttgtatgattgtatctggtcaatatgctcaacaattccatgcaatgttaaacagattaatgagcgaaaaatgcggaaatctaaatcttctgaggatggggataacatgtcgatgacctcacgagctacaaggtattgtggtgcatttattgttttttttttgttctgagaatttgttgatagttctgatggcgtgaatgtcacatctatttatacaaatttaacttctgttcaactgtcctggtcatgctccctgcagacaaagtagatggaatcacacacagatgttttctgattttggaagtgatgaggatgactccaatggtcccttttctgcccaacatacagttgcttctcgtactggaacaaaagcttcaacacggtatgtgccacaatagggccacacttggtttgtgaggattttaagtgtttctcacaaactgttatttttccaggtcgaccaggaagcgccaagcagataagagcttgctagagaagttcattgatcagtcaactggcgagcccctagatttacttgaccagaaaacagtgcggttggctctcaaatcgacgaaaaagagggctatgcctgatgaagatgatgatgaggtggagatggaccctgaagggcgtatcattgtgcgggaagagcgggagaggcgcaaaaagaagcagcctatctcccgagacgacgaggccgacgacaggagcatggtccgaagccagtccgtcaagaggaggaagacgaccagctccggctgggcctacactggccatgactacaccagcaagaaggccagtggcgatctcaagaagaaagacaagatggatccgtatgcctactggccattagacaggaagcttctgaaccgcaggtcggaccgcaaagcggcggcacgcaagggcatgagcagtgtcatgaaggtgaccaagaagctcgaagggaagagcgccgccagcgcgctcgctgctaagagaacgcaaacaaaaaaccggaagcagaagaagagcaagtaaggagacgaagggacagagagagatagggcaaggaagctttgtatagctgaaccgatggcccttggcagttgggagggaaagttttggacgtgtacagtgcttggtgaggattcggccgtagtagttgtttttgctcgtttcatctcctatctgtcgaagagaaacactaggttccattcttgccaaaaagggagattttttgaggggaaaaagggggaaattttgacacccgtcggtatgacggtaccagattcagattagatttaattttcttgtaagtttttgattgatgactattgaatttgaaatttgttgcttcctgcccgctgacacttcgctgtaatggaagatgagctgtagcgaaatttccgaattccttattcgggcatacgcgctaaaacaatcgcgcgatcgtggagctgtacggggatgaaacgcaaggctacggcgtacttgattttttttcatagaaagtgattttttttcttagaaagtgattttaaaaaaaagacactgtcaattcaactttttttttttaacaagggcaaacttcaactgtaatatttaaaactttaaacttaaaaatggaaacaaaattaacttgaaaacttttaactcaaattttgaaactttcaactcaaattttaaaaactttcaattaaaattctgaaaacttttaactcagagtttaaaaattttcaactacaaattagaacttcaaactgtttttaactaaattatttgtgtttttttaataaaaagctaatgctaagcttcatcattagcactattagtgatgttttgcgcgagggactaggtagggtgcatgcggccacacactaatcatatggagcagtttgaaacaagggttaatttgatccgtgacattacaaatgtgcctattcagataattagtctatttatagccatgtcattcaaatttttacaaaattggaaccatgccattgttgtctcgttttctatcttccctatccgtgcgtagggcccgccccttagattcattttcttcctctttcctcctctcttctatttttttttctttttttcccatctctctccaacactttcccgcctcctccccaccaatccatcccgacccactcctcgccgcccgcagcaacaagccaccgacatcgtactcgaactccgcactgatcaagcgagagagaaggctgccaactttgtcagtggtggcgacaccagcatccaacaccaacattgtcgttagctctagcgcttggagtctgccaacgccactgcctccatgccgactatgtgcctctactggccccgccacgttggaccggccttcctagagctcgccggccagcctccgcatggtcagcggggagaaccagcatcaggaaggcaggaacgggcaaagcaccatggggaggggtagcggcgaaggctacttgttgcatcgttggctagaggacgacggctgagctagagcgctggttactcgagctccatcgcagctgcttgaatcaagtagttatttcacgagaagaaggctctagtggcaacaactcgggtttggggatgaccggtctcatcatggagccggcagcaacaagatccagctccggacggctgtaggcgacgacaatgtgtgaaggggtcgagatggattggtggggaggaggctgagaagtagtggagagagacgggaaaaaagaggaggggaggatggagggataagatgaatttgacgggtggggtccatgtgcatatggggaagaagatagaaaacgtaacggcgatgacgtggttctaattttgtaaaatttgagtagcatgattatgaatagacgaattgtaatgacatttatctgaatatgttaacagtgaaatttggtaagcccaaagttaccattggtttagagtcagtatcggcttcaaagttctagaatcagccgatgggagtcaagtcgccacgatgtcgtgttcttggtggagtcggatcaatcaaaggaagcttatctagaagagttcgagttcaagaaggatgcgacatgacagttatctattaattaggcatagtttgttagtttccttttatctttagaaaagtgtgtttagtgtccgataaggactttatcttttccttttatctttaggttagtttctttcttgtccgacaaggacttgtatcaacccatgggtataaatatgtgcacccggggtctatgtaatctatcttcacgatcaatacaattcggcgcatcgccaccttttaccttttctactttattttatcgcccagtgggacttggcacccgacgtgcggctgcatcgtcttcgatctccggcgaaggggtaagtccaatgttccgtcggcccaggcaattgtatcgtctacatcggcgtcgttcaaggctgcatcagtacattcgacctcttggattgctctggtttggatgatatatttgcctagctatttatcatatgtctctattaatctagtcttagcatatcaatttagctctatcggctgcttctcgctttagggtttctgccggtatcggctaaattgcgttgctagattagattggcctaggcatctaccaccctgaaaatcagtcaacggcttgattgtctagatattgtgtttcttttcatacttagtgctgcatcagttaagtttgatctactaaatcgtgcttagaactataatctctaacctgctttctgactgccaataagggtttcatcggggtttcagccggtgaattatctggacgttgcatcggctcataaggattgcatatacatataagttggatttcgccgatgacaacaaaggtttcactgtttaatctaatcttgtggatttcatgacatcggacctccagccgatttgttatattttattatcagtagccgattgcctttatatcattatatacattggacatatagccgattgcttaaaccctatcgctatcggctggtatcgacatcggctattatcgactatcggctggaactactacatcggcttgtcagccgatcggctgttttgatctactatttacatatcttgtcagttgcatgatcaaactgactggcacgcccgcatctcatcgtatttggacctgcactggagctaagcagatctcccaggccggtgtgttcgatttttttcgtcaacagaataggcatagttgcaatggtacagatcaaattaacccttgaaacaagggattgaagcctactaattcctttgaatcctatggaatgagtacctattggtctctcaacagacgatatgacctatcagtgtgttataaggaacaataccttaggactgattttttttttacaattttcgataaaaaatattgttacttatttaaaaattcacaaatctaggtgatatgtcacatttagaattttgagttttaatctttcttggtaagttccaagttggctagatgcaaaagtttatatatgaaagaacattgataatggtggggtggttttgaataggcatttttgaaaattactacttagcagcggtgtaaatctatccagaggatcatgccagaaacatcgaaacttccggttggtcttctcgatctggacaagagagctgaatggagtttccagtccttaggttcaaaactttcgatcccctagtttcttccaataaagagggtgatagggacaatcttcatggaacaagcaatccaaacacgtagagaatgcaagaacaacaagcaataacagtttggactccggaacttccggcctgaggaaaatcacaaacatagcaatagatgaataaggagacaccaatttttcaccaaatttggcattgcaaatatcctacatctatgttgagggactccaagtagccagttctcgattaatcttaagcctcaccaaatgaccacaaagatcgagcttggtatccactcaaaggtgttccttttccttgttgagatagagtaacgtgttcacaaacctcttgggttgtccacacaccctggatactcgtgggtgatgcctaactagctaggagaacttccaagagtaccaagcttgaagatgatggtcggatgtcaatcctaagtgctcaaactgaacccccaaagaatccactccaatctcactctaatcactcagatgcacttgatccaaggagagcttatgggaataggtctaaaagttctaacaacaacttgctcaaagcaggggtaggtggagttaaatattcacctacccgaagctaaccattactcacaattttgaacttcggaacatccggcttgagggctgagggttccggacaatacttcggttttggaagacatggaggaccgaaacttttcgactcaaactccggaacttctgattagccctctctgctagctagagaactgtggttggaacttccggaacttacgtctggaacttctggtctagcccttggccaaacagagagctctagttgaaggttccgaacccgaactttgaagctttcggcctggccaaacacaaagctcttttctcccaattgtgagtgacatgctttgtgtttctctctaataggttttcatctgagcacaaggacacaaaccccacttgaataggtggtttttcctatgactcaatttcaaaagaaaaacaatgaaatgccttaagccatcccattgttttagttttaatttgtgagggtcatccatttagagcatcatccttagggactaatcaataattgtgcttaacactcaagtagctcattagtcccctaattgtcttgcctttaatattcctagatgcaatttaaatgtaagaaaatctctaatatagatgtgactctcttaaagaaaaagtgactttagagaaagtcacgctttatttaccataatcaataaaacgtgactttctcttaaagaaaaacgtcgtgacatgaaaatgaagtgattattaaggtgaaaagcacgagtgtgacgatgactagctgaccacgcatattgcacaccgccatcttggcaatcttaagttcctagttggttagacgcaaaagcttacatgaaaaggatctctaatagagtagtgaccctcaaactgtaaaacaagtgaatccaacactcttcacttaggggaaaaatagtgtaaccaacactcttcatttgtaaaataagtgaatccaacactcttcacttaggggggaaaaagtgtaaccagcactcttcatttgcggtcggtaacgacgtatgcctgcagtagccactccgttagctgttactgccagcccaccacctcggtatcgtgtatacatgcaacaaacagctactccaaaaatacttatattttaggacggagggagtagctagttagctgtggccatcataagtacaaaccgacgacaagccaggaaagcactgaatactgcatacatggaaaaaaaagagaggaaatattgccactgacatttcaccacaccaaaatttgtgtactgaaacaatactatatatgaatctatatgaatctagatatacatttgttcaggtacataaccaagattgatttcttttggacggagaatcccaaaatgcaaggacttttccttacaaattatttcaaaatttgaaatcctgagataaaactttattcccaacctatcaattacttttaaccttgtttattctctccaccatccattttcttactagtttatttctccacctgccaacttttgtagtactttattgtttcaccttcacctatcacctttt

SEQ ID NO: 78043 - DNA, 624 bp, Oryza sativa
tactataaaagacactagtggtgccaccaccactacttttgtactttttgcaaactagtcccttatattttctaatattatataattgtctaatatttgtttcaatcaagtgaatatcatgtattcaaataagcaaacatctctatgacatattattatatattttcttttacccatagcaaagcatggatattttgctggtaatttagaagtgacaatacatcatctcttggctaggttcttgggattatatgaggagacacagattccagagaactgttcaagtgcatttgatgtgatttgccagcgaatggagcagagaatggcttatatccacaatgagcaggtgaggattgatcatatcagcagtcctccttcgatctcatgtattttatataacagtacagaaaatttcatgaaattatcaaagtatactcttttttccacaatacaaaagtgaacttgagagactgagagagctgattttttttttacattgaacgggcaaggtctcagaatatattcactcttttattgtggactttaactaaaagaaacttgaaagagagctgaactttacatacaagtgcatttgttcctttttttattgctcacatggagtat

SEQ ID NO: 78044 - DNA, 12516 bp, Oryza sativa
  unsure (1)..(12516): unsure at all n locations
cgttgcttaatgagctcgatcaataggccgtgatctctctttttgtgaccatgtgctacctacacggcatttgcttagcttaatgtgctcatcttcgactgcattaattaataattaagcaatcggttttgatggtgatctacctatagcgacaacgacgacaacagagagagttgacgacgacaaaagagcacccataatagttatctataggctatctataagagatccatatcagcatattatctaacttggaagagattaaatgaagagagaacaaagctatctactaacctagagatagtctatagagaaaaacgagacaatgaattagagagctataaatacacatgtagacacattattgaggtggtttactattaatctagtctattactgagatatacatattttatagagagcatcttactttaccattgtagatgctctctaagggaggttcactgtaatttgatcgagtctagcttgcacgagtacgcgaaaacaaagtgatttaatacaccactgatgattcacatgcgatataaaacacacgaacgaagaacaggtagacgacaaagacgatgtgcatgcagaaacgccgtacacgtacaacaacagtgccgatgatgtcgtacatatgtgatcgatgtgatgtgccatgtgtgtccagggcaatcgagagatattccacacaaatataattccattgtccagacggctcacctaattaattaagcacactattaagtacaggaaaaattacaaaaaccacctcataagtcgcttgaagtttaaaattccaccaataagttaattattttgttacaaatgtttatccatatatttagttttgttgcaaaaatcatcccaacatacacatgcttaaccgaatcaatatcttttaataaatgctccctccgtactcgtaaaggaagtcgttttggacagcgatacggtctccaaaacataattttgacttcttgtttctataaaaatatttattgaaaagtgatatatgtatacttttatgaaagtattttttaagagaaatctatttatataatttttacatttttcaaactcaacaacttgagaattatttatgatttatattcttaaggtttgacttaaatattgtcctaaacgacttcctttacgaatagggaggaagtacttccagagtcttgatactttttttttgagatttcacaaataaaattgctgacaataacttaaatgttttttttttgcaattttagggttgtttttgcaattctcaaacttcaagtgaattatagggttgtttttgcaattttcccttaagtataactacgtatgcatacagagtacagatacacaggctattattagcacgtgagagttgatgtccacgtcatggatgtcgtaaatcgatctgtttcgtcgtcacacaccttgcagtagaatcgatcgatgtcgacattatgatgtgatataattaatcgacacctgttcattttagtaaaatttgtttttattgcatgaatcccattcaaacgggaagggagctagctagctggcaatccaatatttgcatgcttccaaattcatatgtggaagtaaattttcatttcaatcaaacgtgaccgagagtataattaagtgtttctttgctgaactacgttggaacaagtccatagaaaaaaatgatatgatatgaaaaacatgcatataatcaatttttctcttctgttgtttattgttctggtaaattttgctctagatcatttgtggtttgttggttctaaactatcgagggaatatccattcgttgtttgcatgttatctaaatggttatgaaaaaaattcaacgagatcgattaatatgcgatattaaacatgtgtgagtgatgcacatttgaggctaacctcctccattgtaggtatcatgtatcacacaagttagttattcacattattgatatgacagcagataattgatttgcataagattcaattgcacaatgagtacatttaaatagtactatgggtttttctgttcttcaacatattgctatagatatgcattgacatcgagagcctatggaaaatatttctatagatattcatttgtactgctgactataacaggcagtactatttccatgtggatgtttcataaccacaaaattaaatatcatttcctgattgattcgtacaactgtgcattcaccgcgaatagtgcacacagcttatcgttctcatacgaaagactattcatatatataagaataaacaacaaaataattgaagaatgcttatatggttaacaatatgcaacggccggtttcacataaaaatatcgagagagagatcagagagctatcacatacatagacgttgtttgacatcctgatgcattttaaataattactccttctgtttttaatcaataactatcaattttaattaagtcattttttaaagtgcttgtcactacactttcattagtaagattctaactttgcctctaccgaacccccacatagttctattttggatcattccttttctcgagaccccctttaatttactagttttcttaattctatttcctaacaatttttagttaaattttaaataattagattggtcaaaaaattttaactaaaattttgccgtgttatacatgccaaatatttttaatagcgtgtttgttttgtgttacaaatgctattatatatgcacggtgtttgcacgctctagacgtgctgatccaaaatatcaacagaaaactagcgagctcttgtcaaatccatctttcctcattcgcaacgacaacacaaagcataatcgttaatctggtatatatacaggacatacgtgcagtggctatcacatgaattatattcgagatagagccatacacctgccgtctaaggctgtgtttagttgggaaaatattttagatttggttgtcacatcgaaggtttgaccggacgtcgggaggggtttttggacacgaataaaaaaactaattttatggcgagcatggaaaccgcgagacgaatctattaaacctaattaagtcgtcattagcacatgtgggttactgtagcacttatggctaatcatggactaattagactcaaaagattcgtctcgtgatttccatcctaactgtgcaattactttttattttaatcaatatttaatactccatgcatgtgttgaaatatttggtgtgatatttttgcgaaaaatttttgggaactaaacaaggcctaatttgcagggcgcatgacagcgaacaacagagataataaatgagaaaagggggggcgaattgaagagactcgatgcatggcttgtagagaaaccgctgtgagagggaagatatatgcttactctggctcccattggatggtctaatcagtcaaagaaaaagccaaattttaaattttcatgcttaattttgagatattttaaacgtaatttcttttttaacattgacttttaaatcaccaagaacacatttataaaagttttacctacaaatttatttttatttcctaatacggtttattaggaaatatgccaaacgatggggaccttgctctctgacatcttcgagagggagggtgcctacagcggaggcaaccaataatcaatcgatgcatgtttgtatcgccctcagacagtgaagattacgaccagattcaagctgagttgattactgttaattgattaccgtttatgcatgccattagcttcagccgtcgataggatgatcaatgatgataggataattaacatcaatagtgatatcaataatccacccagcaaaactaattaactggtcactgcatgtacgcataacctaatcgttggactggatcaaggtcggcgcaggggattaattggagaccatctcacttggaaatcagaataaaactgtttgaatcgccggagcttgtgtacctaataaataggtcgggctctcgtgtcatcgatcaaaagggaccacatcattgacgacggagaaaattgaagaatgtctagctttatagctaggagtattggtgttcagagcagattggatcgattaatctccattatggtaaaacagctgctttaattaatttgctaggctgatcatagcactccaaattaaatcaagcaagtacggtagtagtacagctcatgctcaaagctccaaagaacaacttttgcgaataagttagccgcgccttttcttatttttcttcgccctcgcccgcacgcagctcgccgcgtcgctgtcgtcgtcggcgctagctgggcttacctcgcccacgcgacccttcgcgcgagacctcatcgatcgccggtgggccggccggtcgcctgccgcggccggcatgcaacaggctcgtcactgacgctgacctcactgagtcactgacactctgatggcggccggctccggtcagtggtgtgatgcagtactgcgaacagatcagaaatcagctgtagctgctgtagcctgtagcaagcagcgtgcagtggcactgtggcagaagcgactgaccgatcgggcatgcgttcatttcgcagctgactcggccgtcccggattacactttttcctgtgtgggaaactaggagtgacgatttttatgacgaatccaacaggaaaagtatgttacaagtggagagactggcagagaaattcagagttcagatttagatcagctggccaagaaaattaacgctcttatcatctacttatcaactgcagccaaatttagaattatagttaaatttaatttttagagttcattttagtgtttcttatcttacgctagtttccaacgttatttttaaaaccacaatcgacatagattttctaaaagttatatttacaaattgtttcccttcattcatttttaagctgtagctcaaacgagagaaaatttcttctataatgattaaggccccgttattttccacccattagctaatatattacgaacatgttttccaagccactaaacaacatgattcttttagaagaactttccatgtaaaaattacttaaaaatttaaacaaatctatttttaaaatttatgatatcaatacttgattgattatgtgttaattgaatttcttctctggcaagtaggccaaacctttcaaacgaacagagctgcatgtttctctgcatctgcatgtcctgttttcctgattccagaccacacgggcttgctctgtgtttggtaggtcgttgggagctgagttttgctgacaaaatgctacttacatcgttctcatccgatcaagtgcgtgccttgcaagttgcaacaaagcttattactagatccaaccatttcgctgccagcacnnnnnnnnnnnnnnnnnnnnnnnnnnnnnnnngactcgccgacgtgacgcgtcccggagcggattccaaaggcttaattttttttgctaggcaaaaaggcagcagcgaaagcaacagacaaattcagctaagaaaggccagcgctagctgcttattcctagcatttcgcacattcatattaatgttaatggatctagatatatatatactatgtaagtcattttagcatatatatgtctagaatgacatcaatataaatatggaaaatgttagaataacttgtattgtgaaacggatgaagttattagcttcccctggacgagggctctttggcatgttacgattaagctgatcggcatcatcatcaagacggcgacgcccgtaaaccggggaattattggctccccaatggcgatgcctgggacgatgtgggccaagaaaacggccagtggcacggcgcgatttgcaagtaaagatcgatcgcgatggacgtcgttttgttaatttgttcccttctggcccagctgatcaatcgatcgatcgatcgattgcaggaagagtagtggcattcaagttttgatggtttttttctgcactgcatggagggtttgattggaagaggttagctactagtaggacggtagcgatgggtctattctgaatttttgattgatcgatcggcgtcgtcgctgttgggtagtcacggttcagaaactggtacagattcctatttcctggtcctgtgtatttaaagagtagacgcttcttgtctgcactcatatatgcagacatactcctacaccgcacaatgcatggattcatcgttcatctgccaagtaagggccccttagaatcgcatgaataaaaaaatggaggaatagaaaaaacacagaattctgacaaaaatgtaggtgtaaaacataggattggaaaatacaggaaaaacatatgaatgaccatttgattagaccacaggaaaaacgcaggaatcaggtgagatagatagactcaaaggaatttttccaagaggttagacctcttgctaactttcctctaaaatatctataggattacacatttccaaggtgggtgagagagcggaggagaagcgcgagaacgcacgttgaggccgatgcccttgatgtgggtctgggtcgcgatccactgcttcttcctcctcgatcctcatcgccgctgccgccgccgccgccgctgcgaggacgttcagcagctaggacggtcgtgcacgcggcggtgacatgaaaagtagagaaagtgatacaaagtagaacaatttacaattacaatagtatattttagaaggcgcgcggattaggtggtaaagatataaaggcatgtgtagtggagggtgacgctatcgaggcggttccgtgattgagtttccgaacccctcgaacacaatatttaccgttggatacacatacgacggcgcagatggggaagagcgaaagtagcaaattatgactgcgatcctagtgaacacaatcacgtaggatcatgttcggcgcagcgatcatgtcgtgttttatcgtactgtagcgctgcgactgcagcagctatttgaggattaataactgatggaatagacctgatggaattcacagatcacacaatgaagggcccgtttagttttgataccaacttattgccttattgtcttaccaatttttttaatagtagcaaatgcatgtttggttagtagtaaatacatgtttggtttgctacttttgtcacaataattcaaattcaatactacctaatttggtagtgctaaaactcgctaagattttaacacaaaaattggattcaaaccaacaagccggaaaattcatcaccttcgccgtcatctccgcctcccagtcgactgttgcgccctgttgaaaggacgactttggtttttgttctccccaaacagggagtcggacaataattcaccgaaccccacgaacgcaatgacttcccgcgagccctccttcccctctgggagcgcaccgagtcgtgcataatatcgtatgtacatgatccaccctttgcttgctttcgctcggcgcgttcaccggacaaccttttcatggcgccgccgccgagctccgttgatggtggccgccccacatactagtggagacgatgtggcaatgcagtactagcaggattgaggaaacgaagaattgtagctgtaggattcatataagacagagatcataacataatgcatcgatttggaatcgttcacgaacgagatttgacataatttgcttgatcctacacaaaagaacagctacttccgtagtcttcatcttcacggtcacaccagcgtttatacatagcagatcagcgacaacttgtactaccgaaacacgaacagagcacaaacacattctactgctccaaccattctcggcaaccatttccagcttctactaccgccacgctgccattacccgagcactacgctatgattcaggcgatggtgacctggacggacttggtcttcttctccggcggcggccgcttcttgacggtgaccgtgagcaccccgttctcgcatcgcgccgagatgccgccggtgtccgcgtcctccgggaggcggaacttgcgcgcgaacgccctcggcgacgcgcggcgctcgaggcggatgtacttgcactccccttcctcctcctcccgcttccgcttcccgttcccggcgccattgctgctcttcatcaccagcaccctgtcctcctccagcgtcacctgcgcagacaagaaagaatcgcgcccaaactaactcgctgattcgaacgcgaatcgaggaaattcagggctcggattttgtacgcacctggatgtcggacttggagaggccagggacgtcgagcacgaacgcgtactcgccgggggtctccatgatgtccactggcgcgccaccaccgattccactgatgcggtgctggccgtgtccatgcgcggcgtggtgcgcgtggtcgcccgccgagcggcggtccccggcggcggcgccgaggcggtcgagcacctccggcaggtggaggaggctggtcacggcggtgtcgaacagctccgtcatggctaccaacttgggctttgctctctcgctctccttcttgctactgcagcaatggcgagacggcggtggaggagaggaatgggtataaagcgagcggaagcgaaggttcgagatggcgcggagttcgctgcgctgtcgcgcgtcgagaaagatcaggagacacttggaagaacctcgtacccacttgtacattgggccgaacaaagcccaaatctcccatcacagcagctgttttggaccgcagtctaggccttggcctggttggagagttaatccgcagacaccgagcccatcaaatctgttgctgacactggtggcctcgtgcatggaatataaagtccacttatggcctctcaactttacttcaagtttaactaacatcccttattcccagtacaggaaacttagcccatcaactatacgaaaccgtacaatttgataactcgtggaggtggaggagttagttgcagggagagcgctacgcgtcggacgtacggcacgagacgaaaaatcggtgcattcatgagccgtccgatccacgcgcatgccatcagacatccaacatcacgaagcatgcatgcatgaaaaatattttaaactactttttctcttaaattatttatccaagtcatgatccgattacaccattaaattcgccattaaattcgttgcagttaaatttttaaaaaggaaccacacatggatatattccagtgaaaaaaagcttattattgaattatttttaaatgttgcacattgttccaccaagtatatcggaattgtttcactaggtagatcgaaaatgtttcaattgtttaaatcggacgttgtttcgccttatataaaaacaatgtttcagcaaatagcgaaagaatgtttcaagtcactgcaacatttgatcgatataaagtgaaaatttttttgtggaacaaaaaatgaaacgaattctcttaatagatgatttacataatatgtgggtgatttgttgcaaaagatttttttcaattcactgcaacattaaatctatacataaacattgtgagtacactaggcgaaacatttttagtggaacattgtgagtacactagtggatacttattgaaacactcgaccaacatatgtgcaacatttacaaataaaccagtgaaacacaataaactacttactgaaacatacaaatagcactatgagatacattaaagaaagatatatacatcgcgacaataaataaatatgtgcaacataatagaatttcaattgaaacatctaattttcatatgtgaaacattaattttaattggttgaaacatatgtgtttttttatttaatataatcatgtgagatcttgttataaagatttaattgtaacgaatacaatggtgtaatggttcgtagattggatgagtaatttagaagaaaaatcgttttcaagtttgctaaaagtgtgttatgtacatgcaagtaacctcgtgtcatctctctttcatgcatattaatacccaaaaaggaagcatatgtaacagagagagatgatctgacaaaggctgcatgcagtaaaatcacagtaagaggcgtccgatttctttgtcaagatcggacgaccggattgaagcattttcctagttgtagctgtcgtctgggaggcccagttccataatctctcagcggactacctccccacctccgccttcctcccccacagcgtgcacacttcgctcttcagctctcctggtattgagagtaagggatgttaatcaaactcgatgtaaagttgaggtagaaagtggacttatttccctcgtgcatcgccggcaacctaagggcctacttagatcgtttggcaaaatttttcagcatgtcacatcaaatgtttggacacatgcatgtagtattaaatataaacgaaaaaaataattacgtgtaaattgcgagatgaatcttttaagcctaattgctttatgatttgacaatataatgctacagtaaacatttgctaatgatatattaattagacttaataaatccgtatcgcattttacagcaggaatttataatttttttattactagtctatatttaataatttgaatgtgtgtctctaaatcctatgtgacccatggaaactttacatatgcatctacgcttcggcctcggcacacggcccacgtcgtgtcgtcaccatcgtcacttcgctttatcgggacaaagggagcggctgcccatggcccacggtgcacccgttccacgtgagcgcgcgcgcgtaccgaactttgtgggccaaacccgccgcacagccagaaagatgccgcagccgccgcatgccgtccacgcgcgccacgtttcgcggcgtccaccgtgagccaggttcaacgcaccagggcggaggagagtgacgtggcagtggtcgtaatttcacctgatcttcgtggcctatctctcgcaggaggtggcgcgtggttgacgcggtcagaaaagcgcgcgcggccgccctcgaggcgccagctgggcacccgcgcctgaaacttctggatggtcgcccccggaaatatctccgtcctcccaaccacatctcagccgtcaaccacccatcggacggatggtaaaaaaaaaagaaaaatgatccggttagatgtggggtggtgggccccacatgtcactggaaaggtcttgcactgttctagacacatcacacatctgcttcgaggcgaccgttgcgttttttttcctgatgctccagtggaaaaaagagcggccttgaagagcaagtttaacagcgtagccaactactggctctaatttatctatagctaatctaatagtttatttatacaatagttacatactacattattaatacatagttccatatattatacacacactgtgtcttggagtctgtgctacagttggctacaaatctgtagctcgctgcccttctctctctttatttatcttcttaaaatatgtttgcagctggcttatagcctgctattatgtgtcttcaggcgtgtaatcataaccaaactaattaaccgctagtgagcgtctaatggagtagcatcaccagctaaacgtatttcagaattgtggatcagatcaactttttgtctaagaatctttagttgctccggctttcgcaagtgtaaaaggcactcgcaattggtaacacacgccatagccacactgaaaaggacaagcatattagcagttgcccctacctttcaaacgattctttcgcctgattaacatctttttcgtccaggttgaaagttgataatcacaatcaattaggcccctttgcaatgcatggttgtctgaaaattcaaatacagtaaaagtgcaaaacagaagatgcagctagtaatttccccacatagcagaaaccacataaaaccgatcaattaggtatcaggtcacaattaaccatccggataagctcatcaggagtgcatctactaccatcttctcgaatgatgtgaaaaaaatggcaaattgtcaaggttaaccgtaaatctacagtgccaatttctgacggcacatcctacgagcctcatagattattcatattctctaataaacaaaaagatttgtgagagaataaaaataaatttatagataaaatgtttatatatttgttcgtagcgatttaaaagtcaatgttaaaaataaattacgttaaaaatatcttaaaattaactttaaaatttaaatttagattttaattttgatttattagccaaccgacgagactctacggctctgtgcgcaacagtagcagtgtctggaagcagggatagctagctgcagctgtagcaaaagcaacgatggccagccaaggctgggcgagacgtggaaataaagcgaggaaattcctaggcagaaatatttaaaaggcaagtgggcatcatggccttgtttctggaggcttcctggactgcgtggagacgagcgacctgagagagagagagagagaaggcaagggaaggaggagaagaagggggacgaagcggacgaagcgcgcgcgcgccatctttgctttgctttctctctcttccctctcctc

SEQ ID NO: 78045 - DNA, 13408 bp, Oryza sativa
gagaaagagaacgatcgaacgaacgagagcgagaacgagaacgatcgaacgaagacaagcgagaacgagggaacgaacgtgaatgagaacgagcgaacgaacgtgaacgagttagggaacgtgaaagagcaaacgaacgaggacgatcgttaacgtgaaatgcaatatatatatatatatatgtatatatataggacactcatatggggcaccatggtgcccgggcaccatggtatcaaatacacaatgtatatatatatatatatatatatatatatatatatatatatatatgtatatatatatatatatgtatatatatatatatatgttacttcgcatttatcctaatacatttttttgtatcttgcagaaaagacgtgttgtcggagtcatccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaatgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagtgagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcgacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggttttaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatagccatcccaacggaccctttaggtacttaccactgcaggccgattccagcaggatactccaaggtcgaagttgagttggtcgaaggcgcgtacgagtacctcgagctggattaccctacaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccaccgcaggctccagcatcgactcctcctcaggatcctgcaccgactcctcctcgtgctcctacacctactcccccgcaagctcctcttccggcaccttcaaagtcaagggcccccccagctccaccgcttgcccacacaagggcaacaaagaaggtgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgttcatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaagtcttgttatgttaattgctactacgaatcatagctttaaactccatgtagggcttggtatcggttccgtcatttggtccgcggcaaatggagagaaagacttaggcggaagtttaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattctcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatataatatatatatatatatatacatatatatatgtatgcatatatatgtattgaaacatatatatgcatggtttatatatatatatatatatatatatatatatatatatatatatatatatatatatatatataaatataaaccatgcagcaacaggggcatgcaaaaaaaaaaaggtcagctcgatctttagtcccggttggtgttaccaaccgggactaaagatcgatctttactcccggttatttcacccgggactaaagatagcgatctttagtcccggattggtactcccggtttgaaaaccgggactaaaggggggttacgaaccgggactacaaagggtttctccaccagtgaaactagaaaaactaaaacataatcccaacctatatacgtggatggattgggattaggacctaaccagaggcacgatggaggtgtgagttcagtaaatgccaatgaaagcacattttttgctcagatatactctctccgttttataaagagtacttttatcctttttttattttaattactgccaggacttttgtcttgtagtgcaattttcattaaatggaaaaatataatcacagagagagcactgttagatttataaatagtactttaagatatccaaccattagtacttcattattcttcccgttttctctttgtattaatgaagggcatgttagtgccgattgctcgatctgctttaactttcaaaaacaacacttcttttatggagggagtaatcatctactcatgttgctgaaagctgaaagctgaaagtgtgagctcactaatcccattcctctaaaattttttaactatattggttggcctttctcagacaagagaattcttataattctctctatacagtacattgaacgtagtatatttttctgcattttgtttggacgcgactagcggttatacgtcttatcctagccaaaatgttaaatgccgggtacccctccgtcaaaaaaaaattccaatcctagtacgaacctggacatatgtgtgctcatgttcgtagctagggtttgtctctttttttttacggagtagtagtgctttattactcgtcaaaaaattatttttgatgtttttaaaaattttctcaactagatgtgacatttaagaagtaccaattataatattaaaagcaatattgccaatcgccttcaagacggtggaagacaccgtgcacataccttcaaggaggcattacatattactccctccatctacttttgattggcatatttccaaatataaaaaatttatttttgataggcatatttcaatccaacaacctatccttttaatgactttttcagatttaatgtgtgactctccattcattcacacataattggctacatgagcatcgagaaatgtaaatattaatgaatcgcttgtttacgagaaataactaatagcatgtttaaatggattataagtagaattaattatccttatcctcgttaggtataccaagatgaaatatcactatcaaaaatagatgaagagagtatgtgcaagtacagcatttgattaaaagagggtgaaacactcaaatacaaaaaggtgcaacaagataaagcataatacaatgttttgaaaaaaaaatacaagaagagcctatcgtccgggccgatggctgctcgtgtcgatgacctctggcctcgtggcctcagcctcttccattaagtggcatagttattactcacatttgggattaaaactatataaaaatcattgtgtataacttggtgtcaatcgtatcctacgttatcaaatattatagtcgggtataatccattaatatgtaattttttcaaagacgagtaatcatagttgaagtataaataatgtctagcgataagtatgtcgaaagagagggattataaaaaggagcatttacaaatttgtcactattttttaaaaattttacaaagatgccactcgaacgataattttattggcatttttgtaattttctagtagcagacttgtaataacgattcaaaatagtagtaaatttgcaattgcactttataaaaatacagtatatcttagagataatcttgttgggctttatctttagaaattaataaataactatatttaattggcagcagcaataaataacattcttccaaggaatcatacctgtcaaccatgaagcagccttcaaacactgcctacttaaggcagttttacatttacactgtacaccgttcagccatgagcctagctaagcatctcaccagctaattagccgttcttctcccctgattcgggtaattggcttgataatatgatggccatgaagaggctttctttctccttgttcctcctcccgttcttgctcctcgcgttcgtctactccctcttcttccccggctacttcagtatcctgccatctctcgccgccaggtgcagcaacagcgtggcggcgacgccggcgaacgcgacggggccggcggtggatctgcgcgtgctcctcggcgtggtcacccgggccgagatgtacgagcggcgcgcgctgctccgcctggcgtacgcgctccagccggcgcccgcgcgcgccgtcgtcgacgtccggttcttcgtgtgcagcctcgccagggaggaggacgccgtgctggtgtcgctcgagatcatcgcccacggcgacgtcgtggtgctcaactgcacggagaacatggacgacggcaagacgcactcctacttctcgtccctcccggcgctgttcgccgacgcgccgtacgactacgtcggcaagatcgacgacgactcgtactaccgcctggcgtcgctcgccgacacgctccgcgacaagccgcggcgcgacctgtaccacgggttcccggcgccgtgccacgccgacccgaggtcgcagttcatgtcgggcatggggtacatcgtgtcgtgggacgtggcggcgtgggtggcggcgacggaggcgctgcggggcgacgtgaaggggcccgaggacgaggtgttcggccggtggctgcgccgcggcggcaaggggagtaacaggtacggcgaggagacgcggatgtacgactacctcgacggcgggatgcgggagggggtgaactgcttccgccacgcgctcgtggcggacaccgtcgtcgtgcacaagctcaaggaccgcctcaagtgggcgcgcacgctcaaattcttcaacgccacacaggggcttaagccttccaagctgtaccatgtagacctgtgaaaattaaggggaaaaaaagggatcggattatttgtcagtattagctgttggcagtttcttcttcggtatgtgcatatcctctcttaaatgcacagtaagttataaagtgttcaaatttaaaacttgcatacataaatacataatcaacaaattacctgcatatatgcgctagtagaattgaagacacaatgactaatgaatgtgatcctagtatcctatcaggattgctattttagttccattttaggaggctaatatgacaaagtgtttagatgtctactactagtaaattaatttactcaatgattaaaaagaacagttggttgctatataggtagttttgccacacaaatggcgtgatttgatttgatacatggctaccactttatgttaaaagttgtttaaggctaagtctgcgcgtggtagacatcgagtcaagcttagtttctgttcaacagatccttatcaggatcttattgtcatcaagacatagatattggaaagagagtcaattaaaatataaagaccctttcctatatttttttataaacatttgtacaaacgcgacgcaatgctcacaacacgtacacactcaatcctatgaacacacatatgtacatcgtatccctatgagtatctccgaaaaactataccgacatatatcttaatattgacgaagtcactacggacgtctcgttattgacgggtacgtctcctatcaccaaaagaatagttatccgatttggcaaaaccattttattttgcattgtttagggcaaccataatatatgaaaaaaaatgatctatataattatttatgatctgctttacctatgtaagagtagttcatatatatagtagtccagatacccttatgcatatgaacatgtcataagtaataaaaaaatattaggggattctctttctcctgattcaggccactcatatgtcacgtgtctcattataaagtctacgcattatggaaccattttttagaccctgtctttaagcaataaaagggctgatttagcaatatacattgctcttaacctttaaggtgtataacatctgctttgttatgtttaaattaagtagactagcaatcatacttctattcttaggactaaacggtcatcttgttttttttttttgaaactttaacagtaggggaagcccctacggtatatattatgaaagagttgagagtacaaaaagactaaattacaaagaaattacaagggagacatccatgactgaataaaaagagtttggtcatctctaagtctaagtaaatgtagacttaggtcatctttaagagcagatttccagcttaaggtcgagggcatgatagaattgaagaccagattattcttgtgtttccaaatattccaagccgctaagaggaagatttccatgaaacacagagtcccaaaatttgctctctggtgaagaatcatatcatgaaaactgagattaaagttccaatggaaaccaatagaactccagcaacccgcactaaattgacaagagaagaacatatgttccatagtctctctttgattgctctgaaaagattgacaaatgatggaagcattgggaggcttgcagtgttttctatccaaaagatccattgtatttactctgtccatcagaaataaccaaccaaacaccttgattttcatcataactttgcttttccaaattaaaggtaaagttgctggggggagatgctccagaaaagcaatttgtagaacctgctggaagtatattgtgccgtgctccaaacataaaatccatacatcatggtttatcgaaaggtgaatggcagatagttcctgctcaaaaacctcatattcctggaaagcctgaactgagagagtaaggtgaaagttgtcatgcaggtctctagagaagtaggaaacaactgaatcaagtttattcttcgcaaaagagaacagtctaggatactgctgcgatctggtccttcctccccaattatcctcccaaaacaggactgaattgccattaccaccgatctggtcatcttgtttctccaccaccgatctaaacggtgctcttcttctctctatcttcaaatcatcccacaacctaataagagcaagtataataggatgttgtaagaatgctaaatactgaggtggatgagagaggagaggagagagaggagaagcgggtgtaagcttatagccggcttacgtacaggaaccaagaaaatatgtgagagagacaggtggaccatacatttatagttcatagctaaccacttatatgagttggctgagaggtagactataaagatttgtttgttgcatgatgagaggggagtaactatgaagaagatacagagatcccagaatcaagccagccatatgttagtaaagctcgtgttgatcatctctctgattcttgtagccaaatatctcacattctctgtaaggactctgttggttgagtaatatatctttgctcttcttcgtaaaaaaaattctatacagtaagcagctaattgtattattagtctttctctaaggtcatttctagtgcttcacatttgctagagtctatcacactatagcaggtcatgtaggataaaaggtaagatgatagtacaattaataaggagagagcagcaagacccgagtcttgtatgagatctagtttcaacacgaaatcctaccggaaagaatccacaaaaatagtattgaggcatactccctccattctaaaataaaccaacctcgtacatcgatgtgacatattctaatactacgaatctaaacatgaacacatacaaattcgtagtactacgatgttacatcaatatacgacggagggactaggatctgtttagtagagctccaactcctaaattgagttgggtctagagtggagttgtggaacagtctaaacccagctccacctctctagttcattctgtgagaacgctccacctagctttgctcccattttagatagagctgaaactgtttggctaagctcaaactccatttcttctaaaactggagctgtgccaaacagacccatacatattaaccgattgaaatgagggtttgatgccatggccctctggcctctctctcaagtgctccctttcccggcccatgggccatggtccatttcgctgtcttctcatcccacattgatttcttcctccccgtcgtgaaaaatcccgccgcccagcgttggtggcctgccgacggcaacaaggcaacaaaccatcacttctgttcgctgctgctcggcgtgctcacctgagccgacttgtactctcgtcggtgcctgcttggctgcttgcaccgtcatcttccccgtgtgcaacctcacccagtggaggatcggaggaggacgcggcaccggcggtgctcgagaacatcgcccacggcgtcgacggcgacatcgtcatcgcgctcaactgcacggggaacacatggacagcggcgagccggcgagacgcacgcacgcatgacgcacctgaaagatgcagagggacggagcagtctgagcaagtaggtgcaaactgatagatatatactgtagttcgctcctggcctcctgggtgctttatttcattcaagcaatcgaaattactactaactattatacaaaatcttctctagcctggttgacgttgcgttcgtgtaaatctatgtgcggcatgtgcattatacaaaattgattacaaatgcaatcatgttgtgctatgctagctgccgtcaagatttagcaaaggcactgattaagcttgttcaggttcaagatgccctgagtatcgcggcagtggtctctttgtcacgcaaggcgccattgagttgtcaaagtatcagtttggactttgaatcttgactcatatatacagccatctaactcctgcatatgccgcaagcaaattaaagaagcaaaaaaatgaaaaaaaatgtaccgatatagtgatatgccaatgtggatcataggtaaacgagcaacaaataattaaccctgtaaaatgccatcgctcacggtttactgaattcccaaatctcaaaattgaaatccaaaaacacacacctgatcagttaattagcctatacggtacctccaaacatttttcaacaaaaaatatatgagtatattagggattgaaaacgatacttgaggattgaacctcacactactttccactactctatcaagtgcatctccaaattaatccctcctgacgagttaataagctgtgtgatcctgtgaaacgccaactgcgtgaatccaaggacgaatccagtataggggcggtggggtctcgaacccccaccactggaacaagtactataggagcctccgtagctaaatcttttttgctacatgtagatatcaaggggctatatttttatctagtttattcatccgccgcagcgtgaatccatgcaatccgacgcgttcgttgtactgtaatctgtaggcgttgactacctcgcatgccacgcagtcccacgtacgcctctcgtgtccccaagatttacgcaaagggcgccattgccgtacaaaccaagctcccccgtcacgcacatggagctccatctcaaaccggccaaagcaccggcgatccgcctccgccttagcatcatatcactcgcgccacccaattgcacgcatttacaattcaattcacagcaatctctggatcacaaggagagcttcttgaatcgcagcagcaacgacgacgaagacgacgacgactgtgtcgagctcgagctcttgcctgccatgccgccggcgaagagctctaagcatggcttccccaagctgtcggcgtcaagcaaggcgctggtgctgctgccgctgctgctcctcgggttcatctacctcttcgtctaccccaaggagttcgagctgcaggcgctcatgatgagctcgtgcgggccgacgacggcggcgggggcgtacacggcggcgccgcgccgcctcgccggggagccaccggcgtcgcggaagcccgacttccgcctcctcatcggcgtgctcacccgcgccgacaactacgagcgccggcacctccttcgcatggtgtacggcctccagctcgccgcacggcgacctgaccgcgcacg

SEQ ID NO: 78046 - DNA, 4925 bp, Oryza sativa
  unsure (1)..(4925): unsure at all n locations
acggcggcaagacgtacgccttcttctccgcggcggcgcggctgtacgccgacgacccctacgactacgtgatgaaggccgacgacgacatcttcctccggctgccgcggctgctggcctccctgggcgcgatgccgcgggaggacgcgtactacggcgccaccatcccgtgcggcagcatggacccgttcagggagtacatgtccggcatggcgtacgcgctgtcgtgggacgtcgtcgagtgggtggcgacctccgacgtgccgcgcaaccgcaccgtggggccggaggacaggatgacggggcagtggctgcggctcggggggagagggaagaacaggttcaacgccaagccggccatgtacgactacccgctgccggcgccggtggacaagtgctcgcacgagtttatcccggacaccatcgccgtccaccgcctcaaggacaacccgcgctgggccgagacgctcaagtacttcaacttcaccaagggcctcgagccctcaaagttctacaagataaactagaaacagaggatccatcgattggaattggacatgcgttatacattgttggttaattttggggaatgaaatggtttctactatatatatttttttgggtattattcgacattttgcagaaattattttcctttttcctcctttaatccccatcagtttgtaatgaacacttgattcaaatacacagatgataactcaaaaggaaattgtagagtatgcaaatcatgaagttgagtagccatgataatgttgctgggacagttttggtttgatatgtcttaccaaattgttttgtgatcatctgatgttggtacggaaggacatttagatatgtttggattgccacgttgtcaaattttgataaggttgaaaattagtatagtaacaaactctgttttaaatgtttctaaatatacgaggcaactagcatggtggcccgcgcagattgcgtggctagtatcattatattttttttcatataatagcatacatgttttctcattatattattcaaatatattaaaatgacaacacaattttaaattttgcaataactttacaaaactactaatgtgtaatattcatattgtattttatatacatgttagttattaattatttttaatatcaaattttagttatttgtagattatatatattcctatatggactctagactcgtcttttaatatttcttttttttaattccgaattttctgtaaattgtatttctatatagactctaagctcttctttcaatattatttatttttatttctgaatttttattatttctaattgtgtttctatgtggactctaaactcatctttcaatattctttaatttttaatttcgaatttcatttacttctaaattgtattcctatattgactttaaactcttcttcccatgtttttcttaattttcaattttagttatttttaaattgtatttttatacggactctaaactctactttaaattttattatttttatttcaaattttagttagttttaaattttattatgtttattccaaattttagttagttttaaattcctatatgaactctatactctacttctaatatttcttattttttaattctgaatttctattttttttccttaattgtatttctatatgaactctatactctacttctaatattccttatttttaattccacatttctattgtttcctaattatatttctatatggactttatactctatttctaatattccttatttttaattccgaatttcagttatttcctaattgtatttctatatgaactctatactctacttataattttccttatttttaattccgaatttcagctatttgtaaattgtatttctatatggactctgctttttctttttgtcagattaatgtgagaatttctaggccatgagagcgaacgtggaggctcatttttctattcctttaataatataataatagattggtttttaaacatgagatcatttgttccattaaaaaaagatactatgcaagcattatttaattttctctaatatataatattttttaataaaacgagtagtcaaatgtcatatccaaaagttacaatagtaatgtgtttgcacaacattgagttaatatttttttaaactcgtgactatctttcaaaatacttactccatctgtttcaggttataaaatgttttaactttggttaaagtcaaactgtttcaagtttgaccaagtttatagaaaaaaataataatattttcgaccaagataaatttattattaaaatatatttaattattaattcaataaaactaatttgataatgtaaatattactatatttgtttataaatttagtcaaacttaaagcagtttgactttaactaacgtcaaaacatcttataacctcaaatggagggagcagctaaaaaggacacacaatgatatatatagatttatatatcttataaatactttcatggtctcataaaaccatcacattttttttccaaaatcgtataagatggtaaaatggcaaatataagttttgactggagggaatagtgcctttatacaaacaagtctactttttttttaaaaaaaaaactgaacaagactaaatttgatttacacggccgtgggaaaattgtaaaaagaattgttaattttcatttatttttccgttggttaactggataagagggcaggctggaagctgggcgcacagccagagtaccatcaccggagatcagagaaaggctcaaggcaaaaaatgagtcccgccaccgcagccacggccggatgccaccacctcctcctccccacggcgagccggccatgcggcgcgcctcctcgacggctagcacgaggcgccgcagcggcagcggcagcagccgggcacgtgtcggtggtgggtcggcggccgctggaggaggtatacaaggtgcgggtggagcgcggcgcggcggcgcgggagcgggcggaggcgctgcgggcgatggagacgtggtccacgtggcggacgggcgggcggtgccggatgccctgggactggcacgtggaccagctcgtctacatcgtctccggcgaggtccgcgtgctcccggccgaggccaccaccggcgaggagtacatgcacttcgtcgccggcgacctcgtccggtaccccaagtggttcgaggccgacctgtacttcgacgggccttacgaggagcgctaccgattcctcgcctatggggatgacaactgaatctaatcgcgttaatccatccatgattggaggggattggggattagtaccaagcttgctagtgtagtgtgttggtggcgcctagggatttatcttcttcgctttcatgttgagtaatttactgtattgtatttcagttaatcgattttgtccttgcaacacaattatgcatgtttgacactgcttgtgcttgtgcttgtgccgccttactttcagaacgttctattatgtacatttagacattctttaggattgctgaaaggatgaaaaatgagcatctgaaaaatacaccgaaatgatgctgatgatatattttaatttgttcaagtattattatttccttgttgcttcagatgctggtatcaaattgtgaatctacagaacaaaatgttgtaaaaggaaggctgcactccaatacctgttgcctatagctgataagtagattcatttccgtggcagtagttaatgctggtgtataacaaatcatcttacgctgaacttgttttttctgtataagctaacttgtttcaacaaatgaagtacctcaccaaagtactcctacaggcttgaaaaactattatctgctagcacaatttcacattttgtacctgtgggcttttgttttgtcacacccttgattcaagtggggtgcaatcatcagtcgagtcgattgaattgttggtggcatctttgtgtgtatgtaaacaattgggtacatttatctattcttattttccatcatagaagcaaatctcttttaagccagcaccatctcaaacctgcaaggtgaggtaagttactttagtcttatttacatgccatttatagtgctctaaatttgccattcatcattntctttccagttacatctgttacttagagttaccctattaaaattttaaatactccatccctattaaaattttacatacggtagaaaactctgaagtaccaaacttcatcactgaaagcttatgtctggatttttcattggccatgtgcattcatcttatgatgcagaggccgggcgctgcccattatctaaaaaatgtctggatttttctgtggcagtactgatattcgaatggcaattcaccctagagtttgggttttgagtttttgcctcaagactgtaaattaatgtcaaatctactgcaggatggttatcattgaacattacgtccagttgggcgttagatgggcttgatacaatccaatgtacttccaaggcattaataatgtccaatgagctcatgtgtttggaagaaatgttggttgtggtcactatgatgcaatggaaccagtcttgttttctagatttttagataatagtcttgttttcttgatgttaaaaagtttaaaagtactgaaaattttccctgagaattttggatatcttgcattatgtatgtggaaattatattttataatagttgcaggttaatttcttgattgtctttcttaccatattttctgtttaagcagaggcagttaggaagatttttgagaggctgagggagaccacatgaccatggaaatgcatatcaagcctatgcagaatgcctggagcagagaaaaactgcaaaactacagaaaggctttgaagagatggtggtctgtagggatgctcgtgctgttcact

SEQ ID NO: 78047 - DNA, 8351 bp, Oryza sativa
tcacacatggtcgcacacagctgcgtgaccgatgaggccgttccctcgaaaacccgtgcgttgcgctctttccaaatcaaccatgtaacgaggatgaccccggcgtcgaacgtcttgcgatcgatcttcgcaacagtttgccgggcagcgagccaccaaccggcaaagtctgaggacggcggcgagcaggagaggctcaaacgagcctgaaccttcacccaaacttgctgcgagaaggtgcaggcttggaagatgtgttggcaggactctccatccttagaacaaaggtgacaaattggtgcgagcttccaacctcggcgctgcaggttatcagctgttaaacaggcattgcggaccgcaaggaacatgaagaacttgcatctcactggcgcgcgggatttccagataatcttgccgagcgggcaggatgttctaccggccgaaaggatagagtaggcagactgcaccgagaagtcgccattaggtgccgccttccagatcatagagtcagtacttccggggtcgagagaaatcccggcgatcacgtcccagagcgcaaggtattcccccatcgcttggacagacaggccgcccctaatatctgcaatccaggagttgtcgcagagagcggcagccaccgtgatgtcactcagcttgacgaaggagaaaagaattgggaatctgtactgcactgatcctccgtctggcaaccagctgtcgcaccaaaacgaggtagaggctccgttccccagcagtactttgctaccagcggcaaagcagtgcagtgactttctgtcagctagaggcgcaacgcgcatccaaggacgctctggctcagcgcggcgcagccaaatccaccgagtgcgaagcgcaattcccattaggcataggtttctgatccctagtcccccctgctcgatagagaggcaaagcttctcccaagccaccaagctgcaagagcccgcagcatcttcatcacccttccaaaggaaaccccggcatttcttctcaatttcgttgatcgcccaagctggtagttccaagacggacatgaagtagagtgggagcgatggcgccaagttcatgtttttgcatatcagaacttgctcgttagctgcgcgtgattaggcttctgttctgtacttcgtaatctagtattagccaatgattaaaagctccaatccagcctgttcatactctattattagtcatttttttgtgcttgtgtgtgtaattttcgtagccgtctaggattgttggaatatttatttatgaagacctaagtgttcaaatctgttgctctgctcgaatggtccaattctgattgtactgcactttgtgaaaagttccaaaatttaacattacctgatctgcaacttgatgtagagatggcatccggacaaatgctcatcctccagcagtgcaaagcacatggaggaagccaaggagaagttccaggagatccagggcgcctattccggtcttaatcttccttatctcaaactccaccctgttctgtaatcacttcacttgttacaacgattatgctacagataatgaactgatcacaaccaaagaaaacggatttagctagttggcaaacttattgcatggagccctcgtgctcccatcccattgttcttgtgcagtcctctcagactcaaacaagcggttcctctacgacgtgggggtatatgatgatgacgacaatgacgatgacaacgtaaggattctagccatgattatgatttattgtcattgttggttcaactttaactcctactgcctctgctgcagctgcaggggatgggggacttcattggtgagatggcccagatgatgagccaggcacggccaacggtaagaacagttagcaccttggtcctagtactagatgcttctcgtaggctctagctgagaggtggtactggtacatcaggaccacaaatttagctgcaaccgtgattggctaattagatccccttttgtgttgtcataatgcgtgataggttccagctagcatttattactttctatgttcttttgactaatcgtattatcatatttcgtttcgaaaattctatcgctgtattttgtaagcaccatcatacctgttctgttctgtcctttgcaaaagtacgctaaaatggttgaaaattaacttactgcttttggtctgagaaaacaagtatacacatggtaaattattgtggtttgtggttctagaactctcgtcatgatacctctggttctcagcgatgattttgctacagtttattgggaattctatgctatttggggttgcatgtcatttgtcatgcatacaatcatttcttgttcattggaataacaaaagaaaatgctcatatatgaatgctaagttatcagaacttctccaggctgtttatctgaaaaaacttgtaaactttggaaatttttgtatagtttatactggatattgtttgttctatgttcatatgtcacaggcttaaaaaaggaactgttatgaaaagctccatgcccctcaactgaaacttttaggtgattttttctagaaccaagctggaaaccggcctctttttctcctggacctgatgcatccaagataaatataacaatagcaataaaataacaatgaatcattggatttgcagaggcaggagagctttaaagaactgcagcagctattcgtagacatgttccaagctgatcttgattcgggtttctgcaatggaccctcaaagtgctaccatacccaggcccaaagccagactcgaacatcctcaacctccccttcgatgtcaccgtctccaccgcctccagtagctactgaggcagaatcgccatcatgtaatggtattaataagcgtggttcatcagcaatggactctgggaagcctccaagagccagcgaagtcggttctggacagagtcaatcagggttttgtttcggggtaagtacgcatatgtcaatttctgtttacttgtttggtttggcaataatgcatctaggtaggcgctgctgtgattacttaattactgtggtctgattaagcagacactgttgcttattgttgatggtgatcaccaaacaatttgtgactggatcatgtgataccttttttggggtgcaagtaacagtttatgctatttggtggaggtgtgctttcttcatcaaagaatacaagttgcagctagattagcttgagaagcacgatttctcttgaaaggaatgtgctgataatgtgaaatcaacttgacctgccgttgatcactgaacatgtttttttttttttttttaaaaagtgcttaacggccaggtggtttattattattattttctgagggaaggggtttatgaattttgcttaataagtttaggcatcagataccatacttgtactctggaatagattcctttggctagctttgctctttttcactgtattgggcaatacactgtttacatttattcaacatatttattcattattccaataaagatttgctttttggtagagcattgtggggtcctggttgtctggacccactagatgtttgggcatatgccatatggggccattcactgggatgttgcacataagccttttgcggccttttcatttgtaataatcatgaaataatccagaaagttgtggaggatccaccaagtgagtacggatcctagctccaccaccagatgtgctattcacatgaggacttgctgatcaactatgagatttctggatagggtcatttgaatttccatcactgttacatcgttgttgtgtggtccgtatatggaacagtctagtgtgctaccttcttctggtatatattaaaattgattgcgataggatttttgtatatgcctggtacggcatttcttggtggtgttctatgtcatttaaggatatcacaaggtttggacgagattatggcttgtctagcatcttaaatagagcccatgcgtcattttctgcttttctgtatgtcctttcttggattgctacgttgccttgtgcctttgctgacttgttcaatttgctattttatttttgtaacacgccttttttgtgcagcactcctggtccaaccttaaatctccaaccagataaatgcttatgataaggccgtgtatttgctatttccttttaagattatctgaaaattcagactggtggtgccagttgcgcatgctcgcaccaaacttgctgtgcttctggttacttggatgtctttgataatttagtgcccacgaggaacaaaaagttccgttgtcggattcttccactttatgctctttctatagttcgcctggttcttctgtagcgatccatttgagccacacttttgatacggtactgatcattttggctggtgcctttctgcagcagaagagtgatgctaaacaagcggcgaagacgcgaagcgggaacacggccagccggaggaggaacggccggaagcagaaggtgtcgtcgaagcacgacgtctcgtctgaggacgagatgccaggttcgcagtggcacggcgtggcctgaccttttgttcgtgactggtttggtcctttgatgtgccggagcaccgagctgctgccgctgccactctgccgtggcggtggcgctgctcggagtgagtgaccgggcgtgccaaaactcgtcgatgctgctgctactgcgcaattctttctctccatccgtgtcgcggctgtgttgtactacgtagacattgcattttacaattgattctcagtacctatctgtcttgctgttcaatttcaagaactgaagaagtcatgttggggaaatcaatgattgacgaagcttctatgataaacagaacaataggggtggggtgatcacggttctaagagttgaaaagggatgcaatggtatacataactgccaatctatagaagttttccattttatatttacacattagaacattggacgtataacagtatatttagatatgcatactgaattaatacaattctttaaacaatctatacaatagcacaaatagtatgctgccctatctatacaatagcacaaataatggtctaaacagagtcttcaatgagctaaggtcctttttatttaggctttttaagccatatttaaaaaagcttaagtccaaataaaccatcactctttttgtttgacttttttaaaaccacaggtcacccttacactgttaaagctaaaaactaagtttgagtagctttttttaaaatgtaaagttaagatatattccaccaataaacttaaagcttaaaaggcacatgtagccaagaagtctaagctcaaacgaaaatggttggagaagattgagaagatacgcaaaatgaggtgagccattagcgcatgattaattaagtataaagtattttaaactttaaaaatagattaatatgattttttaaaacaactttcgtatataatttttttaaaaaatataccgtttaatatttcgagaagcgtgcacgcggaaaacaaaacaaactttctcacaatctccttgggagttaaggccgtgttctttcgaagggtttagaaacactttcagttatgtaaagtgatatattagctcatgattaattaaatagtagataaaaactaaattaataaattaatataatttttaaaacaatatttttacagaatagtttataaaaatattatttaatagcttaggaaatgtgagtgtgaaaaacatgagagtataaggtgtgaaacatgataaaaaaaaacacgaacaaccgtgctccgtgctcactgctccctccctcttgataaggcccatgaaaaagtatctggcccatcaatccatcacgctcttacggcccagagagcccaactccacccctcttcttcctccgctccattctcctcccaccctcccctgcgccatcgccgacgcgcgccgcggcgaacccaccggatcatcttctcgcgcgccgccgaattccctcccgcctccgccgaatccaccggcgggcgcccgatccctcatcctcctcctcctctgctcgtgccgcaggcgcgggcggactccctctttctctctcggtaggcaaccctaaccctcttgatttgcccccaattctggtcgttccgtggaattccaccccatccgatccgtcccaggcgcgcttggggccttggattaggccggaaacggatcggttgctgccgtagggttcctggacgttcgtagggattggattttggtttgttgctcatttcggtgtgggagagtggagtggaggccggagggttgagatcggtgtgctactacttgcgggggcagatctgatagggagaatcgggtggatagtggggattttgtaactttctcgtttgatatcaaggattgtggattggcgtttcctgcattcagagtttactcttcatactacgtggttgatggcgctaatcatgtttctaaattgttaaagagttggatgataacgtttaacttccttgttttactgttaaaatctgcatatgttatggcaccgacttaattatccttaattggactttttaccgttaaaatttgctagtatgttttatggtgtgatgatttacttctaggtttgttattggaagactggtgtaatcaatcttataccgattatttacccctcttgctctctgtgcttactcgttggtttattattataaaagacatataaatgtttggtcacccttggagtcatacatactacatagttttagtgatctagcaccttctgtggattcatccattttgttcaaactacttacacatatcattttctgtttcagattggaaggaatagctgcttactgttgaatattgacttgcttttgttgctgtcacaatgtcgggcctgctgaatgtgcgtgcttatccttacaactgattattgtgctttcgcttgatatccctattttccatttcaaactttttacttgatttctctctgactagtttgttcatcaaatagtttgcttatgctgcagcttcgcgtggataacgagcaatagatttgtcttttatcacctgataaagtgataattgtcctctgttataacatagtgttgatttatttatattttatacacacatttatttcttacaactgcggcactgtcctcttccattctttgccatccttacgtgagttttctgtgttgagatgcttcatatgaaatttgaagcctgacacttccatatgagaactgtgatggcagggaatattagcattgattgcctaaataagctatgcatgtacaggcactgcattatcagctactccctccgtcccataatataaggggcttttgtctatgcaaatgcgtagccacaatcccttatattatgggacagagctaatatatctgtggtggataatctgtttggttgggcactatttattcttttatgctgctgcttaacccaacatggtatttgcttttgaagataatggcaattccatatgacctgctttgttctttgttttgacaacttgccattttttcctagcagtcaaacctgaacaattctgcatcaaatcttcaagactcaactggaagaccgtttacagggtccttttctggtcaatctggatcagttccagggggtttccatcactctggtgagcatatagtaaaatagcttggttagtttgttcgcacaatgctacattcatgtagtaaatcttcttgccatttttcaaggtttgcacaacatgcatggaagtttaaatatgccaaatatgcctggatcgttttctcagaggaatgctgccatgagtggccttccatcctctggggttcaacagcctggagggagcatgcctgggagatttgcttcaaacaaccttccagttggcatgtcccaggttgtaatgacttccttcatccatattgcaattttattgtttatgctgacggcttgtggaaactaaggtacattgttgctggttgaaatgatcgtgtaacctcaccatgttactgttttgttgcagatccctcatggtcattcaggagtcggtagtagaggattgaatgttggtggaggtccagcatttagtagtagcctgaatattggtggtaccattcaaggcttatcctcaaacctgggtgctggtggtagtcgtaattctgttcctgggatgtcagtatctccatctttgggaaatttgggtcctaggatcactggttctgtaggaaatattgtgggtggaagtaacattggaaggaatataagctctggtggttatctgtgccaagcatagcctcacgcatgaatttgagtggcaatgttggcagtggcggtctgaatgtccaaggatc

SEQ ID NO: 78048 - DNA, 1607 bp, Oryza sativa
atgagcaaacaggagaaaagaatgtcaagcctaccctaaagaagctccatatgaaccatgcttgccctaaaatagctcacatgcctatgcatataagagataagatcattaaaaaacagtgttgtatcataatttagtgtcactgtgtgtgcaaaggtcaaaatatactagctgagtatatgatttaaaacagagatagaatcaagatgagaattcctggcgtggtagcaggtgcagaaatcaagagttaaattttgcttaaaatgcgctacacaaagaagataagagatgaaaaggagaaaaagaaaagggcaggcaggtatagcaaatgaatgctaggaaatgaaatgagaatctcagatgttctgaagagacagccagcatacaatccatataacttcatggagcagagccacctaaacaacgtcctccattaatactgtattgcgagcagaacaaaaacatggggtctactgctttaactgtcaagataaacctttttaatctgatggccgacaatgcaaaattggcaattaacttggttggaggaatgacaataggaaatactgcgagtccattttgacaccacatgattgatgccgtatacttattatacgatgaaaaggatggatttatgatgaagaaaaatgctagcaactcttattatgaagagttctggctcagaatttctcccaattatgaagagattgttctgggaagatatttcatagcaaactacgctgtcaaaagatgaaacaaagccaaggtcattttaagcgatgcaccaccactattgacatccttcagaaacatcgacggattgattggcacggaagaataattgcatggacccaggaggaatagtgccactgatgatctatacagggaagaaccatgttgcaagtgacatagaaatcttattcgtgagctatttacaatctgaataaggatatctctgttcgagttgtcccctctttccttaggacacaattttgtgcaaaaagataactgtgtccaactttgaacagtgtctactactgtgcacatctaacatgtgccagccggaagaagcaagccgaagcttatttacattacatttctatttctatagttcccgtccagaggataaggtatatagcatactgttccccgaggaaggcaaacgacagctgatgattccaggatcgaaaatccctgcatcaagaaatggaaacttcagcaccaaaatcatctctggatttttatcagagggaccaataaaacaagggaaaaccatcaactcacattaaacttgctctggaacttccgtgatgaaatttttttcctccgtgtaactcattagattaacaattgaactaggataaactggaatgctgcaaagacatccatatcatagttactccatagaatcttgttctgagtttgccttcctcctgtatcaagggaactggacgtaggaaactttgcatggcttgtgaacctttacttcacattcattgctgcagccatcttcctcaacctttgagatatttctgtgaaggatggtctatctgctggttcactggcccaacagttttccatcagtgatttccattcacgatcacacc

SEQ ID NO: 78049 - DNA, 643 bp, Oryza sativa
tgtgtgcctgttgtctcatttgatctgccatttcagcgcagttattatttttcctatctgcatttaagcaattctattatgtacatgtttgtgcatctgctgtgtgttctcctttcctttaacctctcaccatcttaactatatttagccattgaatggacttggctatgagcctctcaatggcatctcctccctcctcctttcttgctcttttcatttgccacttctctgttctcgtgtgttagttttcatgcacaggaaagactaatgctttggattttggagaaggtgaaggaggaagagacagaggaggcaggatgctgcagcgggcggcgagcaatgcgtattcatggtggtgggcgagccacatccgcaccaagcagtccaaatggcttgatagccatctccaaggtgaccgtccaatatataatcttgatcttttttatcatatatttgatttctgtgagttatgtatgtacttatatgggagatttgttggtttgttcaatcctagaagttcttcaatggggagaataacgaaattattctaagccttccatccatgtgattcttgatatgaggctacagatattcttatttggagtagcacgagatctcacatctctaaattaatacacataac

SEQ ID NO: 78050 - DNA, 704 bp, Oryza sativa
atattttactgctaagggcggcagttgcttaatcctatctgctgggacggcagttgcgtgcaaacgctttattctgaagatgattgtgacaccaaagtgtttgcccaatcttgtgacggtgagtcggtgaccttagcataagattaatcataaaaatcataaggtgttggtggatggtcgaacatatccatccacggtgtggagagaacactactttcaatttggcaatcatagtctccgatagggaccctacactgtaatttactagtttttttttactaacatgtaattaactagtaatagatcgattgtttgtttatctagagatgagtatacataccgatcatgagtggcattgatcgtttgtgctgggtgtcagcaagctgcacggtccttctgtagctgtagcaaatcatctgttctgtgtgtgtggatcggggctggctggtgccagtgtagctagcattaccgatcagacttattgtatctattataattcaactaaattttatttagttaaattagaatgaatgaattgtcagcgggtcgatttgtgttatccctatatttactgacattttgttgtctctcgctgctgtattggctgatccaagtaaaacttttttctttaagaaaaaaacacttcgccaaccttaaatttatgtgtaataatgtaatatagaaaaaaaatgggctgcaggaat

SEQ ID NO: 78051 - DNA, 11224 bp, Oryza sativa
  unsure (1)..(11224): unsure at all n locations
caccgcgaacgggaggcggcgagaagccattgcttgctcctaattaagtacgatttttttcgcttgatcgatcagatcaggcgtgatgtttgtgttacgttcgtatttatacgagctggagtacgagagtttttggctgggaaagtgcgtgccagggctgaaggagtggcgttcatgttcgataatggttggcatttgtttcaaaaaaaaaagattatggttggcatgcatatataactaagcaagataaagtccaagcaagctatatatgcataatttgatttgcgtccatgtctaacatatcaaagccagctagattttgtcgcacgatggattgcgacattttgggcacaatatacgggcacgtcgagcacgttacgtattgccacggccctcatattgcgttgcacataggacatctggaactgggccgcaaataccgtttcggacatttagcaagaagggccaagcgcttcccgttttcacagtttcggtccatctagtatgggctgaacgtccgtctcaatcccgttacggcccatatagtacctcacgttgcagctacggcctgcatactggagtatataataggaaaaagtacatatgagatccctcatcttatcaccgaattataaaattgtctatgtctcaaccaaaaaccaaaaatatatgatatctctcaatttacaaaaccagatcactctgcatccttaggtgattttaaccgcggttttgttcgacgtgacggctcagtatgagacccacatgaacctcacatattagggtgaccacatcatcaccctttctccttcccctcttgtactgagccgatcgcccgatcgaacgactgagaaagggtggacggagcaaattccacctacggccgtgtttagttcccccaaattcctaactttccatcacattacatcacatcgaaaactttcatacacacaaaaaaactaccaattttttctccaaactatcaactttttcccaacttcctaacttttcaccatctaaacacagcctatgtttacaagtttcaagcaactcgatcagccagcgtgcgattttgtcacaggttttatttcgagataaagcacgcacgcgtgcgacgtatataccgtttccacctactgacctacaggtaggtatactgcaggcaggtcggtcagtcagaccgcccgataatgtgttctgaatcttaactagagatgcctaacaaaacagttctatctatcgtcagtacagcaaaggttctcaaatcagccctgtaagcacgccgcaagttcgccatattgacgccaagtcgccaacaaatagctgtctagctactgactacatactttgaattgaacacagcaaattagcatgcatatatgatcgatcagtatacatcaatactactattatatatatatagcatagttgcatagggcaccgtctctggaaaccgagatgatgtagcatctacacaagaacaggactaccattggacaatctcatgctcctagggctaggagtatatttttgaatatgatgagagccatgcataattgcatatagccatatttttttttcacgaacacgcaaaataattgcatgtcaatatattagaagaaaaaaatattttgttacacaatgcaatcagccagaccggcttatgccaaggaaaggaaggaaagcaaaacaaaagctgaagctaggaaaaaactactacggtggctaaacgcaactccgaatagcgggaaggggcagagccacgctacactcacaagaaatcccagaagcggcaatgtcagctaaaaaccacaaatggaccttcgagagcacagagtaaaaactctagagtttcgttcctttcacagctgccaagagaccaggagtaccacatatggctatatctaactatccaagtatatgtatgtattcatgcatagacacggagattgaattaatcacacatatgcatgcattttatttctgtgtatttcacactcacatactatgtataacatcatcgatatgatactaatgctcatacaaaaaacatggcaattaaaccagtagtttaatttaattcacatacatttatatatatgtattaacagaaacgttcaagatcaatcgaaaccgagcgtacatatgcatattatctcatataccaactagctatcaattaacaattggatccatatcactgaatgtaatatatatatgtgtagctagcacccaacaccaaaatctattattgatcataccctagaacgtaatcgccggcgccgcccgaaccgtagtcgcaagacgacgacgtccacgtcgagaacttctcgtcggcgccgatgatggcgctgccgtccgggcactgcagctccggcaacgacgaagggatgatcccgccttgcgctccgccgatcgactcgcacttgaagaggaagtcgtatagctcgtcgtggagaccgtagccggcgacgaacccaccaccacccgccattgacgacgacgaggtcatctctacaccggcgactcccggcatgtagttcgaaccggtcgccgccgcagggtcgaggtgctcggcggcttggaacgcctccgacgtggtggcggcggcggcggcggcggtggcgagggtatggccgccgacgaccaaatgatgggggtgttgcacggtggcgacgacggcgtccgtcggctgcacggccgggagcggtctgctcggcagcagcgcctcgagcttcggccactgcggcggcgcgacgccgacgccgccgccgttgctgctggtggtggtgcagccgaacgcgctgttgtagaggccttggaggcgcatgtggagctggatccgctcgagggccgacgagcttagggcttgatgcggcggcgccgccgccgccgcggtgccgacgccaccgcacatggcggcggcggcgctgcctgctagaccgcagtggtcttggtttgcgcgggcgcggcgcgacggcgcgcgcttgccgaggagcttcttcttcagcttggtgttccagtagttcttgatgtcgttgtccgttctccccggcagctgcgccgcgatgatcgaccacctgtgaatgcaactagcattagcacatctctactaaattatctagattttttagggagattattagtaattagctagagtttttgttttgttttgttttgttttgataattaatagctgaagttattaatagtgcatgccatgttttagtaagtgatgcatgtacgtgttagtctctgagatgaaaggggaaaaagaatgaggaaagtagaagtagatagagaggtgtgtgcatgcagttatgtatgcacatgcgatgagaggacaagttgctaatatggtgattattacctgctaccgatgctaatgtagaggctacaaatgatgtgctcctcttcttctgtgaaatcaccatgcttaatgtttggccgcaggtagttgagccatctgagcctgcaactcttgccacatctcttcagccctacaataatcatatgcaattaatatactttaaattcatttgaattatacagcacccaattgcatcagatcaggagacagaaatgaaatggtctaggatagacaaccattagctagtactgcgctccagtattcagagacaaaaataagaggagaattgaagggctatgcatgcatactactgaagatcaacaaatacaagctagctagaatttaactaataactaagatcaaactacttggcatatcttccagtgtgctagacattaacagactactcaagtttaggttcatgtaattatcatgtgtgcttcaagctgatccctcttaatttatcaggaaaaaaaatcaacttgatcccctttgatctagatctctcactccacgacaaacaaatagggcaatctacaaatggatgatcatgttatagttcaccccttttagatcaaaagtctacataaactttaccttctattagtaaaacagccaatccaccatacaggtgatacaaaagagggaaaatagcatgtattagatgcatctctaaaaaatgttttgctttaatccccaatttagactcaatcacacaacaaaaaccatactactacctatcaaaagctaaacatatggatgattaacttgcactagcaagctagcaaccacctgtcataaccaaggaaattaattgctagcaggataaattagaattcatgaaaacaaacccaatttttgctgggttagcccaagattaggctgaccaaatgttaattgaaataagaagggggctttgtgcgttacaacatctacataaggaagaccaaacagcgcggtcggtgcccagccctagctaataacacacaaatcagccactagagagaagtccagaaacagcaaaatgaattgaagaagcaagagcaaattaagctaggcgaaagaacacaaggtaggagaggagtatatatatatatgcgtgcttaccgatcttctgcggcagcgcgatccagttgccgccggtgccgttctcctcgatgtaggccttgagcttggcgtcctcctccggcgaccacggccctttcttcacgctcgccttgtcgcagcacggcgccctccccatcactaactccttcgaattcttgatttcttgctgctcagctcgatcgtcgtcgccgtcgccgtcgtcgtctatctcagcagaagagagatctagaaccgatggatcgctagtgcctgacgacggcgacgatgtgtagctagctgctgcggctggtggtggtggtggtggtatggtgatggcgtgtttggcagcagcggtgagcgggtgcatctggggttgtggccgggctggctttatagtaggtttagtagatggatagctagagaggaaggaggcaccggacaccgggagaaaaatacgggtgtgggcttgtgagaattgtgaatttgtgaggtgatgatgtgacggttggctccattatagggacaccgccacattattttttgtgtgtgtttgtgtgtgtgtgtgtgttgctggggattaacggacgccgccctaccatgcagtcaagtcagacatgcactcaccaagatcttctctgccaagccaacttttgattattacgctagctgctgctgacatcggttaattaattgatttgcactagttaaccatgaatacttacaggtgtgtgtcctctgaaactgatcttttatcagtatactgcaaatatcaatccattatgtttagcaaaatgcgcatgatctattacaatggtactagagctaagtcatatgactaaatcaacaatagtgcattgatcaacacggtttatactttatgacatgcgcatgcttctcctttttaacatgatcagggttgcttcatttttttttccaataaaacaaaactatcaaaggcaacataggtaaatggattacgttcattgagaaactacgcgtcgacgcatatggacttcattgaagtcatcgggtgcatatacgataaacaacacgcgatgatcctgcaaatacgatgacattagcacactaaaaagaaagtcgttacatattgatatggaacgagatcgcttgcaagtagtattacccactcctaagagtaaaagcatctccaacagcctctctattcctccaagccaaaaatttagcaaatgaaccaaaaacactccttcaatagactctctattcgactctctaagccaaatgcctgtccatctcaacccacgcactggccaatattggccagcctcccagactggctatccttctatccgcctctccctgtatccatgcttctcctctccctctagctctgccgccacaccggctctcaccatccctgctgagctcccccgtatcccctcggttgccttgtcatcgtcaccacctgtgggaggagcatcgtcgccatcgccttttgccgtggccgccatccacagggaggagtgctgccttccccgaccttcctccgcacccaccatcccctaagctgaggagcaccgccgcgaccgccgccgttgacagccaccgccgccagccatggccgccgtcatttgcgtcgtcaccagccatggctgccgtcatttggaggcctatgtcaccatgcaacccctgccggattgggccggccgtgcgacctccagactggcggcgtggatttgaccggtcatcgtcgaggtcgtcgttgccgaggtcgtcatcgcgagccgccgccgccgccatcgccagcctctggatggtcgcagtcgcgcgggatgtgtccgagagaagaggaagagggagagaggaggaagagggagagaaagagaaagaggaggaaggagtagtagaggcagacgtgtgggtcccagtgtcataggctcataatggatagtggctattggagtgagaaatgagtttggcttgccaaatcaattggacagctggctatatgggtgtttggagagaccgatttagaaagactgttagagatgctctaagtaggggcacatatgttagtcagcagtaccgcagatccagtgtcgttgcggacgtcctgtgtccttgttgatatatatgcccacttattcagtgtgcgcaatggatcccagcagagcatgcatgtcgatttggcgtgtgacaaaacccttccaaacgcatgccaatcccctgttccatgcatgcctacctttacccagatccgtttctttctccctgagttcccaaatccgccattgacaattcctccacaaaaccaccacctttttcactgcattcagcagctagcagcctctccctctgtcacctttattagcctcagtgttatgccgggatcatatgagccttcaggagttcagacctaacattcgtggtccctgcaactcttgtcaaagaaaaagctttgcttaattattttgttattatatttaagtagctaatcaagcactgcacagatgtcgtgttggctggactgcccatgaagccacgactttcagggtttcatgtttgaaattctgcctctgtctcaggagttactgtttcaaactagtcattgactataaacatgagcatagttaatggatggtccaagcagatgtgccaaaccgatgaactattagcagatgttctcaagtgcagtaaaccttgctgcgttaaacacgtctactagatgtgcacgtaatgatctcatcaccatcatcatctgttatatatttacctagcttactatgtgattacatatgtagaacttgtgttttctgtatacgtgttgcttcagaattgagacagaagaggttaattttaaatttatctatgtatatatgactgtacattcttttcataaaaaagaacaattaaagctggttgtcaatctggtcgtagaaatcttctcgatcaaacgcgtcactatgcgtggttctgaaacggaaaaaaggccgggctgcctgcccatacgtcaggcatggtgaatccaagttaaggttcagagaatgtaccaagaaaagcagagaaaagctatctagttaaagaacatgcagactgaaagagaagattcagaagaaaagttgagactgaaagaggcaagaactctaagcgaattgaaagaaagaaacgtgtacatgactcggtcatttactgcaggcagctaccaagacatggggatatcaatatgcacatatggttttcttttcttccatcatcaaatttatcaagaattttaatttgcatgcatgcatactgccaacatctatggtctcccagctacagatcaagagctcatgcatattcttttgttttgaccatcttctcccagtcctccatgctgctgttggctgcttgttttcttgtgccacctaactaacttggaaaacttgttcatctattaaatgccatatatttgcctagctatgtggatagtgctactctgctcttctaccctagatgtggcaaaactcaaaaaggggggaaataattaacaataatactttagtatcaaggttagctgcatgtaactatcactgtaattcagtagataatatttacagtgatagtatatacccaacaactctctaactaactatgatcattggacagcgataaaaaataattaaccaacaaccatgcatccaagtgaaggaaatttttgggagataactaacttactatggcaatcaatctcttaaaactgattgagttgaactagctagctcactcactactgtctagacaagtggcacaaatgtccacatccttatttatgcaccatggaagaagctccaaacaggaagctgttgggaattaatggcaaaaggctaccactttacattgcatattgctaatactaaactaataccaatcacaatgccgtgaaattgagccctcacatattgaccttgatgattaatttgcctggtcatcgacgtaaaaattaacaattgattggtcctaacgaagtgtcaagccaccgacaggtggggacaggccaccagagtggagcacattagccccactgtcagtgactcataagacagcgatggtaaaactagatggatgcaatagagccaccacctttttctcaaaaggcaatccaagttaatcctgatcaagtccacaggatagactttattaacctaaagcaagatggcttaaaatatgcaacccttcataagctagcaaggagaaaggatggaaggagtcatttggtattttcctgcttgtcacttcctacaaggtcatattcccaaaggccattgcctgtcatcagcaacatgaacagttttaaattttggccaaaggaaaagagatgagccccagggaagaaaaagttgggaaaaggggggaggaaaggcagtgggaataactggatatctttgctgagcctcattggagtttagcatttgatcgcatgcatagtacttgaccttagaggctgtaccccaaaacaaagtacaagagacgctatgaatgcatataataaggtaatcagtaaagtggtaatgaaagtggggatatggtctaatttgtgccacaatggtgagagatttttcaagctggctcgatcaatcactcgatccacggtgacgcaattcaagtaatgaattccatcagattcgaagatagagctatattatatccatcagcggtgcgatcgttcaacacattctgtgtcatatagggatattacggttccttcacgtaaccgtaaattagatggtcaagataaaaagaccttgcaatatcgtcatttacgcggactgaaaattttttgcgttcatcctggctccgagtcggtcgcacggcacaacaaatagacgataaaaaaccttgggtgtgtttagttcacgtcaaaattgaaagtttggttgaaattggaacgatgtgacggaaaagttggaagtttgtgtgtgtaggaaagttttgatgtgatggaaaagttgaaagtttgaataaaaactttggaactaaactccgccctcatctaggaacaaaacctcacagcacctataccatccatgtcctatcaatcaattgtccataaccgatctgaatgttttttggttgctaccacatgcctacaatgtccacttcacattggctgatcatacatccccgacaaatgaatgacaggagattggactgcacatcaatccagacaccaatctgtcgtcagggccggttcaatttcccctccattttcacctcttatcattggcaaatgatggcaaattggcaagctgctctgctccctgccatttcactgtctgcacatagtgaccaagttcatcaaccaaagatatcggttaacgcaagaaaaacaaagaaagttagttagtgagtgagagtctcatggatatcttattcattgcttcagcttgaagcacgcatgacacatctgttttgactagtagcaatcactgtttcttcctatcaaacttgttgcttgcacaaatctctatcagttgtggtactgaaaaacagggtgcctcatctctgtgtattcagtattaaaatccttttcagtttatttgcattttattactgtgtcagctctgcaaacctattggcgatgctgtaagctcgctgacgtcagccctgaattgtggaagttgtaactgtcatttgacatgtcttgatcagttcttctactactagtatgaattttgcatggacaggcaagttgttaattagtggcaattgtttcttgcatttatggatgacaacctagctagatagctagagaaaaaaaaggagattaatcagttgcatgtgtcagtgatgaaaccgtgctggtcctgctggagaaatctcagttggagagattcccctcgttgcgttgctaggacagagggatttgattaaattgataagaacaggagaagaaaaaaggttggggctctagcttgttgccatcgtgtcaaattctgccttttcagatacaaccaacggccaaggccaacacatgccccaatattgaattccaggttttctgaacttcagagaggattaggatgtcgcaaagcaggcaggattcaagaactcagtatctttcagcatttgaaatttcaggcctcaggttcaagttagttaccgccaaatcgaaaaccggaaatcttggagctgacacgaaacacctctgaaattgtaaactttttaagacatttgcaaaggagatttgtgataccctggacctgaatagctgatatacagttcagtttagattttagtatactgacgagccatttgcaaagaacaacatggaaatccttagctgacaaagaatgcattttccaccacaaaccattattgataaactggctaggaacttgccaaccttctggagctattctaattttgggatctaaaaccccctagatccatgatgactcatgaaatcagaatgtcttgtactgaaggtaagcaagcctcgtctctttggagctgtcatttctatcagtttaatagtgcatatgcagcgcataacgactgccatggatagcaaggccactcattctccagacatttntntgcctacatttattccgagccatgatttcacttgctttacacctggcaaacgcaggcaaaaatcacaataaacgcacaccaaaaggaaacaagtaagcactatttaaattgcaatcaatcaactgcattgtcaattaattgtgaccccgcatgaaccctagctagattagagctaggtggtgtgtctgaaggaggaggagaagaagccaa

SEQ ID NO: 78052 - DNA, 670 bp, Oryza sativa
acgaagaagatagatgctgtgaaacatgacaaatcaagcttacaagttccaaccctgactccatcataagtccatatgacataatataatagaagtggtgcatacattcgacatcaaaactacgagaacttccaggggttctcagggaacagcagttcacttgcaaactcaacatgaatccggttcctttcaaaacattttcagccaaaattaaaatctaaaaaagataaccaccatcctccacacttcaaaagtctgcattggatgagaaactgttattaatttatcaaacaaaagacagcagcaatttggaaattgcacagccatttatgcttcacaatatatgcacaaaaattacaattagagaaacaacaaacagtactagaatgtttcagtaggatgccaaactgatagtttaacaaaaagacactctgttggtaaatcaaatactcggttctttatactaaataggatatgaagacgcgattgcattaagataaatttagcatgcaaccttgtgacaaacatggctgggaaacttttttacattgtaagtaaatgtgataaaaattcctcagatgtcaatcatttgtgtacataacgattacactacaaggacccaatatcatgccaatttagtatctgcagttcaatagccatagcaggttcc

SEQ ID NO: 78053 - DNA, 40442 bp, Oryza sativa
ctgaactatgacggcgtttcttggttttgaatttgtatgttggaagaaaattgatggattctgaggtaccccctcttgtattgtttgtatcttctctaaatcccataacaaatatgatgcagggcaggcagcagcatatcattgcacagaggatgaagggcatggcatacccaatacaactaaaggtaaggaacacaatacataacctggcagggaaaaaagtcagcaacaagatcaagggagcatcttatccacacaaaaaatatttgtatttacctgtacaagtttggagcatcggcgggagaagaacgcccgccaaatatccacacatttcctacgacaaaccacacagcaaagaaacaatccaaggccatcttgaagtggtcaaaaagagcattaatcctgaaaaggcatttgcctttaaatagcaacattgtgaacatgtgtaaataacaatctaaacaatagtgttccttgcaatgctcatacacagatgcttcagacatgcactaaaacatatctagcctagttgatatcttgtaacattttcctaggccaacaacacgactcggaaagcctagccatagaactaaagaggaattccttatatacaggcaagatctcacaatagcaattttaatgcaaaagatgcacaacaaagtaccttggattagcgagcactgcatttcgtgcagcattccttcgacgctctgatgcactagcagaaggctcagttgaattgttctgagaggagccttgaagtgtatgtgctggctcattttcaccattgacaatattgcggtgtatatagcgccaataaagatggggtagtgtagcaaaacaaccaactgtataacctatgacccactcaaataatggagcttgcggatgttcctttcttgaaagagaaagcacaacaatagcagctacaatttggctcacattgacaagaacttctattgaaatccagagtccagaattcaaagggcttctgtgccggcgaacatagttatcacttcttctagcacctgaagtatgtcctgcactaggtgcaccaactgctgatggtgcctgcaaagcaggtactagcgctctggttgcagatctatcaacaggatttggttctccatggttttctctagcaacactatgggaagtcgaagtagatggaccactgtcccttggaatatcaattatgtgctcatggccactaacacctgtagtttgttccatcctcgaagcgtgcatatcggtatgaccttgaatttcaagtaacgttgaaggctgaggtcatcaattcttagatgcaacaaagaaagaagcaagctgctaaatttctgagacctccagttttctcaaaactgagtgcaggaattatctacgattctacgcttcagcagagacttccagcttcaagtgaacatttagatttatatcacaaagagagctattctgcaagagaacacagtaaaaaaaacatcaatttcgcacatagaaggaaaataaattttcaaataaacattaagacgactagaaatgaacatagaaattattgcaaagctgctgaacacggaaatgaagaaagcaggtaatctgtatgttcaacaagttgaaattatgatgcattttaaaggtgatcaaacatcacaaacctgtccccgtttatgtaatcatggggctttggacattgtttttgcccttttcagaatactaacacgcgtaaaagaaacagcagtggatattaaagcatacctacctcctctcaagcataataatatccatacagtacatagatggacaggtcacaacgcatagaagaaaaataataaactttgacagaacatgtatgcgcagtatgcaggtttgcctaatttagtaatatttaagtttgtctaaattataaagtgtagagaccaccatgcaggcaaagctagcagctgtctattcacacatgtttccactttctgggttatacctgattaacagcaaaccacagctgacacacaactttaccaggtgaaagttataccaaagtataaaaaacaggctaggctaaattaggaaccagaacatagagtgtaaaatcaggatgcaaggttcaatacaatacatgtgttgtattgtatcttatcatagcacgtaagaacatatcccacagtttagactctagagatgcaataggtggaatattcaacagatctgaaggcctgatgtcaaaatcaacactacaataaccacagcacggtacatcatatagaaacaatatcattcacctctcataggatccaatgatccataatgaccaaggtcattcatagccaatgtttggaaaaacatgccttaaattaataccaaaggcgtttggcaggcaaagaacaggacatcactcgtagtatggatatgcaaaacaagcatgatagcaccaagggtaagatatatcagtgaagagagaagaagcaccaaagtttgtaaaagtataatagcattcagagaagggagagtaaactaatccaccctactgaaaacacattgcagtatgacacaacctgacctaacacattcagataccaggctgaggtttgcatccagttcctgaaagaccaaaatccaagtcctgatctatttttaccagtactgaaacaaccaaactgggattatatcacaaaacaccactaccaacaaaatttgacaccaagtttaggcaatccatatccgtacacacgcacattatttctctcttttccaaggaattttcagcaattcacattccaaagaacccttactttctcaccgttggtgttgtaatgaaggccaacaatagtcaaaacggacaactcctaattgatgaatgcatagaaaatatatattgattttacagaatagtgtttgtcattaccacttaaaccctgaaaactaagacataacagtatgcataaaaccaaaaaccggatgaagttcccctaacatgaacaaaccacagatcgatcccctaacaagcacagccacaaaaagtcattcccccctactatctaggtcccactttcacatgatattgaggcattgcgcaaaagcacatttgggaatattaccgtaaacgtgagttgtgctacatttaaggtaaaaattcagagcaatcgcagatctggcgaatccaaaccatatataaacacacgaacccactcaggtcagccgatccgcgtaagcaaatatcacagtcgaaaggatttggggcgcagatatttaccacggacttagagcaacaccgtggagggtagatcggtggcccgacagctgagattccccctaggcacgactcccaactccgccggatgggagggtacccgcgcccgtggcagaggacacggcgagcgggaggcagtggcgacgagggagccgcgcgcatgggcggcgcacaaccctaaccttaccgagtcgtcgccagatgcacagagaggagggtagctcgcgctcgcgcgcgcgcgcgaggcgcgacgcgggagcggcgcccgcacggtagacgacggcgcggccgaggcgcgccgagctccgctgcctgcgccgcggcggcgacggcggcggcggcggcaaggtgaggtgggcggaaaagcggaaaggccgagagggagaaaaagggttggggggtggggttggttggtgacgaggtgagcaacgaaggggtcttcaccctctcgcgattggccgattggggatcgcttcgtcctcccgcaaagcagtgggggatatggggagacggaatatgggccgggtcgggccggatccgcgaccgtgactgaaaacgagccccctgaaccacccaccacacgaggttcacccaccaaccaccgtatggtccacattgcctcttcgcaggcccatctttctcctcggcccaaccaattacacggcccatctacacttgcttcacgacgtgttgcacgagttcttccgtaaggaacaagggcctgttcactttgatgccaaaataaatcttaccaaattttggtaaggcatagttgccgaaattttggcaacttgccaaaattttagcaggatttcttatatagttaccaaaatttggcagcaaactaaatatagccacttttttggcaactttaccaaaatttgataaggttgaaaatggcatcaaagtgaacaagccctaagttctcgttttatcgctcaatttgaaattcatccctaaaccacaatactactagatataacttgtctctcagcttaaaaatcgggtcacatttggtcccaatgcaatattcctctcagttttggctgacgtggcagctagtattacgggacgaatttcaaattcagcgacaaattgagggacctaaagtgaacttattcctttcaggaatgctcgtcttgtctatctcctcggcccaacaaattacacggcccatctttatactacacttgcttcacaacgtgttgcacgagctcttcagtaatgctcgtcttggatgtgatcacgaattttaccctgctcgagtgccctgttccattcaatttcggggacagtttggtcacggttttcacgtgctctagattacaggatagtaatacttctccgtaacacttttcgagctggcatgacctgcacttacagcattctgcagaaacaagtggaatacctgttaaattcagtgtatcatctgcaggattgcaggaactcttgtcagctgtagtattacagcatcactgtatcagtgtcgtttggccttgcaggcaacagcagcagagcagaagaagagacctgtcggatgatgcccatagcgaaaaccaccgagcttcctgcggttttcatggctaagctgtttaacttggttcattgaacacctttgtttagcttggcttttgtccattcatttgctgttttcgccaacagcttgtacctaaaaggcaggacaccaacaggttagatgcaggcgacatgtttgagacagatgctgcatcggagacgaagtccggctggatttgttcgctcatgttgggacactaggacatatactctactccacttatgcagacgcaagggccatatgctcaacgaagcttttgacgcgttggcctagtagtagaagagggccccctggcccagcacatagagcctgtcgcatcagccagggctggcatgaaaatggaattaccctgcatctttagcgtcattatctactggagtactatctcccagaccagtagaattcagctcgtgctcattgcgttttttagttcactgaactcgcctgacccgtaaaattccgctcgtgctctttgcgttattggagtttactgaactcgcctgatgacccgtagaattccgctcgtgctcattgcaatttggagttcactggactcccctgatgctactttcctcgtgcctggaattcaatgcattcatcagaatttgttgattccacgatcgagccgtgcagacaagagagcatgcataacgattattcccacgtgatgttgttcggtttactcagctgggagtagtagtaccgtctggtagtgcagctctgattctttttgctttttttttagaaatatattacatacaccataattacaacgtacgcatacccacccatatatcgacgaacaagtcatttatcacttaaaggataactaaacctatgcatacccacccatatatcgacgaacgagtcatttatcacttaaaggataactaaaccaatacgcaaacatccatattaagtttaagacttgaatcgggataaacacgtccatttgaatgaacccaaataattgaaccatgctggagatggattctaatagctcgagtgaatgtccacctgtttattgcatgtcaactagatggttgcaaaaaattttttaaaaaaattgacaagatagatcaatatgtaatatatcactctacaaacatgcaagttaaaattctacttgtacaagtcgtaacaaaaataacaaatttaagtgtaaatatacatatagtaatttgagttttgtttgttattttttgttacaatatgtagaagttgaattttaacttgcatgtttgtggattgatacattacatattgatctatcttattcatattttttcaatttttttcataaccatttagataacatgcaataaatgggtggacatccactcgagctgttaaaacagtttccaaccatgctccctatacgtatacgtatatatcagcatgcagttccattcgctgaaccttgccgacaacgattcctcactatctggcaccccatcctgcccagttccccatcaatccccgtccggcagcaagtgtgacaaggcaacaaaacgagctgccattttccgtacctggatacatacatgcacgctggcgacggacggacggtacgttcggacaggttatcggcacgtcgactgatcccggagaaagacggcgccaaaaggttgcgtactagcgtcaaggagcgttggaaacgtgacagccgaaacagccgtggatcgcaggcaacaaacagtgagtaagccatccatccagccagacgacaccggtgtccgttttattgcgagcattgaatccgaaaaggtgcctgcctcccggccgataaacagatagaagcgcgcgtgtacgtcgtcgtcgctggttccgctatcccgccaccgtgcgctgcgtgacgccgtcgccgtctctcgtgtttcgccacgagcccaacaaaaaaaaaaacaacggtctaatttagttcctaactttttctttaaacttttaatttttttatcacattaaagctttcctacacatcatataaactttaaacttttttattatattatttaaatttcaattaaactttcatttcaattttagagtgaaaacacacccaatattgctagccgcagcgcgcgcgcgtggccacaacccccatccgggcgggaaacgtgcccctgctgacgctgatggggcatcgcggccggtgtctcgcgcgcgggccggcctttcggctttcgctgccgccgcgaaaacgatcgacggccggggcgcacggcgcacgacgacgcgtaggtccgcgcgcgtttccgcagccggttgcaaccctgcagcgtgcagctagccatgcaccgctcgttcgccatgacacggtgtgtgctgtcaagcgtcgcgcgattgcggattcgccgagcggcaaccggtgaccgtgatgcgcacctgccttagctagctagcgttaaatgcttcgagaatctttggccctgagaataaaagctctctaaaaatagttcagcttttgatcaagattctaaaaaattataattataaaaaattataattatagaatctagaaaataaattagaagcaataagttgggaaacccacttttttcagattctcaaaaaccggctttcaaagccagccagccagcttcttcctaaaatcttaagcttcctaaacggctcctttatctgctcctacagcaatgagtgctttactacaggaccattctaaatgtagacctatacagatgcggtgctccttctgccgtgcttcctccgactttcttggagatggaagaaggtgccgtgctgctacacgctggatcgatgtagtacatatacaaaagcaatggataggattgatcaatccgtaactgctcctgtatgtcgagaggaggagaagaagattactgttactgctggtagtgtggtgtagtatgtggtatagatgacgcacccgtgatgacagcctcggggccttcatcactcatccacgtcggcacgaaaaccttttttcgatcccactagctggaattatgaccatgacagttacatctacgttgctttcttgttgttttcttccacaatgtcaaatgtgaagctgcaaagaaaaatggcacgcgctgaggaaaggataaaagaaagcaatgttccctttttccttcagggcagcatggaaagcgagctcttcaatctggagatttttagcgttttttcaactatggtgggtccttcaaaaattgtgaatctaatctcccaaaaaaaacaagtgatgaatcaggtaggggagttcattgacatcgaaagatatgcataatttacatatgccgaaagcgatccatttccctgccactaaccaatagaattgaagatcttatcagctccaaaagcaagtaccagatctttgtttatagcccattttatccattagctcgagtagcaccatgagctaacaacattcttgtatgccagatgaaatgccactcgcacagaagcaccgttggcaattgcaaatcatatttttggctgctctgtggtgtaggtttcatgtgaaaagatgaccatatattgcccagaagtcactggtttggtatttggatttaatttctgccgttggttttgctccaagccggccgcgtgctagtacatactgactgacttccataggagattcccacactgttgtatttttacagaagctgaagctgattcaattgaattaggctgtgttccttccaaagttgaaagtttgggttgaaattggtacgatgtgactgaaaagttgtatgtgtatgacaggttgatgtgataaaaaatttagaagtttggatctaaaaacagccctagtaggtcgatctcatcttcatgacttcatgacatctgcgcccatatgccctttttaactacaattttttttcaactgcatttttgtttttcccagagggtaaatagaacgttttcagggcaataaatcagaagaaacaaaagatgatataaatagctacatatgttcattcccctccaggatccaattctcagtttgcctggcacggattggctgatatgagttgaagttgataagatcgggtcaaaaaaatcccaagcttactaggctaggcacacggatttttatacgtacttgagctaacatcaaaccaagcagtgatggtatggccagattacatcacctcatggccacttgattaggggcaataaccatgaaaacccatatacaagttggaggcaattaattagagaaaagcgagagaatcgctagccctgtttatttttaaagcacctttgccgctgcatctatgcaaatgatctacagaagcatcagtgtgttggccttacataaaaaaaaaatactccatatctttctgaaggaaatatgcaaattctttcttttttggaacaacaaattctccatatcttgtgggacagaccggcgccattgttgatgactccagcagtagtaagtcatgatccatcgctgcatcatttggagcccacatatatactcgggaatcccaatcagtcgtggcctcgagctctctttcggccgtgatcatgaagccggtgatcagttcatgctcatgtccacatctcatctcattccaccaccagccaaaaaagaaatagaaaatctctctatttttggattttgccggtattatactagtactagtcaacgaacttgttgaccacaggatgtgtttcgttttgtggaggagatggttaatggaccatctaatcgatctgaactccagatatgagatcttgtttggttttgattgaatggttggtccatcaacatctcctgctctaaacgtacattggtgtattgttacttatttgttaatggaaaataaacaatgacgccgtgctgccaaaatcaagggatgatctcatctactgatagaccattccacccttacacattgagatgactagtagtgaactagtgataactcaaattaaacacaccataaatatagatatgttcttattaactactccatttgtctcaaaatagatttattttttatccattccacatataccaataaaaaaactagagtacactcactttatcaaatctgaatacaattattacttttttatctactcttggtgctctcatgctttcataaactttgatgtagtgaatactcaaatgtgaacttattttggacaaattaaaggaaccaaaaaataaatttattatgagacgagtgagtactactggacgagactttcagctcattgtttgttgtatgggtgaattttttcagtactttaagcgagctgaaaaaaaaactgtgataaaaactcagaattaaaatttaaatcgcgactgatacaccaaatgcaaaatgttggagctgtattacattaccgagggcctgtttggcatagctccagctccagttccactcctcctggagctggagctcggccaaacagtttcaactccaccaaaactgggagtggagttgggtggaactctatcacaaaatgaactagagttgtggagctgggtttaggcagctccacaactccactccagacctaactcctcgagctaaatttaggagttggagctgtaccaaaccggccctgaatatcaatcggatccaaggatctttggccgtccaatccattgagcgtttcgccccttactcctagtaccataccatgggtgtgtttagttcacgctaaaattagaaatttggttgaaattggaacgatgtgacagaaaagttgaaagtttatgtgtgtaggaaatattagatgtgatagaaaagttgaaagtttgaagaaaaaatttgatactaaggccccctttgaattggagggaaaatggaggaaaaacaaaggaattgaaatcctacactattcatgcctttgattcgtaggaatgagaaaaggaaaaatgtaggaaacttttctattcctacaattctagagcaaaaacgtaggaaatttaacatccactctaacctcttggaaaactttcccagagtctatctctctcatttaattcctgcatttttcctgtggtctaatcaaacggtcattcctatatttttcctgtgttttgcaatcctctgtttttacacttgcattcctaccaaaatcctgtgtttttcctattcctccgttttttcaatcctacgattcaaaggggccctaaaccatgttaggcaggcagttaggtaggtgagtaactaacggtgacacgacctcgtcagctttgaaacgttcacgcatatccgtgcagagccaaagtgcgtggacgcgccacgtaagcctaagccccccctccccgacccggtcgccgctgcttcctgccggcttccgcgcggccaaccaaacccaacccgaccggtcgcgcgccgcgtttcggcgaagcccccgacgaagcagccgcgcaacccctgcaatgcatctcattctcgccgaagggaccgatcgatgcgaggcgatgcccaacggatcggaccgggacgacccggtcgggtccatccgggacgcctgcctgccacgtcgacccggcaaagccagcgttgactcccaccagcgagagagaaaagaaaacgagcgtgacgtggcaggtcctgcgcgacacgctggcgttgacatggagcttaccggatcgccgtgatgttgtcgtcggccaacttctaggaaacaagttaaattgacttgtagatgttgtattactccctccgtttctaaatatttaacgctgttgatttttttaaatatgtttgactgtttgtcttatttaaaaaatttaagtaattattaattcttttcatatcatttgtttattgttaaatatacttatatgtatacgtatatttttacatatttcacaaaagtttttaaataagacgaacagtcaaacatgtgctaaaaagtcaacggtgttaaatatttagaaacagagggagtagtaattaactaactgaagtaggagtaggatatttttgcacatgtcaaaatcaacgtatgaactccaatctccaccaggaatgcagtagcagtactcgtgtagtagcgtggggtattagcagacctatcctttcacagcatatttacaaacgaaaaataatttgtaaataaaacttttttatatgtgtgtttttgatgatctaaaagcaactgaaaaataaactttgatgagaaaacctaaaattaactctaaatttaagataaaaaattaaattttagctgataagtgtaagtataagcgaaaaaacgagacgacaatatcgttagattagataggggtaaagtaaaagttgctgcgaatcctgacctgatcaagtcaggggttcattgatctcttctcacttctcagcaacaaagcttacacacgcatcgcacgttggaagaacagcccaaaacattcgcgatagacagacagtaacctcgcttgaatagtgagcactcgcgctgtctccttctgtgatcgccactagctctagttgacggtttgcgagcgtgaaacgcaacgcagagaggagaaacgaggcaaaattggcggacggatgagcgaggaagaggacgcgattggaggcgttgtttggttgtggcgtcgcgcgcgtatggcgtagcgtggcagcagccgtcccatcaatcacccgtcgtccatctctcgctgcctccttttccggacccgagagagaatccgacgagtacgagaggcagcagccgccagccgcgctgctcgcgttggttgtaccccttcagtttgcccccacgcatcactccacctgcactacctcctgctcctcgttttgtctttcgctttccttgtttcatctactcctatcctttttttccctcttggttttacactctatgacacgtcatcttggagtacggagtacttcacactatgctcagcgttcgtttgaaaaaattgtttcgtttttccacgaatatttttcaaactgtcaaagccatgtgtattgcataaaatatagaagcattgtttaaaagatcatgataatctattatttttaaatttaaaataattaatattcaatcaattatacaaggtgctcgtatttacggttaattttttttattgctagataatatatccataaaaaacactggaacttatatttgctagtcttctagtagatgtatttataagataggtgcggtgtgcgggtgtgttcttaagagtaagtgtgtgagcgtctatgtttgtatcatgttttaaagaaagaaaatcatatgctaaaaacttatctcgttttaagtatttttcatgattttttttctcaaatatacccctaaaggtaggaatagtataatttccgggggtgctcgttatacggtgtggcgatggtataattcccgaacccagtaataaaaccgctggatgtgaatcccgaggcggtgctccagaggccgaaatccacgtgccacatgagacgatatttattgcccccctgtgaatctcgatgcaattggcagggggccggcagagggcgttggtgagcgtaatttttgagccgtttgtttacggcgcgctctcacgttgttcatcgcgctgtgaatcggagcatcgaaatccccaagtagccccctcctcctcggctgccacgcaaaaacaaacccacacgccgtacattcgctgccacgcaagctggcaagaattttagcggggcccacctgctgacactggcgtgtgggcccgaggatcagggcgactgcgcgcggctgtcagtgaccctgtgcgtcgcagactcgcaggggagaaaccgcgacggcgaagtggtgttgttgctgtcctcctgcggcacgcctgactaggaacaatcattagcttaaccaacaagatttgttaattaccagtgttgattcaaacatgttttttttgaagattttgattcaaacatgtctcaaacatgcttaactctcattttagctgttttgcgttgtttaatttgaggctaaacatgtttctttttgtctatttttaggggaggggaaacatgtttcgacatggcattttagtaccaaactagggctaactggaaccaaggttcgtaattccgatagattattttagttagttttcatacaaagttgatggaaagtcatcgatttttttcctttggttttggtaaattgataggaccgaatttcaccttgaaaacggtaatgtaagccatgattcgagccataataaattcatgtaatgttttgtagtgaagaaatttaattagatcataaatttgtcactaaaatgtttatcgagtagtatgtgtttaaagctgcatgctcaccgcctcgtggataaccaagtgtattaagtgtgtggtgcatattcgtctttcatatgataaaggacaaatatgtaacgaaaacgctgataatttaaaattcaattgggatttacaacaactgatgcaccaatgtgatactgcaaattatttcctctggccggtgatcaacggccaaaaagctctcatgagagcaagtctagtagtacagcccactactagctccaattcatctataaccaatttatacaataattgcttactatactataaatatatggtcccacctgtcatacacacagtgtgtcttggagcccgctgctcttctctcttatcgtttatatcattaaaatatatttatagttgtctaatagcctgctattatacctgctctaatagtgggttcagtagctaactactgtacgtttaattatttcctggtgtttttatacacccaaatctagctggtggattctgtttacactcagcttttctaattaatttccctgtatagtactcttatctggactggtttccttatcgtgtgttttcaaatatgaagacattagaaatggatttgaccaattgaactaggtagtagaaaccgttaagcctaacaaccatgatgatcatataaaaattctggaagatcaccggtggcttctcaaatcaaatgctctgccttccagttctataatctaatacccacctgatatgcatggcatgtgaacaagagggcataggtggttacacttacattttaatctgtttgtttttttttcaagaaatcaacaatcgaatcatgcatggacaccacttgcttatctagaaggctggaagttagacacggaaatattttctaactaaaacagcccagtacatcaacttaggtgtaactctttttaaactgctggggcatgaaagcagagcattagaactttcatcctaattatggtggaatttactcacatttttatcttctaatagtaagaattgttggattctcaaattagctataaaattattaacaggaaataagtatgataggaagaataccttttataaatgcacataaacatgtatgcatttttctaattcaaaccaacatttcaattttgcattctaggtgatgttatcttatgacaccggacacgagctaaatcatgattttcaagggctagtcataataaaaccaacacagaggcaccatggcaaataagaccaataaatgttacaccgttaataatgtgtcgtagccgttttcagagtgtttttatatgatagtagtgtatttaataactacacgtatactttctcatgacgctatgtttaaaagttggcgccaatcgcaactaaaagtaacctcacccaattatctattaacttattaaaggaatagaaaaaggatcatccacgttcgctctcacggcctagaaattcttacattaattgaagaaaaaagaaaaacagagtccatatagaaatacaatttagaaatagttgaaattcgaaattaaaaaaataaggaatattggaagaggagactagagtccatatataaatacaatttataaataactgaaattcggaattaaaaaattaagagtattagaagaatagtatagagtccatactattaagaaataatagaaaatcagaattaaaaataaggaatattagaaatagagtatagagtccatatagaaatacaattaagaaattatagaaattcaaaattaaaaataaggaatattaatagagtccatatagaaatttaaaactaactattcagaataaacataatagaattaaaagtagagtttagagttcgtataaaaatacaatttacaaataactaaaatttaaaattaaaaaaacatgggaagaagaatataaagtcaatatatgaatataatttagaagtaactgaaattcgaaattaaaaattaaagaatattgaaagatgagtttagagtccacatagaaatacaattagaaataatagaaattcagaattaaaaataaataatattagaagaagtgcctagagtctatatagaaatacaattcacagagaacaaaaattcagaataaaagaaaataaaatattgaaagacgagtctagagtccgtataggaatataatttacaaattactacaatttgatataaaaaataattaataactaacatgtatataaaatacaatataaatattacacattagtagtttcgtaaagttagtacaaaatttaaaattatgttgttattttaatatattagattgagaaaacatacatgctattatataggagaaaatataatgatgctagccgcgtaatctgcgtaggaatcctgctagttttttttacaccaaaaagaaaatttaccgaggtccacaaaacgttgaactatcacttggaacacggcaatacgaaacacaacaaaaactgactcgtctgatttgtaaaaccagagagaaaagaaaaagggggaaaaggaagttataattttcttgccacccccatcacggcttcacttggcctcgtctataaaaaaacactcctctgtctcgaatccttcttcctctccctgcccccgatcggcctcgtcctctccacgccgcgagcccaccagaaaacgcacacgccgacgcgagccaatcaacccgccgcgccgcgcctcgccgccgtcgcgatgcgaccgggcgggccgccgagcttgcgggcggggctgcagcagcagcagcagcagcagccggggacgccggggaggtcgcggcgccggccggatctcacgctgccgctgccgcagcgggacctcacgtcgctcgcggtgccgctgccgctgccgctgccgccgtcgtcggcgccgtcgtcgacgtcgtcgtccgggtcgtcctcgctcggcggcgtgcccaccccgccgaattcggtcggctccgcgccgccggccccgccgccgctgtcggagctggagcgcgtccgccgcatcgggaacggcgcgggcgggacggtgtggatggtccggcaccgccccacggggcggccgtacgcgctcaaggtgctttacgggaaccacgacgacgccgtgcggcggcagatcacgggcgagatcgggatcctccgcacgccgagcacccggccgtcgtgcggtgcccggcatgtacgagcaggccggcgagctccagatcctggttgagtacatggacgggggatccctcgagggccgccgcattgcctccgaggccttcctcgccgacgtcgcgcgccaggtgctttccgggattgcctacctccaccgccgccacattgtccaccgggacatcaagccatccaacctcctcatcgactccggccgccgcgtcaagatcgccgacttcggcgtcggccgcatcctcaaccagaccatggacccctgcaactcctccgtcgggaccatcgcctacatgagccccgagcgcatcaacaccgacctcaacgacggcgcctacgacggctacgccggcgacatctggagcttcggcctgagcattctcgagttctacatgggcaggttccccctcggggagaatctcggcaagcagggagactgggccgccctcatgtgcgcgatttgctactccgactcgccggcgccgccgcccaacgcctcgccggagttcaagagcttcatcagctgctgcctccagaagaacccggcgcggcggccatcggcggcgcagcttctccaacatcggttcgtcgccgggccacagcagcagcagcagccgcagccgcagcccctcgcaccgcctccgtcatgatgaattccgatgggattccggcgttgatccggctcggccatggatggacggtggtttggcattgagacgtgggatctaggagtgctcttcctagccattttgggtattcaagccaccaccacaatttagtgatttaccctcatcatcatcccctctcttgtcgctgttgctcctggaattaagctcctctcctctcctccccttcccctcctcaacttttctttaatctcttcttcttcttttttttcttcttcttcttccaattaagttcatgttcttccaaatgatcatcatataatatgggttgttaagaaagcaatttcttcttaattaatttattttctaaaatcatcattggagcagtagaagtagtagtagtagtaggtggtggtgtccatctgctccagttgcaggaggaggaggagaagatggtgacaaaacaacattgtgatgctttgctgtgctggcttcttggattctgcaaattgtggggggtggattggattggattggatggatcatgaatggttggagcaagcaaatcttgaaatgggaaccaaatcaactttattttttcctcctcctcttcctgaatcctgatcctttctctctggtggttttgaggggagaatgatcgaatgaaatcatgaattgctctctttattctttgtctcactttgctaccagtagtagtatattgcttctgaacctgtgcttttcttctcttctccttttccctttcccagttcattatttttggggcccctgtagggatggcactactactactttgcatgcatcgatagatttgggtcatttttttttagcgtgacatccttaattttcacgtagtaaaaggaaagcatgaaaaagaacaagaagaacaggggacgcagccgcgaagggccctctgcttctgttgtgcagagagtgacaattgcttgcaaatggatagatttgtaggtcggcgaaaggggctgtacataggaaaagcgatgatgagatggtatgagatgagatgagagcaagagagagaagaaccaaccaagagggtgtcgcctccatcaatgtggtgatgctgtacgcaggccgtcctgtgctgacatgtgggcccgaatgggctgcttgcttcgtggaggtgtatgaattgagtttgtgaacagtgtgcatctacaataaatagacacggccttctcatgtgtgtgtgtatgagctgacttatgatgatgatgcagtgcacttgcagcaaagagtacaatgcgccccagctgagaggaacaattcaactgtgatttctaatgcaagattttatctagtataactttataaattacttctttcgttctaaaaagtttatctgttagttaaaaatgaaccagcatgatacaaaagaaagagaggagtgtgaattactcatcctcctatgtcctatcttagtagtaggttaaaaagggtgtttaattatctctcccagtgtacatgaacatgatgatgagtacttcgtcgtaccacgtatggttgcatgcgcagtactcctctgcttataatgcgtgatgcggtatgtcttgcgtgatgcattattggtgtagttaagatggcacgagatgtcaatgtttcgtccacagattacctacgggaagtacatccagagcactcatttatattcgttttgttacttttctagaagccctgcttatgattcatgagtactccagtagtccagtagtactagtaaacatggttgtgaatatcacatctcaagaatatactccagtgacttggagggggacgttgattacaaggccattcccgactcaatgactaggattgtgtctatagcattaaataaggtgatacctaggatgaaaaatgatgtggcatgtaaataaatgagaaaagagaaggaaaccatgtcttgagacatggtttctacacaacatccaagacatcatgtgagataagaagtattaaatttaagtatggaatattagtgtttgcattggaagaacggtgtctagtactagtctcttgatgatgtggagtttatggaaaccatgtctagtgttttaggttgggaatggtttaaaggaaacggttaaaaccttaatcaccggataggtggctcatttggtatcctacaaacaaattatagttaaataatattgtactatgtccgtctaaaaaatatagtactcctagattttaactatgtatcttgatatgctcttatctaaatttatatctacaaaccagtagaacggtagatattagtagtattaataaccatgccactttcaaaagcaggaatttcagaaaaatataacggcggaataaaaagaaattgattggcttatacttatgcttgtaagcaaaaacattgaattttaaacttaattttgaatttaatatactgtttttatcatagtttattttatactccctcagtcccaaaaaaaagtctaattctagagtgtgtccagattcatccctagaattagactttttttttttgaatggagggagtagcatttgcttttgagttgttaagggtatgtatatgtagtactaagttttacttacaaattttatttgctaataaacgtttcggatagttaatgtcttttcacgcacgatcacggtgaagtgaagtggcctgcgaatggaagcacgaaacggaaggacaagagagggggaaaacacagacccagacacacgagatcctcggcggctgctgattggagcgcaaggacagattcttctgaaactgaaatgataggtgcctgacacaaacatgccatgcccgaacagcgcctacccctagtagcagcagctgcagcggtagcactagcatccaacgcgtacgggcacgcctcggctgccactgtttggaagtttcgcctcggcgacggatcatcatctcatatggatgcggccctgctctgctctgacagcagtgaaggctactgatgatgaatgcacgccgcacgctgcgtcatgagaattgcgggtgttcgcgttcgattcgatcgattctctcgtgaagtcatgagatgtcgcagtgcagggcccccacatttgtgtatactactactccctctatccaaaaaaaactcaacctaacaataaatctgaacaaatatttgttctaatagaggtcaaatcctctgataagttaagttttttttttatgaagggagtaattctgtttaaaatgtactatcatttcagactcagtgctatttctgtagattatcctgtgtattttactacagtggagattattcactacgagctgacttgttctttcagtccttcatgatcaattcagttcagactttagtggtagtagtctttttcttctttgtacttatcgtttaaaaattgacgagtctttgttgattgttgatggagtaggaaatggtcgtcggcatgtcctcttcttaactactccctgaacgtcattcagttgagtactattatgcagcatgtcgcacatgataaattaacaggaaacaagtgtagctcaaagatatgaacagaagaaatccggtccagatgataatgtagctatgacggctgaacctgtataagaccagatctttggtggccctttttccgagcttctggatgaactgtcagcattttgattagttttaaaatgtcaggtcatttacaaacaacaggaggatcaagaaacgatcgacaactagtttacaaccacaccaacatgtaggcatgaacatggctctctgtctctgcattaacaaacagtagcttcctactcagattaatcaggagaagcattggataaaaatcatgcttaagtgagccttgcagtaacgcctattgcagtcgtagtgcaaaactcaggtcagctttaatttagttgtagttgagccttcgtccctgcatggcttgctggctcgtgtccgcgtcgtacgacgacctccctacgctgtgctcaatcgccatatcctggtgattaatcagatgaagcaacaaagattcaattgatgttcttgcttgcaagttgcaacgagatttgcaggagatggtggatggattgatcttacggtttgtcgatgaggttgatgcatggaggagttgctgttgtagggcgagctgtgcatgctgctccggccgccgccgctcatggtgttgcagagctgcatgttgtcctcgccgagggcgcggaggcggttgagctccgggagcacgacggtggcgaggtcggggcggtccttccggcggagctcgcagcagcggatggatatctcggcgaagcagcgcgcctcgtcgacgggccagtcgtggacggccgggtcgagcatgtcgacgatggtgccgtggtcgagcgcgcgcgcgacgtggtgggtgagccccatgggcggcttcgcggtgacgatctggagcagcatgacgccgagggagtagacgtccgacttgacgccgagcatgcccgtctgctggtactccgggtcgatgtagcagaaggtccccgccgccgacgtcatgtggcactgcgtgacgctgtcggcgacggagggcgggacgaggcgggcgaggccgacgtcgctgatcttgctgacgtagttgcggtcgaggaggatgttgcccggcttgaggtcgcggtggacgagcggctcgggcttggtctggtggaggaagagcaagccggtggcgatctcggcggcgatgcggaagcggtgctgccacgggatgaccgggccgccgccgcgccggacaggcagtcgtcgaggctgccgttggccatgtactcgtagacgaggcagccgtactccgggcacgcgccgaggaggagcaccatgttggggtggcggatgcagctgagcacctccacctcctggttgaactgcgacctcccctgggcggcgtcggggcggagcaccttgatggccaccggcgtgtggtccaggtggcccttgtacaccgggccatagccgccctcgccgatcttgcggccgtcggcgaagtgctcggtggcgagctcgatctcctcgatggtgtacttgcggtaccggaccgcgccgcgcgagccgccgccgcccatggacttgagacgctcctcggtctccttgagcgccttcatctccgcgctgatccgcttctgcgcctccatctccgccagccgctgcgacgcctccgccgcctcgatggccgccctcgccttcgccttctcctgctcgatcagcgccatggccgactcctccgtcagccgcgtctcgtgcgaccgctgctcctcatccgtcttccagcgctgcagctccatcgcctgcacgcatcatcaaacactcgatcacatcaactcttctcaacttccacaatccaaacgtaacatgtcaataacgtgggaaactattctaaattcttgataggagattcactcattgattgcatataacccaaatggttatgaaaaaaatatgaggaaaaaacaaaatagattaatatgtgataaatccatccacaaatcaaatttaactgcaacgaaaaaacaaatttaaatgtggatacacattaactatatatagtttaattaattaatatatttttaatttatagaagttgaattttaacctgcatgtttgtagagtgacctatcacatataatctatcttttaaatttcttttcaacttttttataaccttttaaggtggtgtttggatccagtgactaaactacttcagtccctgttatatcggatgaatttggagtattaaacataggcatcttataaaactaattacataaatgagagctaattcgcgtgacaaattttttaaacctaattaatctataattagcgcatgtttactgtagcatcacataggctaatcatggattaattaggctcaatagattcgtctcacgaattaatccaaggttatagaatgggttttattaataatctacgtttaatatttaaaattagtgtctaaacatccgatgtgataggactaaaaagtttttgtcccatctaaacagggtctaaatgatatgcaaacaacaataaagttgcgatgcttataatttcttggttgatcaatggttcatcgctaaccttctgtttagccgtgagcgcctccttgcacgcggtgctgtacatgtccatggtctgcttgagctcaagccgcagccgcttcatctcggcctccatgtcctcctggtatatgtacgtacgtgagagatcgatcacaacgatcgatcatggcgacgaaatctcatctgatgcaaacaaaaatctagcctgtactagctagctagcttgcattattgtgtgtaccatgggaagggaggaagcgaaggaggagttgctggactgggagtcgctgccgaaggagtcgccgccccacatgctgggcggccgcgtcgcctcgaagctgtggtggtcgtgggcgtccgaaccggacgacagccgcggcgggtacaggtccaagctccggcgagggccggagctgatgaaggagatgtccgacgactccggcatcgagtagtccgggaacgccttcctcaccgacgtgttcgcccccctcgcgaacggcgacctgtctccacacaaatgccacaagcttagcttcttgtttctcatccattcttcccccctagcttaagcttacggaaagagtttttctacatctaggtgtcagcacccgttatttgtatactgctcaaatagttatagaaactagcttaagcttacggaatgagtttttctacatctaggtgtcggcacccgttatttgcatactactcaaatagttatagaaaaaagatttaaaaaataatatcaattaagatgatataattttatagacaaacatacaagacatctagactaaggccctctttgtttaggtttataagccaacttataagtcgaaaagtctaagcctaaacaaacaagcagctttttcatttggcttttttgaagccataaaccactttaacactattaagccaaaagctaggttggagaagcttttttggtttatgtgaggtagatgtatgactcaactactaaacttaggacattaaatccaccggcttataaatcatataagccaataagctgacttaaaagtctaggccaataaatctaagcctaaacaaaaagggcctaaatcagatagtaatattatgttccttaaaaaaagatatatactacatccatttcaggttataagactttctaacattgccccccccccccacacacatatatattcattaacatatatatgaatgtaaacaatggtaggaaatcttataatataaaacattataaaacagaggaagtagttaatattacatgtacaatgcatataaaatttgttatttttatttctttatatgtaaatcaaatttatatttgccagtttgtataatgttttatattcacaatctatctcgtcaaattttataattttttatattattatttaaaccgcatgtatacacctaggtgtcgtgacgtctaggcatagaaaatactttcccctcgacttacataatgaagttgtcctgtatcttcggtgtcccggcgatgtcaggtctcgtcgtggacggaggaggcggcggcgtccatttctgcgtggacacgttatcgggcttggggccctggatcattgtgcggagcggcgaaacggccggcgcctggcggacggcctgccgcaccgacgtcaccttgccgcctttggagacgacgtacacggtgctgaagtccggcgccgtcttggagatgctgctcgagatctccgccttgaatcttttcaaatgccacaaaccaaattcaccccggtttcctcgacagctgctttttgagagttgatcgatcgagatgagatgagtagactgaattggttggttggttacctgacgaagccgcccctggcggtggcgccgacgacgagcttctcgatggcggcgtgcgcggcgaactcgacgatcgccttggacacgtcgtggtcgtccagcaccacgtccttgcagtggatctgcgagcccagccacgagaaaaacccccattagttattgcaccacgccgtgctgcaccgtacgagaatggacgcgtcgcgttacgtctttccgcgtgcagaagcagcggaacgggaggaacaggtccttcatctgcgggtccgacggctgtttgtacccggccgcgtcctccacgccacctgcacacgcgcgcgtgcatcgtcagagaaaaacttgaaatccgacgagagatttcagcggcgggggtccgggggatgcagtggttgcctgaggagcccttggtgtggacgtggacgagcacgatggtctggcccttgtgggcgagcgactccgtggcgtacttgagggcgttctggctgttcttgtccttgtcgatgcacaccgccaccagcgggtacccgccgccgccggggtcgccgccgtccttgcccattgccagggctaaccgattaaccaatttagttcccccttcctcgttgctctagtgctcgaagctttttgctatcctgtactagttccatgccattttccttcctgcgcacagctctgctaccaatgtcttcagaaaaactctgctggttgattgttcatccactgaaagattgaaatggggagggaaggccattgttcatgatagagcatggggatctcatttagacctttgctcctgttcctctgacctgtattgactattaataaacacgtcctacttggaaacgagtttaaaacgcttatcttgttccttgtcttcttttacctgctgggttaacggatgaccaccaatgcttcctctctccttttttggtctacactacaaaacagacagcgatggtatatatatactgatgacaacagatgtacagatcataggattatgtgtgtcggtctcaaatcattgacaagggcactcctgctttatattaccactaagccaaaattaacacagaaccagcaggagaattgcataaagagcatctttattcagagaactgcatatacaaccagaggcagtcaagtttataaaatttatatgtacaaaaaatattacaccgacatttacactattaacaatctaacaattatccttacacagttacactacaagacaacaaatcagaggcacccaggctccgataaatgataaccttacatcacgtgtgatctaatgaaccaggcatgttggtccacgggtgtcatcacctaactagagtggtacaatggagttaacccaccgtataaaaggctgttatttatcaataattcatcgaaatttagctacactagaaaattgtctatcaaatggtagattacgtcttcgccgtctgaattaacaggatggatcctaacctgcaccaagcatcagcttacatcaaatgtttagaattctctctctctcttaagatatcatcagataaatcatgcgggaaaatcctctctcttaagattgtggaaccaagaagaagagaaatatagtgaaccatgaagggctatctatcgacaacagtatttgtccataactactgaatgcacatagaagctactataacatagaaggtccttacgcaaaaccccagcagccacattgccttgcagttaatagttcaactaccaattactggtcagttatcagtcttagattatgtttcacaaaaagaatctgcaggagtgccgattatattattcagtaactattggcaacagaggtgcgggactagcagaagatacctggatattgtggtgggcattgtatcttagccagctcttatgaaagcatacatcaacacgttcccagggaacttgtgtaaggccatggatcatcacttctgtaacagtaggagtaaagtctcattgcacagctagcaggaaacatagaaacaaatttaagttcgtgggtttgttatagatgcctctactattaacaccattttagttcgatgcgtcaataaagcttatgtgcactttacacagagcaagagtctcctgaatttagagagcatcaaaaccaagcttgcctattgatatatatatgttatagttattcttaccttccatgctatctgtaagtgaagcttctacagattcctcttgctgatgatgctctgaatttcctttgtcaacatggataatatgtggatactttttatcacttggtgttaactgcaactgagatgcataaacaggccagattattaatgtagtgagcataaaagcacagcaacattgtactgcctcctaaattgaaaaggttaaatggtaatttactttaggtaattcgtgctgacgccgaattgatgatgttctccacccaactatatctttaccaacatgttaaggacacaagcaaccaaagttgccttgagttcaagagaataccaaaaaaggaaaaaaaaagtaagtaaagtgggacattggtaggatacgatcatatgttacattcgcataggcaacacggcgcttaaaagagcgcaacgcagacctgcacaaagcaacaacatgtcaagcatggtacatggaaatagatatgttatacataaaaatatagtagattgcaccaattgctggatatgtacatgaattttccatcatcacagtcttcagccattcgtaggagaagtgggggcttcccatcatctgagtctgtaaggaataaatgtttccctgttctcccaactataaaatgtgcagttactgcagcagttcgctccaaaagtggaacaccaaaaaggaagggaagctgtcaagaacacaaatgaaagagtaggatcaggtttattctatttattcatactattttcttattgaattcatacgtacaaaatcccaaaaaaattatcaaggaaggtttaacgaagtactccatgagttcagagctgaataaaaatcaacatggggttcagtttacggaatgttttcctagatcaataggccatatgatataagtttggtggttacaaggttctaaggattcaaattgagaatgcaaaagctaacaatcagatgagagataaacatgtcaaacacacaacaaacacataatctggacaacttacttgtttattccaccttgatcccaagtgtggagtagcaactgcaataaaatttattggctccaaaccagctattttaccaccatcagatgttctcagttcatttgagaagttttctttatcaagagaagcctcttcatttattgatggatcatacagttttccaattgcatatcttgtaactaaaccaccaagtgaatgggcaacaaaagagatcttctgcaggttacttctcctctgaacaacttgtcgaacctgagtattaaatattagtgccattaggcaccctttgtattaaactgcaacttcatataaagtgcgatgataaagtgttctactgattacagtgaccatgaactagtagatgtataaacagttggtacaatgaagttggctgtacgcctgtacctcttcagctaacctttctcccatcaagtcgactccatcatatgttaactttgaatggttgcactgactgcctgtttcaagaaatttagttagacacggaaggtgtatgtttatgtaggctgatcaactattactgcttaggacatagcaaatcaactgggcagtatgaggtatagacatgggagaacagcaactaaatctggagtgcagctttgcaagtgaagtttggctgcatcaatgcacatcatgctaatatggtacttgctccgcaaatttcagactgtgattgaaacagctagtcttacgaggaatttcaaacaagctacaccccagcttaacggaaacttgagagggatttcacactatccacaccctggttaaacagaagctttctgtaatctaaattgcacaaagttcacatcttcagtgcacaaccaaatcacgattttttttctaactagcttgatgcctgtttgtggaaatgcaatgcattgcatttgcacttccagattgaagacattttgtaatgtgcaggcaaaaccaattccacaagaccctctagattaaacacttacacgggagcaaaattgaaaagcagtaacttttttttttcagataatggaaatggtacaaataagccagtaactaatcgagttgtataaactcacgatgcacgaagactttccccggcagcctcttcacaaactgctctgcagcaaatttccaatccgccgaactgcccaaagcaccaaattatgcaattagctagtaataggaaagcataaaacaacacaatactatgccaaaaaaaaagagcagtgcaatcgcacgcacacctcccgtacagcccgttgaccatgacgacgaggtgatcggcctcctcattcccggcctcctcctcctcgcggttccccgcgtccctcccctaggcgctcgcctccgcctccgaaggctgcggcaggggaggcgccacgaagcacctcagccagttcgccaggtccagcttcccgcccccggaccttgtcctcgccttgcggccaagcagcaaccctaggtcgaggcggagcccctgcaacggcggcggcggcggcggccatctcgagattccgcggctgcggctgcgccccggccccggcggcgagctcggggcctggcccatcgcggaggcgggcccccggccgcggccgcggcggcgaggcgaggcggaggtggaggcggaggcggcggcgagggagcacgtggcggaggaggggttgagtctggaagacgcgggcatttccggttggctgcgaggtgtgtgtggggcccacatcgacggttccgaatcgcggagaccttttttttggtggaatggacggtggtgattggatggtggattcgcatcgagcggctgggatgcactggggcgtactgggtggttggctttcgcggtcattgaattattgcgtgggccgctacgagatattgggcttgaggtgtattggactcttgggtttggtagtaatgggctaaaggcccatcagagattgatccagtccaattcacaaacgattttgctaaatatttgtcgagtgatttttttcataggatttgacgtttttctagccgcacgatgttttccaagatttgcgcaaaagcagggtcagttgagtccatgaccgagtcaacctgactttgtattgatggatttctgtacatcacgcatatcagtagccatttatttcttcgctctatttctttctttctttttctagttaccaaaatttacaatgcactttgtactaaaattacaatacacttgtactgaaaatacagtgcacttacatgtcatatctactacttttacaaatgtaattttagttataaagcactgtaatttagttataaatgcaacatttaacacttcaaatatctgcacggtttctcaagcaatgtatttatactaaaacgacaaatattctagttaacaaaatttacagtgcacttgtactaaaattacagtgtacttacatgtcatatctactgtttttacaaatgtatttttagttataaaacactgtaattttagttataaatgtaacatttgtgttaatctttactgaatactactgtactaacaagcacaatcacaggctatctgtacttttttttttaccgttggatgcagatatgaggggagaaaaaatttgggtgattttttcttaaaaattacacgacagatgtctagacagtcccattcacaaatgttctctttttgttataccgtacttcctccgtttcacaatgtaagactttctaacattgtccacattcatataaatgctaatgaatatatatatatatatatatatatatatatatataatagtgtctagatttattagcatctatatgaatgtatacaatgctagaaaatcttacattgtaaaacggagagagtagtaatgttttcaacaatagtacttttttaagagagagatagtaggcactgtttgcagcaaatctctacaattatagtattctctccattctaaaatacagtaacttaagatcgtgtagtactagggtatgatcctttcagtcatagattgttatattttagaacggaggtaatactaatttgtacatgttttattttctcaaaacgatgaatatagtatgagtatgaaatccagcccaatttgccactgtttttgctcattgtttaatgctgcatcgatcaacagcagcaggaaacgaacgaaacttcgacgtattcgccgactgatcttttcgatctaagatgtggtctagcacgcatacccacatgaaagcatgtgtagccacttcgtcggtcgtcacagtgcttctacttacacaaaaaccctgccaaaaatgaattttgtaagtgacactgacacactggaaaaccgaaacaaattgaagccagaaaactacccttctccagccgtttacttcagggtgcaaactgcaagttaaattccatcctaggcaggcatgatttgacatcgtcacttgctccatcgatttcccaaaggtgtcaaaccgaccaatggaaaagactcgaataatatacaaactgagacagtactgaaaattgcaagtcaaacaagaaccgggacgtcctgtctcacgcgcggcctgcatgacgccctcaatgtacgtgccccatcacatgcaacgattctgcgtcgatcgattaattcttcatgaactctgattcgatcagtagatctatggtacttccagttgcagattaaatcttaattgtcaacgctgtttgtgcaataatcttcagctcgcatgcgtatatataaacaactgcaatggtaaggtagcctttgaagcctgcaattaaccagttagctagctaagctaggagcgacactggtcttgagctagctagtgtggtcggccatggagtacagctcaaggagggtctcctgctgcgtcgcgctggccgccgtgctgctcctgtcgtcgcgcacgctcggcggcgccgccggcggcgcgccgcggcggctgctgcagatcagcgaggcgcagcagttcgtggtgccgcagacgcacctccgcgcgatctacggcctgcacccgctcaagtggagcagcgacctggcggacctggcgacgcggtgggcggaccagtacaagggcgactgcgcggcggcgtcggcggcgtcggcggcgggcggcgtgaacgtgttccgcggctacggcggcgaggcgtggcagccgagcgacgcggtggcggcgtgggcggaggaggcgcagcactacgactacggcgccaacgcgtgcgcggcgggcaaggagtgcggccactacaagcagatgatgtggcgcgacagcacgcaggtcggctgcgccaccgtcacctgctcctccggcgagacgctcatggcgtgccactacgagccgcagggcaacatcatggggcagaagcccttctgatccacgggctaatcgtaattaggatctacccggtcttgatatgctagttaatatgctttgcattaatcttgatacgtactataatttatctatggttattagttggggctgaattagatcgaagatcgatgctatgatttttggtcgtgcgttttgtttatgccataaggatcaaacctatctcttcgaatatcatcgatgtcatcagctcttagctagttttgttcgattttttcattctgcatgacgccgcttatgagcttatccaggtaatactgggcaaaatgaaaacatacattactccttcacttcaaaagctgatcatccagatgtatccgttttgctctgtgtcttcatgcctcaccggtgtcctatataagatcagccataccaaaatttaaattttaaagttttttcattgaagtttattttagcgttagtttttaaatcgctaaagacgtatccacaaaacttttactataattttttttggcctaattaacagatggaggcttcactcgagaaacgcaaatcgtttcattggtctgagaggctgcgtattccttctattgggccggaagcgcacgactatggcccaaatcccctaaaccattagccttttcactgttttcaccttccgtccttccctctagtaaaaacagttccgacaaaacaatggcgctctagtaaaaaggtcattagatgtaacgaaatgtataagaacttaaccaccagtgagtgtatttacagtgacagtaactcagaaatgcagattgcacacacctgattcctgaaacttttattcagcagctgtacatgcacatctcattccatcatttccatccaggacaatcctgacaaactctgtggtatcctagtgtactgctcattcagtacggcctctcgccgacgacgttacccggcgggtagtagttgcaggtcatgaagacgccgccgtcgtcgcaggcgacgcgggcgcagccgacggaggtggtgccgcgccacacgatctgggtgtagtggccgcactcgcgcccggccgcgcacgcgttggcggcgtacgagtagtcgacgccctcggcggcccagtccttgacggcgtcgccggggcgccacgcgccgccggccccgccccagaagatgttctccccgagcgcgaactgcccctccgggaacgagtggcgcagcgcgcagtcgccgcgccgttgcgccgcccaccaccgcgcgtacgactccagccgcggcgaccacgccagcggcagctcccaccgcgccagccgcaccaggttgtggtagtagaggaactccagcgactccgcccacgcgcccagcgcgccgcacccggcgcacttcgccacggacatgtcgtacaccgtcgcgttgctgtacccgagcgccgccgctgccgcctccttccctcggcggctgccgtcggcgagcagcgagtggacgagaagggtggaaacgagcagagccacgagcagcttcatggcttcgatctcctattggtcgctgtgtttgcaacgaaattgtggtttgggattgaaggaagcagttatatgcggtggctgatagtgtagtgtttgtctctggcacccgtgaccgtgggtgggagcaactgtagtagccatattgatggtatttttgtccacatttttgacatctcgagacatcgtttcgatcatggcttgtttgtttatgcaaatgcgggtttgttttggttatcacaaaggccaccaagactttcacggatttgattctgtgaagaaacctgaaagaatcgttgctgacgagagatcgtcgaacatacggtccatgattgattgctgtatatactgcactacagatttttcaatagttcatcaaaatctgttgatgaaagcttgttctcctcctaccttgttacctgtgagctcgcccgtgacgatgaatggccgcttctagatacttccgtggtcacgcgcgagcttacaacaaggtccagggactccaggcttatgatgaatcggtagcacggccggtcggccgggcggtttgccatagattgcttctgcgcggcaggcggcacatgcatgtggtggccgcaaggccccgcaaacggtgtaacccaccaccgttgtcacaggaggcccggccggcttgtcgtgtactgtgtacgtacgtgtccgcggacatttcggccgcttctgaacttgagagaagttgagatcgatgcatgcaacggctgcctcgtcggcttctgaacctgaccactctgggttttctcttttctgtttctcctttcgcaaacttgtgctgatgcgaacgtacgtgcggcccgtgattgtgagcacgaaagtacgcgtcatgcgtgcggcgggttggaccgtgaccgcggcggacgttcagcccgttctaaaatgctcggcccgtttgacgatttgactggctgttcggtagccggtttcggcttttgagccaccgcgcccaggctcgtgcttcatttgacaggctgcgctcttttttctgtcgtagctgcgagaaagattgtttcgttttccgcgcgtaagtttcccgaactactaaacggtatattttttaaaaaaatttctgtagaaaagttgttttaaaaaaatcatattaatctatttttaaagttttaaataattaatacttaattaatcatgtgctaatggctcaccatgttttgcatatcttcccaatctccttaatccccttctcctcaaacacactcttaatttcgttagcacatcttttaaacggttaaactgtgcattttacatgaaaaatttttatataaaagttgtttaaaaaacctaataaatatattcactattttttatatattaatacttaattaattatatgttaattacgtttctcgttttacgtgtggttaattagccgtttcaaaaatctaaaaaaaaggcagcccttgtacgtactcctcctcaaaaataaaataaatccaattctgaaatcgaattgactcaagggccgtgtttagttgttttggtaaaaaaaattaacgtatacgaacacatatttaaagtattaaacatagactaataagaaaccaaattacagattccgcctgtaaacagcgagacgaatctattaagtctaattaatataccattagcaaatatttactgtagcaccacattgtcaaattatggcgtaattaagctcaaaagattcatctcacaatttacatgcaaactgtgcaattggttttttcgtccacatttaatgctacgcgcatatgtctagacatttggtgtgacggaaaagttggaagtttaaagggaattaaatacggctaagataggatttgttttagatagatggaataggccgcagctagaaatattgcaatttttttgtgaggggctatatttcattgttgccactgagttgccagcggctggaagttgttatgttatgccttagaaaatataatttctttattttttgccgggataaattataagttctttaaacaaacagcatcttttatattgttaagtcattccttttttacaagaatacaacatgagactacaatcagagaaagtacacaaatttactaaacataccactacatatcgacaatgcctatacatgctaagaactaaacaccgcgtcagggaagagaaagagcttgcttccaccgttgctgctttcaattggtttttgccacatccatcgctattctctcttaccgcctcccttggtctaaaggaattattctaccatttaatattggtgtctatgttttgcaatgaggttgaagatggagacagttggacggaactgcctgttacgagacttgagttccttctcaaattgtttgtttggtgtcaatgttgtgtaatgccattcgcggtgcattaaatgacgtatgtgtgatcttaggcagccacgtggtcgtatgttgtcctatccttacgaggatgctcgtccctttgcaaggtcgcgcgagtctcagtgggctgaagaaactcgtcaagtcaaggtgtgagaggaaccatgttggaaaaaccatgccccagtggtcccctcctgagctgccttcatcatcatcgatttgttgttgtcgtcacgggaaatatatggcgagcccgtcaaattttggcaagcttggtggcgtggagtggccactgccacattttctcccgcggctttgggaatgaggaggaggtgacatcgtaacaagaaggagaggtgatgccgcctgatctacttcatggtgagggaagggtgaaggaaagtggcgccgaaggagagagtggccggcgaagagggggatggagagacataaatgggaggggaggtgatttcatatttctttatatttttttgggtgttcagtccaaaatattgttgttccctataaattgataaaatatgaggactaaaatagaaaacaatagagggttggctatgttgcactttataagaaggggtgtgaatcattaacgtatgatgatttaagtgttaactattataaactaagatttacttaaaacaagaaaacttaggagtatttctttttaacgaaatgcgtcatttcactaagggaaaacgaaaaagttatcactgtttcaaaagtcctttggatgggcacagttgagaaacatattcataactaatgtcgtgtagtgccgtgtctagcgcacacaccttttcaagctcaattttgaccgcccaaaacttatcgagtggtaactactactccctccatcccaagctcaattttgaccgtcccaaaacttatcgaacggtaactactactccatccgtcctaaaatatagcaacctataaccggattcgtggtactaggataagtcccatccggtcctaggttgctatattatgggtactaagatacgtcccatctggtcatatgttgctatattctaggacgggggagtagtagtatgaaaaagctgcttttcactttggcgactatcgtgttttcagtgtcgatactgttgtgaagtcagcgctgctaggtcgcttgggctgctagctcggcaacgataaccccttttatgcgatgtcaaagctattgtatcgcttttgtgtttagcttgcggcgatgtcctgtttttgggctccgccgttgttagtagttgtgtaggtaggtttcatgctttttttgtgcggtgggtttcagtcggtttccccccgtgcagttgtatggttttcgggttcgattttccttataaactgaataattttttttctaaatataaaagctgggtttttttttaaaaaaaactactactagtagtgtactagcagaagcccgtgtttattggccggccatgtatggaggaattcccaattttacggcggtaagcccgtgtttacttggaacgagcaaaaaaagggcttgagtacccgtaaatagacgcattcgccaaaagaaccagtggctgataattttccaaatatcacgcagtcataacagcgcacactataaaatatttaggaaatactatgaatgtcattacttacctaaaataaaattgattgggtagaagtagtattctcaagcaaactctcattggtagaaatccaaccattaaaatgttgttatatggaagctttttaaacaaaacaattataaagagagaacgtcagcgataattggcatgcatatattttttacggcagaaagtttcagcccaacccaactggttgtgggacacgcccacaaggggatcgacatgtcagtgagagaacgtcggtcagtttatgggtaagaaataatagcttctccatcacgcggactctttccgtctctgtacataaaagaagggaacgagtagcggagtgaacgcctcgccccgcctattcttccaccatccaaaatcctccaccaagcgcagagagagagagcctcacaccaaacggtgtctcccatggacgacctcgccgtcgcccatcccatcaccagcgtctacttccggctcgccgtcctccctcccggggtcgaccttctcctacctcttccctgacggcgatgaggagaggcagtggttgacctcagacagacgtggctcactcccagccaccgctccttgatgggatgagggggtggcggcaacggcgagtcgtgcctttccggcagccccgtgcccgaccgccagcgtcgtagttgcagaagcgccgccgggagtttgcttgaccgggctcgctctccgccggtgaggtggagacggatttgcacgcgctctagatttgagcgagtggctgtagagcttgtctctggctagatttgagccagcggctggcggagccttcatccggctagatttgagtcgccgggctccctctagatccgagctggtggaggtcgttcggctcgttcttctccaggtaaattacttacttaagagccgataatttctctgatttctccaaagattgcccaaacgcataggcccatcagcccatcaccaatcttgccaccgtgaaatgcacgattccggcctagtataatgctagctgttcttacggattttatcatgtgactcgattgcaagcagaaccacattggcccatgctttttgcaggcctcatttcatcatatttacccgcattttcagcatttctacctcgatgctgtagtgggcttgtagagatcgaggatgtagcaaagcattgcgtcgtgatgcctcatactactatctataaatagtaagcttgtgatggattttttatcctagcaacccaaaaagtgggcggcgtgtagttgtagaaagcgacctcatggagaaaaagacactaccacccaggttgaaatcgctctgaccaatttagtccacatcgttctcttcctcctttgattttgatcttggatagccactactgggtgcatcttttctcctgctcgcgctctctgtgccctgttcatcaccgtgttctcgttttgtgttagtggtgtgtggagtctttgattgctgtgtgtttttaagtttctgcaggatgtctatgttcttgtgggttaagtggggtatgttcaacttggctctttagccatctttgtacatcttcacctgcctggatttctagtatcaactgatgttcttgtaatttctatattgatcattttcagaa

SEQ ID NO: 78054 - DNA, 14099 bp, Oryza sativa
atattaggccattctggttcgtgacacttcacattgcctaaggctggtcctctcctgtgttaactagctattatgcttctgctgctttagtatgcttatgttgggttatagctaccctgtgtgctgctatgtaggaccatgtgccaggttttctgttgtttttctaatgtgtgactagctagtatgcttttgctggtttgtaactaacttgtatgttgctgtgtaggaccttatgtctttgaacatggattattgtatatatttttaatgttgttaagcatttatggttgtattttatcagaacatggaagtctgttgtctccttttggtcgtttcgttacagttttaagagttggcaaaactgatcaggaaaaacacttatggctgatactaacgtgaacctgactataaatattcattggttcttcacatgcaattattgtcctatcagattttcaaatttcttaaaacacatggttttgtattcctgactgtcatatttatatctttattttgtagttatcttgaggttctgcagcgcaacatgccagttcagaatcacgaaaaaataatggaagatgcactgaagagggagttccagcattgcatgtttagtcacgcgcctcctcgtggtatggcctacttttagaagactgtttgtattaaaacattagcctaactgggcctacctattcttgagataatttcttgaagaaaatggattttatcattttccctactctattattgctaagatcctggatttgctcattggttgttgaaagtttggtctaagaagatcacattcattgattgaacctgtccatatgaaaattgacttggttaactgcaataattgccaaaaaatggatttaataattttctctactcaattattgctaagaacctggatattggttgtattgaaagtttggtctaagaagatagatacgtgcattggttgaaacctaatttatatctaggaaaatggcttgttagttggattgaacctctccttatggaaattgacttggttattattggcagaaatgtctttcccatttattgcattggaatttgctcgttggcattactggatcaccttcatgaatttgcatttgcttattggctgtatttgctttgatgaatttggaacttttccttcttttgcagtacacatccagcagagccaagacccacctgaattagagatcaacttgggtattgctggtgatgaaggccccccattgctcccccatggaaatcatgataaccatgcacatgcacttcaccgactcctgaagcttggcattctcgggggacctgatggatgtcttcatgatgtggtctatatctagtagatttgtttctgtgattcctgacttctagaagtgtggtttgtgagtatgactaatatgtagccactattctgggtttagttgagacttgggacatgattaggcactattctggctagtagtagaatgtaagtaagcgaagcatgcctggtgatgattgtagcctatcatcgaagctttggaagttggattcagacttgatctgctgctgctcctttcattgggagtatgcctgaacttccttctcaacaagagatttacttcatttcgattttcagcggagtacttttaaatttctcgcattagtaatcaggcaatgcattaatttgttttgcccgttgatttatatgatcaattaagttgacatgctctaagtctcagttggatgtgctgctctgagtctcagttggatgtgcaggggtttgcgttatgctgttgtggtattttactgtagttgcccaatggtttcactttttcggtaggatgtgtagaattctctttttagcctacgcagttgtgcttgtgacaagtgaagtcttgtaaagttgtaactgaacagcgtagtagttgcttcagtttgtagcacttctttttgttacgattttagtgaatttgttcattttgttacgatttactgttttttccttttctaggcaacctcccaactcctgctcgtttctcaccttgcatgttcgtaagatccggtgctcaatcattctgcacagttctcttgcagtctagtggattatgttccacactttgatttggggtgtgtttagttcacgctaaaattgaaagttcggttaaaattgaaacgatgtgacggaaaagctgaaagtttgtatgtgtatgaaagttttgatgtgatataaaagtcaaatgtttgaagaaaaactcggccttgataatggccttgtttggatcctccgggctattaaatagccctccggaatcttactatttaggattattaaacgtagattaccgacaaaaccgattccataacccctaggctattttcgagacgaatctaatgatgcatattaatccataactaacatggtggcccgcgcagattgcgcggttagcatcattatattttctctcatataatagcatatatgttttctcattatattattcaaatatattaaaatgacaacataattttaaattttgcaataactttacaaaactactaatgtgtaatattcatattatattttatatacgtgttagttattaattatttttaatatcaaattttagttatttgtaaattatatatattcctatatggactctagacttgtcttttaatatttcttttttttaattccaaattttctgtaaattgtatttctatatagactctatgctcttctttcaatattatttattttatatctgaatttttattatttctaattgtatttctatgtggactctaaattcatctttcaatattctttaatttttaatttcgaatttcagttacttcgtaaattgtatttctatatagactctatgctcttcttccaatattatttatttttctttctaaatttttattatttctaattgtatttctggactctaaactcatctttcaatattctttaatttttaatttcgaatttcagttacttctaaattatattcctatattgactttaaactcttcttcccaagtttttcttaatttcgaattttagttatttgtaaattgtatttttatacggactataaactctacttttaattttattatatttattccaaattttagttagttttaaatttctatatagactctatactctacttctaatattccttacttttaattccgaatttctattttttttcttaattgtttttctatatggactctatactctacttctaatattccttatttttaattccaaatttcagttatttcctaattgtatttctatatggactctatactctacttctaatattccttatttttaatttcgaatttcagttatttcctaattgtatttctatatggactctagtctcatattctaatattccttattttttaattccgaattttaactatttctaaattgtatttctatatggactctgccttttctttttctccgattaatgtgaaaatttctaggcgatgagagcgaacgtggaggctcttttttctattcctttaataatataatagattagcggctgattactgtagcatcactgtagtaaatcatggattaatatacctcgttaaattcgtctcgcaaaatagcctaggggttatagaataggttttgtcagtaatctacgtttaacactcttaaatagcaaaattccgtagggctatttaatacccctccggattcaaacaggccaatgttgttggcgcaccagctcggtccctcggtgggctgctctgctctgcaagtccagattgataatgttgcagtctagtggattatgacattatgttcccaactcttgattggctgattccttgtgtctctcttcgtggtgaaaaaaaaaacagcatctgctcaaacatttaaaaatctaattatcaatgatttatcaaatgcttagtttgaaaagatggtacttgtagatttgtcttgaaaagtacggttataagcggcaaatattcatgttcggaatttatataagttaaaattcatggtcggaatttaaaaaaatgaccaaacttattataatcggtaaatatttatgaccctgttgtgcacgttctcttgcaggctgcaaagttcaggtccgtctgctagcgcttgctgctttggtccaatctcagattcgtgctactccggttaccctgctacaaactcaccccagcgacgtagagcccaccgccgggctgctgatcccgtgctcccacggcgcccgcgccaccctactgtacttcagtactctcctcctttcggttgctccttccctatcaaaatgttgccattcatcgtgaacatgagtgcgacttcattactactcctacatcaaaggcttttacaaggagatgcacttgacagtactatggtttcgatcccgacatcccgtattcaatcctcaataaacttataatttcttcttaaatatgtttggagggcgtctctcccttcaaaacttttgaaacaaaatgctttcacagagaccgaccaatggcatggttttcagacttccaatgaatcaaaaatatttcactagcatttacaatgaaagtctttttttttacaggatgagttgaaccgtctgaaaaaaaaaatctttcacagataccgaccaatggcatggcatgggctccagtcttccaatgaatcaaaaaaaaattcacaaacatttacaatgaatttgagagaaaaagttacatgagggatatcctttctgagggattagaatcctctccccattctttggaaatgcctcaaacgtcctaataaattatgtcaaattccttcgaaatccttgtgtacacaagtgtagtgatttcatgccaaccatttaggagtacatcgtaacaagtaataacaatgttccccacgaaaatttagaaaataataataataaagactttaacaacaatttaagacatttgcaaatactgtgatcactttatattgattcttattggcgatgatctttcctcgttgatcagcctcctcgttaactctctctctctttgtctgtacttggataccacgtagttgggtaatactgacaattctcacatttgacttcatcctccagatgtatatcttccaaattgacagccgcgtgtgctagacgttttatgagtttcacaaatttatccttgatctcaaaaccaacaacagtgaccaacagcagattgtagtgcctgaaatcagaatcaatgtgccactctatattgtttttcttgcagtacagtagcttcctcatgacatccgctgctgccaagctgccacaagagtgctctgttacctgtacgcgacgcacgacgacaaattgctttagttgagcatgcccgtaagttttagagacgacacatgtttaattgataatacatataaatatattattccttctgtccaaaaatataagcattttttttaaatagtgacaagccaaacatttttaacttttattattaatagaaataataataataataaatcaatcatgtaaaattgatattactagatgtatcattaaacaaactattataatatacaactatttttatttaaaacatcttagggcctgttcattttgataccattttcaaccttaccaaattttggtaaagttaccaaaaaaaagtggtgacatttagtttgctgccaaattttggtaactatataagaaatcctgccaaaattttggcaatgctaaaatttggtaaggtttttttatggcatcaaagtgaacaagcccttatttttatatatattattggtcaaattagcatctcggagacagggttagaatctaaaaatacttatattttgaaatagagggagtagcaattaccgatatgcgaagctcctttaagaggggtgcagcttctaacacaaacatcgtccaaatgaggtcacattccttgtgaatcttgtccaaacatgcaatcctcagattgcggagaagtggagccagatgtttcgggctttcaggttggaaccagatctgcacaaaaatcagtcaggacgaatcaacaaacgtgacacttcaaacctgaaacagaaacacacgtacgaggaacaaccaattcttttacatgcataccttttcactctcaaaaatcatttgcagtgtacgtatgccggtggcattgacaagaagcccgcttagcttgagagttctgtagttaactgtaccgacagtggagagtactgtccggagctgtggaacatggccaaaaacaagcggaggtagagtccgtgaagggaaccagatgttgttggagacctgaaccagcctcgggagccacttgagatctacggtctcgaagtcgcacgcgtcaacgtcgaggcgaacgagccgcgggtgctccatctccaacgccgccacgttcgagccagctgatgcgtcgcagctgtgcaaggagaggatctccaggttctcgcaggcggcgagcacgttcgccacgtcgttggacccgcgcagcgtcacgctctcgacgcgcagccgcgtgagccccgcgaacgcgcgggggcacccgccgacgagcgacgcgagccgcctcccgttcgcaagcgtgtccctgcccgtgcactcgagggcgcgcttctcgcccctcacgtcgaacgccgcctcgcggaagcgggcgcggccgctcgcgatggcgtcgtcgacggagcggacgatgccgatggactccgccctcaggtagaaccgcacgaggaggcggtcgatggcgtgctcgccgctgcgacgcgcgaggatggctttcgcggcgtgcgccacggcgaggttggctcgagcttctcgggacagtctcgacgtgaaagtgaaaccatcctgatgatcatcatcctgcttctttctgaaggagaggacgtccagtacgatatcgggcagcgcggccgggagatgcctccaccgtttagcgagtatcgctgttcttactgcgtcgcgtaggtcgacacgtttcaggatggagagcaggacgtcgtcaggtagctcgctgagccggtccgccatcgatgcatgcacctagctagctttccacaggaagagatgagattatacttacatacgtacactcgctatcgattcgatgcgaaggtgaagaacggaagatcggaggaagtccggctagagctctctatttaaaggggtacacgtataaggacgtccgtgtcctattcaaattctatgtcgtacagtatacccgattccgcatccgtctcggagattaagtatttctttagagaaaaaaaacgttggaatttgctcccttctcgccttcttggtctcttgtgagatttgggggcatttaactatttgccacttttaagatatgataattaaaaatttatcactcgctatctatatgagtcctcatatattcatgatatgggtctagtggcaaattttttatcaccacttataatacaattggtagatcgatgcagcaataaaaattgggctcgcgcaggaagttacacttaactagtttattatcattttctcttcctttgtttaaatatctttttcctaaattaattatccgatttatgatccggtcataccattgtattcgtttaattaaatatttacaacaaaatatcgtatgattatattttaacaagagaaaaatgtgtgtttcaaatcgttaaaactcaatgttttatatatgataaagatatgtttcagcatgtgcctttatcatgtttcacaaaattcatgcaactaactacaactactatctctcctcaccatccatgtatacatgcatccatttagcgatcttcaaaattatgttcttctaaactatttatctaatctacgatatgcgtgattatattctgatgaaaaaaacaaatatgtttcaatttataacactcaatgtttcatatgtgatagtgacatgtttcaacgtgtctctactgtgtttcactaaaaaaataaatatttcagtgcatgatttcctcatttcaccaaatataacttaatatttcaccgatggttagctgaaatatttgaccgtctaaatttttcaagacataattggaggctcggtttatagtttcttccttgagattttgctatgtctcgtgagatcttgaatggggcgggagcggaattgccacgaacgtgcaggcgtgcagcccatatgtatggtggaacaggatgagatgtacgtgcggtgtgttgggccgtgatcgcgaggaacgtacgtttctaggccgtttgggacaccacgcccggtttcatgctgcatctcctctggtttgtgggcttcagtgacttgtgggcgccgctggcagatttcggcgcgagcatatgggtgacggcctgttaggatcagttttatacggagcatcgacaaacaaaacgaccaacgaatttctgcgccagcatatgggtagccagcaggggcatcttcatcagtgtgataattgcggatctcattttttctatgttatgcttatcaatcaaaatttaaattttcgatcttaaatttatagttgattttgaggtttttcaatcgaagtttattgtaagcctttgcttttatatcgctaagaacacgtatataaaagttttattcgtaaattattttttgtttaccaacgtgacgtttcccttagtatgctatatttgtttttgggctatagatggcaataatgcaggatggcacccactactttgcacccagttgcagcacccaaattacaggcgcagctgacaaagtagtagtagcacgccagaaattagctcagatttaacgcagcacactttgcgcaggttcgatcgaagggattgttattgttactgatcattacatggttcattcaatgtcacatgctccaacagtggctgcatgggggaggaacgagatgaacaacgatgaaccctgcaatttgcgagagcacatgcatgttctgatgttcctttgcctattgtcaaatcggcagggcattaaactagcgccgctgtcttgttgacatttgccacatgacaatgtatatcacagcacagattatcgtgcaaatgtaaggcggaccataggctgcaactatggcctggtttagttaaaaaaaagttatatatattttttttatacatgcatggagcattaaatatagataaaaataaaaactaattgcacagtttgtatagaaatcacgagacgaatcttttgagcctaattagtctatgattaatcataagtgctatagtaacccacatgtgctaatgacggattaattaggctcaaaagattcgtctcgcggtttccaggagagttatgaaattagtttttttttattcgtgtccgaaaaccccttcagatatccggtcaaatattcgatgtgatacttaaaaattttcttttcgcgaactaaacacaccctatatattgtagtactgcaagctctgcccccgaaataatactcaccagatcaccaattgaccgttccttcccttcagctttgacccgtataaactgtgtataagatacgtattggctgcacaagaccagagctgcagaagaaatacagtaaattgtattagtactagtagcgaccaaaggtccaaagctaggtagcatgtggacatgtggtgttcgcagcgacccaaatcacatctgcttcgcgtatgcgtagtctcgtgacgccgtgatgctgcaatttttgctgctagattcgcacagtataattgtactcttcttgcaggcattgtcgcgtatttaactcatcagctgccactgatactactctactccactatacttcagctacgcattcaactcgaccgttttggcgatcaatgcgcgaagtttttgcagctagacgacgccgcagagttagagggggagattaaaaccggttgggtcgcattgcattgcatcggattccaactgaccatgatgcacacacctcagagattcagagtttcagacttcagagagagagagagagagagaggaggcccaggctctgagcgtcttcggtacaggcacatggatgcgccaaatacgtacagtagcactcatttaacaactcatccgttggtcgttttcgctttgcaatactctgccaaccgaccaaccaccaatcagaggcgaccaatctcttcacctaaaagcctcacacacgcagagagagaaaaggtgatttctgtaccacctagccattcttcctttaatccttttcaattgttccattcttgcagcagctctgcataactcacattttgccactgtaaaatgtgttcaaaagtggagtacatagtacacgtgaaatgtgcgagaaggggacggggaaaaaggctcattttgttggacagaacagagtaataacagaccaatcaattagctgatcatatttcattgtagtttccccgatcctaccaataacatcataatatatattttggtaggaaaaaaggtaaaaaagcaaaaaaaaaaagatgttgcagcgtgcagtagaaagaaagaattattttgtacagttgtagtactcttgtaacatcatcatcatcatcatatggcaatgaatgagacagcaagattggttggttgctgcgctgcgtcgccctgccgtgtgccgcggtgctcccggccggccggcagagcggaccaaggaaagaatcggtcaccgtcaccatcaccggcgacggcagcggcggcggagggtgggtgggcgggtagtcagtaggggcgcatgccgacgtagttgccgggcgggtcgtagttgcaggtgatgaaggtgcccctgccgttgtaacaggcgaccatggcgcagccgacgcggcgcgtggcgcgccacatgatttgggtgtagggcccgcacatgccgccgtaacaggtgtggctccagtagttgtaccgcggttgttcggcgagccacccccccacggcttgcgccggcgaccaacccgtgccgctcccccagaacaggttctccccgtacggccccgacaagtgcaccagcgggcagttgccgcgccggaactccgggtaccaccgggcgtacccggccacccgctcgtcccacaccagggccggcaaccccatggccgcccttgccgggttttgctgccccaagaactgcatcctgtagtccccgccgccgccgcggcgtggggtaggcgaccacgacgaaggcattgccgggaagaagaagcccaatgccgaggagagcaagggcaatggcggtggaggacgccatgggaggcaaaatgctgagctgtggatttgcactactgccactaccagtctaccaccaccgcgctagctcaaggccgtatatatggactcgacgttgagagtaaaaaagccattttttagatgatggtgttggggacaggagccatgttcgataatgattgcgccacacaagactatggaaggcaggtctacctaaatgtgcttccgactagaataaaattagcagttcaattatgtgcaggctgcgccgagaggacgaactgattagcttctttgatttttatggaatctcgaactaattatagtagttagttctatgcaggtcagagtctactccagcagtccagctaatttagtcacagcattcattccgttaccgtttggtaattaaaatcgatgccaatttgttcagggaagtctagctctttggatgcaagagcagaggactgaaataaaactgcaccagaattatttttggtgagttggattcatcatgacgaaccgcctgacttggcctgtagcaccgatcgtgccacggcgttttgctctcgaaaagacgctatactacctctttacaactcacattggctgccaaatgacaacacagtgacatacattgatagccagcgcccatcagacagctttcattgctcgaaaagaattactactagtgcgtacagctccattgttaattagtgagtacttaattaaccgcttgtacttcgtttctgaattctgaactatgctgtgaactctgaaagtcaagaaaggaacagtggcaagtgcagcttttgcagttaacaacgattacgttataatctaatcaataaatctcagaggtcaagaggtcagtcgtggtaaaacaccatgtgcatctgggtggtactaatttaagtgatcatcacaacgttgcatttgcgtcgcagatttcgtttattttatggcagaaacagatgccattatcactcactcattcagaactgacctaccgaatagccaggaatatatacgaagaatgtattggcatggtttggaaggtttctgttggtatgtacctactgatgaacaacgtgccaatcactgtctgtcaagaactatgcccaatatgcggcgaaacaaatggagctgatggaaagacttttggcgtcccctgcactagctaaacagaaaaacagcatgacaattttgacattgttctctggagtacttgggtacgagtgataattgctttgggacagcataacaaagaaggatggaagataattgcagggttaggagaagacagctcagtgtcgggtgttcagaatttgaagtgtacagttcagtactactacgaagttgcttgttgtacacattatcacattattgccttgtctgaaccagtgtaaactgttccctcaatggatgtcttgacaaacgctgtaaatgtaaaatgtaagcttgcaactttcagtcgccagagaaaaccaaggccaaacatctcaacccggttggatttacgccttccgtttttttttaaaaaaaactctaaatatgaatctagacaaaagtacttattcagattcatagttagagctttatttttcttaatgacggagagagtatattagtaccatagattatgtacttaattagattaacaataaaaaacaaatttaacaataggctagaacaagtgtactacgtaaatccattatcttttaaaaatagaacaagtgtactacgtaaatccttattgaagtcaactttacacagctttgactaatattttaaaaggtcttcttatgagaaacttgaatatacgattttcctatcataaaacctatactttgcgatgatttttatgcttaaagttaactcttgttaactggtattctctccgtttcacaatgtaaagattctttaacatcaatataaatgtggaaaatgttataatgacttacactgtgaaacggaggaagtacgtattttaaactagcttgttttttttaatcggagggagtattatgcataactgctgcaagacgaccttgcaacaaaattccgttaaaataaccttattattttctccatttggcattttcaccaataaaatgaatgacaagaagtaacaaataatcagcggttcctatacatatacacatacacatatacacatatacatatacatatacatatatatatatatatatacatatatatatatatatatatatatatatacatatatatatatatatatatatatatatatatatacatatatatatatatatatatatatatatatatatatacatatatatatatatatatatatatatatccgctgaacaaaagatccccgtgaacaaattcaacacaaacctgtccaaaacaacacaaaacaaattcaattagccagcaatcactcgtgcacccaaatcacgtctcccctgcacactgtacgtgcgtgcgtgtcgttcacgggctcgatatcgatcacgtcacgtcttttcgctagtacggcctcacgccgacgtagttgcccggcgggttgtagctgcagacgccgtacgtgccgcggccaccggcgcaggtggcgagcgcgcaccccaccgccgtggtgcgccgccacaccacctgcgtgtagtgcccgcacgccgcggcgtcgccgccgcggcacgagttggacgccgcgtcgtacagcgcgcgctcccgcgacacccacgccgccaccacgtccgcgggcgcccacccgacgccgctgccgtggaacaggttctccccgtacggcccgtgcgagtgcaccagcgcgcaaccgccgccggggccgatccgcgccgccgtgtaccgcgccg

SEQ ID NO: 78055 - DNA, 644 bp, Oryza sativa
atgtggtgtttaatgagcacccttttccatttgccgagtcatcctccaagacacttgctacttaccttcgtcaacggcgcccatcgaccgagcggtgacctcccattgtcggctccacatgccgcctgcctctcccagacggaagaacgactcaatttacacttccaatcataaatccaaataatatatggtgtcttatttgttgaaatgccccaaaattgggggaggtctaatgcgcgaaatgtatgtatcgccgtgtgaacacgtatggcacgccgacaacatgtgtgtcggaaagctcatgcatgtgcgtagggaatccacatgcctttttctttttcaacctttttcaccaccataccatcccataacaaaatgtgaaaaaaacgaaaaggaaaaaaaggagataatattagagagaggaatggagcaacaacagaattgagaagacataagcatgcaattgatatactaaaatgcatgaatgttgagatggatgcatgcatgtctttctctcaacaaaataagtaaatgtatatccacatgaacaaactgagacactgagaactaattaggtaaaaaaaaacctgagaaacgttgagaactaattacagcagcggtacggcgcgtgtgcctaaattatg

SEQ ID NO: 78056 - DNA, 3565 bp, Oryza sativa
atccaaataatatatggtgtcttatttgttgaaatgccccaaaattgggggaggtctaatgcgcgaaatgtatgtatcgccgtgtgaacacgtatggcacgccgacaacatgtgtgtcggaaagctcatgcatgtgcgtagggaatccacatgcctttttctttttcaacctttttcaccaccataccatcccataacaaaatgtgaaaaaaacgaaaaggaaaaaaaggagataatattagagagaggaatggagcaacaacagaattgagaagacataagcatgcaattgatatactaaaatgcatgaatgttgagatggatgcatgcatgtctttctctcaacaaaataagtaaatgtatatccacatgaacaaactgagacactgagaactaattaggtaaaaaaaaacctgagaaacgttgagaactaattacagcagcggtacggcgcgtgtgcctaaattatgtaagtatcctgctgaaggcaaaggaggtaaacttaatttggtttcaccagtgcagctagctatcttcgtccatgccaccaccttgacctgcacacgtacgcaccagatcaattacattacaagctagctagagaagtagagatggatgattgctcactctctcgcgcgcaaagataaagtagataccagcggtactcccagcgcggatggagatggaagatcgtcttggaggatgtggcagtggcagtgttacggaaggcgcagcaagcgcaggagtagaagaggatgagaagcaggaggaggacgacgttgaggatggtgacgttgtgccagtggcgacgcagctgctccagcacgccggccttgcacgagtcgcacccgtagcacagcacgccgggggcgttgctccaccggtagcagtcgggctgctgctgctgctgctgggcatcgtcatagtaggtgcacgcggtgggcggcttgcagcaaccggactgcacgggcgtgaggtcattgcggaggtagtcgaggggcgtccaggcggcgagggtgtcgcaggccctggcagccagcacgcaggccagcgccggcctccagtaccgctccgcccgcacgtggcgctgcagccacgacgagtagtcggcgaggcggaactcacggtagggcctgccggccacctgcgtgccgccccctcccgcggtgacggccagcccgaagacggtgatcccgagcagggccagcacgaggagcagcatggcggcgaggtacagccacagcgccgaggggacgtggtagcaggcgcctaggaagccagccagcgagacgaggagggtcacgaacccgatggccagcagcggcgcctgcagcgcggacccgcacggcgatgacccgccgtgagcctgcagccagagccccgcgccgatgatggggacggacgccacaagcgtcaccaggttcaccaatcccaccaccctgttgctcaggtgctgctgctctcctcccgccgctgcccgccggctatacatgctcaccgatcgatcaaatctaacaatgtagtacgtgcttgcaaattcagctagctataatataattaacatatatagctcccatctgatccagcctcctcttcttgtgtgctccggcctccatatatcgacatcgacctacctagctacttgcgcctctgcaacctactatagcgctctgctttaatttgcttttgcttttttactttctttatctactttgctttacttaacgatgatctggaaccgtctctacttaacttttgcgcatccccaaacctctttttttttcttctactggagtaaactatttcaaatctgttttttgcgcgcgcctgctcttcactactactgagatctatctatctcgtatattcgatatggtttaactaagaacaagcatatataacctgcaagatctaccgagacatgaaaagtgagatttttttttgaagtgaagtggattataaactctcgaatagtcgagagatatcccctcgttgcttacattacactcaaagagttaacaaaaaaataattctttttgagaagatgtattagcatctgatatatcactccacaaatatgcatcttaaattcaacttctacgtgtcgcaacaaaaaattaaattaaactacaactagttaacacatattcacaggcatattgttttttcggtgtgacatgtaaagtgaattttaagttgcatgtttgtggagtgatatatcacatgttaatacattttcttatttttttaactatttaagtggcatgcaaataatgatggaacatccccttgagagtttagaatagttcccttttttttgttttctcatttctcgcaagtagggttaaacttttcggtttagtcgatttgatcggatgtcaccgaaataccgaaattttgaataattttagttgaatttggacaaatattaccaaaattcatgaaaaaaaataaaaaaattgaaatattttggccgaaataatatcgtatcagaggggtccgaaatgaccgaaatctcagaaatttcagtccgaaatttccaagcctgctcgcaggtcattcaaatagctatgatatttttttaaaaaaaatagcaaaatgaattaatatatgtgatatatttctctatggacatatggatttaagctaagttcaaattcgacctatacaagtctaaattgtagaaaaacacgtctaaattctcttgtatcgttaacggtttttgttacatcattaacagttgatcgacacaaaaatttaatgagaattcaaaaacatattaatagatagcttcttggatgatttatggacttgtggcctcatggagatgcgattgacagtgtaaaagctaatgagaatgcaagaaagaatggccatgcatgaaaaggtagcgggccaacaaagcttgttggagtccaacttttgcggtatggactgtaggatatctctctctctcacacacacactaccttttgggctagctgtctttattccaggccaatgtaatgtagggcaggacatctttcgtttctttgttaaatttacatatatcggccatcaatgtgcgggtacaataagctgactaggcgggctccaaaaatgtttctgagagcaggtacaataagctgactagacggactccaaaaatgtgccacatcatcatattcctatgtggaggggagagaaacgatgagagagaagcgagcgagcgacaaatctatcgcccggcgatagctctctttcccacgcgctatcgcttgcttgcagcctacctgggcgataaaaaacacgatttgtggaccccactaaccgcggccgatcccttccccaccgtagccgatcaagatcccctttcccctccacccagcgcccgcccgatctccgcccttcccgcgcgatcccgggcgattgcgctcgatctcccgcgcgatcccgggtgatggcgctcgatctcccgcgccgcgcgccatttctttccctcccacacgcaccatctcttcccctctcgagcgcgaagatctcttcccctcctgacacaaatccaccgaaaaaaaatccccatcta

SEQ ID NO: 78057 - DNA, 15159 bp, Oryza sativa
  unsure (1)..(15159): unsure at all n locations
gagcggaagcggaaaacatctaataccatgaaaaactgagtcaacacgataattgttttaatcacaaccatgagtacataggcatgtacatccttatttacaatcgacctgtagaaacaaaatcgagaatcaaataaaaccggtaatagataagattataaaaccatatctctaatcgtgatctattcatttatatacgtatttctttctgaggtgttggattcttttagaccggtataggttggatttgaaccaagattgaggaataattacatgaaaaattattaatatcaaagtatgtcatttaggggaatatcaaagcatgttttagtttgatatactccctccatctatacttttaatagtcatatttctaaatctgaaaaatttatttttgataggcatatttcaatccaacaacctattatcttaatgattttctcagatttaatgcatgactctccatttttccacacaagattggttacatgggcatcgagaaatatatatatatatatatatatatatatatattaatgaatcgcttgtttacgaggaattactagtagcatgtttaaattgatgataagtagaattacttatccttggtctatatgctaagatgaaatatgattatcaaaactagatagagggagtattaggaaaatgcgcatttggtcgaacagaattactattattagagcaagtacaatagcaaactattagccagctacaaatatattttaataagataaaagatgagagagaagagcaacgggctatagatccgtagccagttgcagcacggactccaagacgcaatgtgtgtatgacaggtgggaccatatactaatagtatagtaagtaattattgtatgaattagctattaggggtgtgtttgaggagaaggagattggggagattgggaagatacgtaaaacgaggtgagccattagcgcatgattaattgagtattaaatattttaaatttcaaaaatggattaatatgacttttaaagcaactttcctatagaaaatttttgcaaaatacgcaccgtttagtagtttgggaagcgtgcgcgcggaaaacgatgtgctttctcaccctatatcacacaaacgaatgcagcctagattgacaatagatgaattggagctagtagtgggctatactattatcggcatgttgtgaggaaaggcgtattttcgtgaatcccgtgtttattcagggggtaacgcagagcaaaacagacgccacgcgtcatgtggtgattggtcctggctacgtgtcccgtttccgtcccagttaacttgtgtacgcgaatgaatgagaaaatttgagtctaatttagcaggcagaactaagagagcacggcggcggcggcggcgatggcgcggtggccgtggaggtggagggtgctgctgccgctgcttctccttcactcctcccccgtcttcgcgcaaggtactgcgacccccgctttctctctctctctctctctttcttgcgcggcggcgcttcctcttggccccgccacccccagccccaaatggcaaatactgcaagtgaatcatccatcatacagataagatgaacgcgagactcgtcatctcattccaccacagcagtgttctgcatccatctgcgataccattggatcgtttctaacacaagatatttggatcttagagccacccttggatcctaaatttaacgggaccactgcatcctaaatttgctatttaacatattgatttcatggatcagcaatgccctaagtttcttttcactccaattagcactacgtctacacaaaatggatgtttcctttatgcctcctggtagactaagtatcatttttcccctcattttttcagaaggccaagataatgatccctctactttgttcaaacgagcctcagaaatgatgaacctaaggaaatatgatggatcacttggtctgctaaatgctgtgttggaggttgacccaaatcactcagaagcttacaggcagcgtgcatctgtgcttcgtcacaagtgcaggtaaaaaatttgtgtgtccgttactttagtttataatccattcatgtttgattcacatattttcctcagttcaaagttacttaccagaaaaataattacttgccaccgccagaaagctaaactcccattttctcttgccccaaaaatgtctaaagacttgtaccattaaagaaccgttaagctaatatgcctacttataacattgtcagttttacacgtatgtgtcacctttccgtatcccttacttgtttcaatgtgttttttctgaagtctaggtacaaggaagcggagggtgactatagcaaatacctggagctaaaacctgggagttcttctgtggaaaaggaattatctcaactgcttcaggctcaaaatgcattagagtctgcttatggccaatttgaatctcatgacttctcaaaagtcctggagtacatcaacaaaattgtgcttgttttttctccaaactgcttaaaggtatatttcagaggatagtaggaatcatggacagctaaatatttcatctaattttgtctcagtaagctgcagtactaaagattgatttttcaggcgaagcttctcaaggctaaagcattgctagcacttgaagactactcaagtgttatctcagaaacaggatttattctgaaggaagatgaagataacctggatgccttgttgcttcgtggccgagcatattactacctcgctgatcatgatgttgcatccaggtaaagcgtatctggtattttaggtttggacaagtgcatgcttgtttgtgcctgcacacacaaatgcagtactagataaatgtgctagctttaaatatttgtacagtgatgacaatattaattgtttaggcactaccagaaaggccttcgtctagaccctgaacattcagaactgaagaaagcatattttgggttgaaaaatcttctgaagaagactaagagtgtgagtatgatttctttgtatcaacaaattaggggcttactgcatcatagtaataggatcaaacggtgtgcatgcaggctgaagataatgctgccaagggtaagctacgtgtgtctgctgaggactacaaggcagccctagcaatggatccagatcatacttcttacaatgtacatctttatcttgggctatgtaaggttctggttaaactcggaagaggcaaggaggctatcagtagctgtacagaagcactcaacatagatggagaacttgttgatgcattaacacaggttacattacttgcttggcatgtacagaaatacacatttttctaatttagagttcgtattattcgatgttgaaatttccgtgaaaaaaagaagggaatttcagtctgattgccctgccattaatgttgaatcttggactccttccgcacactgatgccacattattgagcaagttgtgagcatgcagacatgcagtcgcattagcctgtcctgctaattctgtattttaaaccacaagacttgggaaagctgcaactgttattcagaaaccacaaaaaatgtaattcagtatgcacaatcaatgtgttctgattttgtgagtgaataagtgatgcaaaaaaaaagtaatgtatatttgtttggtagtgttgcaccaggaaactaagttatgcaccagacaatgcaattgaattagttgttatagccagatctcactagtctgttacttcatctgcttgttgtatgttaccttctactggttgcagagaggtgaagctaagcttcttacagaagactgggaaggagcggttcaggatctaaaagaagcttcccagaaatctccccaggcaagttttatgtggacctatctcttttttcccctaccctcctaggcaaatgttagggataagtgtgctcatatatcagcatatcttcttttttgtcgtttgaaaacattcatattgctatttgagttcccatcaaataatctgcttatgtggctacgcggtgtgttgatctcattttcttttagatttgggaacacaatatttttagtgtaattgtgctgcaatcaaattatcatgaaacatagttccaaatggatgaaacatctagttttagtcgattggatagacaatatgcgaaaacaattatttgttttttacggtagtcatctgatgatacttttactccccgtgatgtatttctatttgctgcccttctgccagcaatctttgttatccggtttttgcagcgtgggatcgtaggttgcatatatttctctagcacctatgcatgcaatggatgagttgataaaactagatttgcacattactattgttagtactactaataataaagtggggcaccgaagaggaactttatgccaatgtatttatgaataagcaacaggatctcatcaagatcttaaactagcggaaaaggtgagggcggtcagagtatcgaacatgtgtgagccccgcttgacggctgccccttccagcacagttctcaaataatattgatagttacacaaattgcttctcagctatattacaaataggaagttaacttgttgcttccatgtttctttaacatcaggaattgaatccaaaggtcatgtgcttttaatggaatgctttattagatttatctatctagcagacttggtctctgccccttttctgtatttttttggtacaaatgtaacaacggtttgcactgttcatgctcaggacatgggaatccgagaagcactaatgagagctgaaaagcagcttaagttaagcaaaagaaaagattggtataagatccttggcatttcaaagacggcatcagctgcagatattaagcgtgcctacaagaagttggcactgcagtggcatccagataaaaatgtagataaccgagaagaagcagaaaacatgtttcgagaaattgctgcagcttatgaggtatgaataaacaaaattgaaccgtactaagtatttaatgttctatgagatgacattttctattaatatggttaatttaaaatactcatgcattccaagtttctagccctggtgttgtactatgaataagaactagctgaagtgcatttcatccacaaaatatatcatgctagacaccgcgtgtgtccgagagaaaaaagtgtcccaataacataaattctggtcacccatatttagcgataggcatgtttgttttgaatcagatcgacatgctgcagatgccacgcgtgtcttttaacaatgcgcaatcggcaatttgcaggttcttggggatgaagataaacgtgtaagatacgaccgaggagaggatcttgatgagatgaatatgggaggaggaggtggtggtttcaatccttttgggggaggtggtcagcaatacacattccattacgatggtggattctatggaggaggaggattccccgggggcggctttcctggaggatttcagttcaactttggatagaaagttactgtctgtggagttggagtttgtatgtttgtttgttttaggaacgctgataagcttaacaacaggtattgattgtaggcagtcaggccgaccgaccgatcgatcaagatgagaatcgtatacaagtgttgtttaagcaccatcaaattttccttaagttgtatccttccttgggattttctgacgcatatgatccaatcgaaataaactgagccttactgtggagctagctgtttcactttcactagccaaggatttgcgccgaaaccataaaaaccgaaggtccattccatgtattgtgatcggagtcggcacgcaacagaaaaactaacccaaaaaaaaaacttagatcctctgaagaaacatactgaaccactcgctggaccgtctagccatcagtcaaccatgagcgtcatgtctaacaatctccatgttaactgtaacatctggctagctaactttctctgttttatattgtataagaagctttctaaagtcaaacatttttttaaacttagatcaaatctatatagaaaacataataacattttaacataaaacaaatataatatcaaattatatttaataaaattaattaggtgttttaaatgttgctaagcttttctataaaaattattaaacttaagaaaaattgacttaaaaaaagtcaaaatgtcgtatgatatgaaagggagagaggaggtttaaagtgatttggaagtcaagcatgcaactcctcctgagaaatttttatttgatgatcgatcgatgtttgaacaaagtctgaaaatgaatgctcctaatttgggggcctacggctgcaggaggccagggccatgagggagtaggcgagctgcgcagtatggcgctgcacctcttccctcaccatctgtcgcatcacctgcaacatgacacgcgatgccgatgatgatctgctgctgccgtcttggatctcagaagcagctgccagtgccctgggcggcggcggtgccacctcaacctcagcagcagcagcagcggcgccgggcagggaaaggctaaggctcagggtcagcgacggtagtgtctcctgggcctgggcctggatgatggcgggcggcgtgaccggccgatctgcaggctcgtcgtcgtcgttgagcacgacgatgcagtcaggtggaatattaattggatcgggcagcagatcagggtccttggatttgaatttggcttggcggcggaggcacctccggaggttggagttccagtggttcttgacggagttgtcggtgcggccggggaggaggcgggcgatggtggcccacttgttcccgtggcgggcatgggcggcggcgaggagggcatcctcttgcggggtgaaggggcggtgctgcacggccgggctcagctggttgcaccaccgcagccggcacgacttgccggagcgccccgggatggcgccgctgatgatgctccaccggtgggggccatgctgcgccaccagcctcgtcagcagcgcgtcctcttccgccctccacgaccccttcttccttgtcttgctacacatccccatttaccttcacttcaattccctagctagctcccctcgctcgtcgacaatgcaagcgcgctatatatcgcacttcattacctactgcctgcaacgtccgggcaaaattaaagcaagcaaaagtaataagtccattagcaagtaattaaagtatgacgcacgtatgcatacgtgtatgggcgtctggacgatgcgtaggtgcggccatgtcgcctagctagctagctaactcgtatatcgcacgcacgcatgcatgcaccgatcgatcgatgctgtcttgttcctaccaaaacgtacactacgcttactcgatcgatcacgtagtattcgttgattctttcttggtcgctcgatcgttttgggttaattgcaaattgagattatattggtcctagctagcgagacagataacgactacacgtcgatcgtacgcaggtgcgacgccacagggatactgaaaaaggaaaaagtacgtactattggatgcatgcgcttcaaagggagatagagatagctacgtcgaggtggcgagctagattacaagaacacggacggacgatcgatgtgccacgcccgtttgtgagaaaagctaatttaaccagcaggggaaaacggcatgcatgcacatcgaccatgcatgcctaaattacaaacagtaccagaggtaatatataattttctttcattctttaatttataccagcttaattgccgatcgaattcaccaccgggaagttatttgtcaaaatctctttgatgaatggccaatatatacgctatatatagaaacatctttattttttctaactgctaagagaagacccgtatgtaaaaataaggaggtgcccgcttttgtcatccaacgctacagagataaagagagaggggtcgactgatatatgtctattgagttggttttcccttcttttattgtcacatagacgatgtagaccaagaaacaaatcttatagttggagatggacttattcccggctgaaaacacactggcccagcaggccatcgtcttcgctaggccgggccatcctcttctcgcggcccagcaacccagctcccctcctcctccactccactccggcccggcagcgcacgtacaccagctgctcgtgcaaatgcgcaccagcgccgcccgacctcatccggcgccagatcgccccgccgccaaaccaatctttcctcgcggcggcgtttggtcggcgttatgtagggtaggtcccgccggcagcgaggagtagcgggcgcgatgcgtcaccgttctcttgctgctgctgcttctgcttctgcgccgccaccacaaatgccgccctcgttccacttccattggcgccaccatgctgctcgtcgcctctcctccaccaccgcctgcctccatccacctccactgcaacctcctcgagcgtcggcgtcggcgtcggcgtcgctcctcctccagctacaggaccacatcgccagcggccacctctcccgcgctcaccacctgttcgatcaaatccccagcccggacgttcgcacctacaacgacctcatccgagcctactcctcctcctcaccgaccgccgctgcggatggcctccacctataccgccgtatgctccgccaccgcgtcgcccctaacaactacaccttccccttcgccctcaaggcctgctctgcgctggccgaccaccactgcggccgcgccatccaccgccacgccatccacgcgggcctccaggccgaccttttcgtctccaccgccctcctcgacatgtacgtcaagtgcgcttgcctacccgacgccgcccacatcttcgccaccatgcccgccagggatctcgtcgcctggaacgccatgcttgccggctacgcgcaccatggcatgtaccaccacgcggttgctcacctcctcagcatgcagatgcagatgcatcggctcaggcccaacgcctccaccctcgtggcgctccttccgctccttgcccagcagggggcgctcgcccagggcaccagcgtccacgcctactgcattcgtgcctgcctccaccccaaccgcaacagcaagagcaagctgacggacggggtgctcctcggcaccgcgctcctggatatgtacgcaaagtgcgggagcctgctctatgctcgcagggtgttcgatgccatgcctgccaggaacgaggtcacctggagcgcacttatcggaggctttgtgctgtgcagcagaatgacccaggccttccttctgttcaaggccatgctagcccagggcctctgctttctttctcccacttccattgccagtgctctcagggcctgcgcctccctcgaccatctccgtatgggtgaacagctgcatgctttgcttgctaaatctggtgtccacgccgacttgactgcagggaactcacttctctcgatgtacgccaaggctggcttgattgaccaggcaatagctttgtttgatgagatggccgtcaaggacactgtctcctacagtgcgcttgtatcagggtatgtgcagaatggcagggcagaggaggcgttccttgtcttcaagaagatgcaggcatgcaatgtagaaccagatgctgcaacaatggtctcgctcatcccagcttgctcacacctggcggctttgcagcatggaaggtgcagtcatggttctgtcataatccgtggactcgcatcagagacttctatatgcaacgcgttaatagatatgtacgcaaagtgtgggcggatcgatctctccaggcaggttttcaacatgatgccatctcgggatattgtgtcatggaatactatgattgcaggatatggaatccatggactagggaaagaagccactgcattgttcttagagatgaataatctaggttttccaccagatggtgtcacattcatctgcttactttcggcttgcagccattctggacttgtgattgaagggaagcactggtttcatgtgatgggacacgggtatggtctaactcccaggatggagcactatatctgcatggttgatcttttgtcaagaggtggtttcctcgatgaagcctacgaatttatccagagcatgccactgagagcagatgttcgtgtgtgggtagccttgcttggagcttgccgggtttataagaacattgatttaggaaagaaggtgtcaaggatgatccaggagctagggcccgagggcaccggcaactttgttttgctgtccaacatatacagcgctgctgggagattcgatgaggcggcggaggttcggataatacagaaggtacagggttttaagaagagtccaggctgcagttggattgagataaacggctccctacatgcatttgttgggggagaccaatctcatccacaatcacctgaaatatatcgagagctggataacattctagtaggtattaagaaactgggttaccagcccgataccagttttgttttgcaagatctggaggaagaggaaaaggagaaggcactcatctgtcatagtgaaaagctagctatagcctatggtatcctgagtcttagtgaagataagaccatttttgttactaagaatctccgcgtttgtggggactgtcatactgtaatcaagcacataagcttagtgaagcgcagggctatcattgtacgagatgctaataggtttcatcatttcaagaatgggcaatgcagctgtggagatttttggtgacaacacaacgcgtggttcagctactgagctacggattacaatccgaatcttgattttgaattttatagttcgattcaatgattaatttttatggattatcttcaccactttcgttgctttggctctcttttcatgacctgctgaagaaaaatataaaacactacaaaatatttttaaaaaactttaaaattcaaaagcgctttggataatgaatattgttatatttcatgaccctaatcaaccatgtagaaaaaattgacaaatgcaatcaaactttctttattttttttttaaaaaagaaaggtcatagaccagccttatattgaaagccacagtggcaagggtttaggtttctggggttaacagctttatagaacacaaaagcaaaagatctcatggcataggaaggaatagatgacaagcaagcatttaactgtatagctctgccaacatgagataagttcccacattccaagtatctaatctttcctcaaggggtgttcggatctagggagtaaactttagagtttagtccctgtcatatcggatgaatttggagtattaaacatagactacttataaaactaattacataaatgagagctaattcgtgtgacaaattttttaagcctaattaatttataattagcgtatgtttactgtaacatcacataggctaatcatggattaattagactcaatagatttgtctcgcgaattagttcagggttattgaatgggttttatcaatagtctacgtttaatatttataattagtgtccaaacatccgatgtaataggggctaaaaagtcatctaaacagggcctcaagtttctgccataggaatacaaacaaacaaggcatctatttgtagctaaagaactccattgccaaatatttgatttggttgaactggcacatttaccaaaatttcatatcacctaggatattcagtcttacgaaaacttcgacagcataatcaccgaatattgtgcagtgcatatgaactattatatttatgatgtcgtattaccaaannnnnnnnnnnnnnnnnnnnnnnnnnngcaaggctcttaaccttgtggtcgtgggttcgagccccacggtgggcgattatattattaatttttgtgcctcaaatttcctaataaaaatcactccagtcgcatataaaaatttgcaaatccgcctcaaaacccttatatccttttccacctcgaatccctaataaaaatcactccacaactccagtcgcatataaaaatttgcaaatccgcctcaaaacccttatatccttttccacctcgaatccctaataaaaatcactccacaatcacagataattcttttttttacaaatctacctcaaattcctgatctcctttcccgcctcgaaatttaaaaatccgcctcaaatctctaatctccttttccacctcaaatccctaataaaaatcactccacaatcatgtataaaaatttacaaaaccgcaaatccacctcaaatccatgattttcttgcatatcattctgtgagcataatctcctgcattattaatttgggattatgtgtgttctatgtttccgatggacgattgattatagatgttgagtttgtgacaattactcgagtagattaaatattagaaggttgataagtttttgttttttctggcaaaggttgattgtaggtgaaaatgttctggaaaaatcataaacttaaggggctgtttggatgcccacctcaatttaccacagtttttataccaaaggtgtggcaagatgcaaattatgtggctcaaaatttgatggccacacttgtggcaaactttagctaagaaaagagtctatgactagtgggaccaaaagagtagaaaggaccaaaagagtagaaagtgtggcatgccaaagttatagaaacaaaccaaacactagccacatttcgttaaactaacatacctcaagtatggtaaaatgtgacactaaccaaacaggcccttagccacagaaagggctaagctgctgttgccttgaggagcccttgtcgaagaagcagaaagcaaaggatcagccagcattcaactgggctttgaacaaaactgcggggcaggtttgttctgctagattttgtttctttactgtaacattgacaaaccttgcttaagcatttattctgattacaagtattgaacttgaatcatgctttggagtttggagcatttgattgaactccatccgcatattctgcccacctggctagctgctttgctcatgtattggatgggaatttccagttttgacgttcgtgggacatgatttttctcaatcacatactgtacagctgtttggttgcacacttgtactgttgggttgaactgaacatagcaatttgtgccaaaatttatgtccttcctgggtttagttgcctggcttaaagcaggctaacacccctactactacctttttctcctttttttttttatttttagcatcccgggatggctaccacgtaatttcttttacaacatgctccctggttgggcagttggaaccggtagcatgcggttcaagtttggtacctcccaccccatgtgtctggtctccccctacatgcatgccacgcatgcactagcaattttgcaaagggtagctttatctatatgtattttcaaattcattatatatagggagaaaaaaagacaaaattctaaaagatttatattgaaaaactatctaaattttatctttttaacgactaaaatacaatgaatttgagattaagattttacacataagtgtgatgctattttaagtacttgtacaatttttcctagattttttttgataaagtttgttactccctctgtttcaggttataagatgtgttgactttaatcaaagtcaaactgttttatagacaaatatagtaatatttacattaccaaattagctttattaaattaatattaaataatttttataataaatttatcttgggtcaaaaatattattatttttatccaaaaacttggtcaaacttaaaatcaaagtcaaaacatcttataatctgaaacggagggatttgttcgttcgggttgggtacccacctcctccgcacgaaaaacggaacgatccattagcacgtgattaattaagtattagcaaaaaaaattttcaaaaatggaaccgttctccctcttcttttttccatctatgtataaggtcaatataattttttaagcaacttttgtatacaatctttttgccaaaaacacaccatttagtagtttgaaaaagcgtgcgcgcagaatacaatggagaggggttgagaacacagagcaaagagtatagcgaactacaacatccaaaacatcaatagccaatttaatagtaaattcatataatagttatttactatactattaatatctaatatctagtcccgcattccatacgctcgttacgtcttatagtccgtgctgcagctggctacagattcatagcccactgcccttctctctccctttttatatctttaaaatattaaattcatataatagttatttactatactattaatatctaatatctagtcccgcattccatacgctcattacgtcttatagtccgtgctgcagctggctacagattcatagcccactgcccttctctctccctttttatctctttaaaatatatttatagctcatagcccactgctctcctctctccctttttatctctttaaaatatatttactgcccttctctctccctttttatctctttaaaatatatttatagctcatagcccactgctctcctctctccctttttatctctttaaaatatatttatagctggcttatagcctgctattgtacctgctctaatggagtacacgaaaaagctggtgtgcgtctagttacccaataggcacggcatactaaaccatatcagcagcacacgtgtttcaggagtttgatagacaacttattactaagctacaggtgataattatcgcattttgaattacgggacaacggagacacatgaactacatatttttatctaaccttcattaaatttgtaagacaaaacataataactacggagtataaatttaaatttctacggtgcaaaaaaaaaataggcatagcgcagcacagccggactagaaaggagtttggcacaagggacacgttgatttgttggatgttgagaaccacttgtagaggcaagcaccatgaaacttatgcctgcacgtcttgcaagccagccggggaaggctgtggttgctcgtgtgcagaatgctgtaacagattgggcattcctccaccccctcaaactccttgtcaaaattgcttttccaagtgtggatcgcctctgctattgcgccgttctgtacacaca

SEQ ID NO: 78058 - DNA, 9100 bp, Oryza sativa
acctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtggtggacaagaatgaccgacgtgacgggtctgacaccggtcatgtcgtcagcagacagccacgattccacgtcgcacctgctcccggcgaaagtggaggtagttgtgggccgtctcatcagaagatgactcggacggcaactatacaaatctccgtccatttatgaaaaggtggggtaagtccccacaaaaaagagagaaatggtgcatgtggtatccccttaagatataaaaggaggacctagcccactgagagaggggactgatttttccagatagggaacccagaacaagggagcggctggctcatactttgtagctccttcatacacagatctcccaaaacacaggagtagggtattacgcttctcagcggcccgaacctgtatacatcgcccgtgtcttgtgtgtttcctgtctcgcgaaccttccacatacagagagcttagaatctcaccctgagtccccggccgaaccggcaaaggggggcctacgcggtctcccggtgaggagccccacgctccgtcaatatgttacttcgcatttatcctaatacatttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaatagatggctgaccgcgatgaggaacagatattgtacgatacaatcgcggagggaagcagccaatactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccaaattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgtcgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgagtatcgagctacgaactcaacatgcaagaggaggtggcaaggaaggttgatgaacgcatggccgcacatcggtcccatgatccccagctgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattctgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcaaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcagagcgaggatcagggacacggacttcttgcaaggagatgacattctctggatcaatttcaggggaatctacgaactataccagctagacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacttcgaaatcgtagctagctaggacatataatggattgtaattaatacatgactacatatgtttctatatgcatgtatacacattttctataatgtaaatatattttgttcatatatatatctatatacatatgcatttgcataacatatatatgtataaatacatatacatatatatatatatatatgtgtgtatgtgtggataatgatagaaagttttataatatgagacggaggaactagtcaactggacgtggatcgatggataattgtggtgcgaagctgttatgtgcggtgcaatataatagtggtagatgcatgtcgatggagtcaaacaagtggactatacatactgatcagctaggtacgtccaataagtcaaaggaagggtcacggggctggtggcatctctcagctggcactaattaattaagtacgagtatattagagtacacgtatatatgcttaattcctgatttatttgctatacatacagtagctagctagctaattaaggtaggcggaacgaacagcatgcaggcacaggctcttgagatgtaattaagtaacgtatctctagctattgcctttgcaatacaaagcttgccgatcctacctcgaggtagctagtagttgttacacttacacatcaatcacaacttcacaggtagatacatatactcctatatagtaatatagtttggatctgcatgcagcctactactactaacccggtttaattaacacaatttattatttactactaactaacgtacatatttctagcgattagcttgcaactaaaagacagatatgtataaatggagatatatatcgtaggagtatcacatcatattctagcatgatgcaaagagatagtactgtagtttggccgacgggattgatatatcaatgcatgcatgcatctgcatggatcgatgcatttgctgcctgtcaagtcaagtcagcctactctggttgagaatgaatcgtatgctactatacttattattattattattattagaatgaattgtactctctccgctttaaaaaaaatcaatcctaagccaggattgttttatttacagagtttttttattgtccttgacaataagcggtaccaaatcgtagccgtcgatctagcgacatcgaacggctgcgattggtccgtactgcatggtaccgcaagccccgattgaggaggtaccgcgagtgggagggtaaactagtacttccacgtccgagctcatccgtttgcggtgctttgatttgcagccctttgggaagaagggctaaaatccaatgcgagctcgccatagttttcgttcgctggccgcaactggtgagcatcgtggacccaaatccattgccgccaggcagcatcagtgccgtctgctgcattgtcgactatcgccgttagggatggatttggaacccacggtggacgccgccaactccgaccgtgccagaagtacaagtccggccgcatcgccagccgccgtcgacgaggggcagagagggagcagcttcccctgggaaaacacctcgaaggacacgcaactttccttcttactgcctatatgctcgattccacggcaaccaaacgcgttcgtcaaagtagaatccacgaagccaatctggtgattcaagacgacccgtactagcagcggcggcgcgacgacaacacactgagacaattcgctcaacaggcgaggatgcgacggtggcctcggtgagggcgtcgatgcgatggcggccgctgcggcgtggatgcgacggcaaggacacacgagttgggatggcggtgagagctcgcaagggacggaaagcaggaggattaagaactacgcagcgacgacatctgacggcctcacctacctttcggtctcccgcagcgacggtgtcgttcctcaccgatggattttttagcccgatcctacccctcctaaaccaacggtcagatttaattggtacctggtacctcatagtaccttctcaagaataggaaaaaagtatactactatacttattgctattactgttactccatgtgaagcccatacaacactaataattatagtgacttgagtagcaccataatattctaagtttaaattttcatagattaagccaatgtgaactgttctccatagatcaagttttactgtgatgtactgaactgttttttttttcgtttttaatttctaggagctgaaaaaattaaggcaatgtgttgaccattcgatgttgatccaacggatggcacaaatccccacaccgcacgacacctcggctaacaactggctgagcgtcaggcaaggcaaaggggtccgtcctataaataaaggaaacagaggctgctcctttatagcttcaaggtctgaaatcttccatccccatccaggactttgatgatctcttctcttgagtcttgatccatccatcacccacaataatcctaatcacaagtgggcgtgagagagagggggccagaaggtcaacctttgatttaattagcaggcaggaattaagaggcagctaacagtagcagtagcacacaatcaagctcaaccctcatatatcccgtgatccattgttcagacctgccttattactagctgtagagatcttaattttattgtaaagcaaagctctcacctttatttataactagctgcccttcccttgcatcctattccttccctgcatcagagcagcgagctcgctctccatcccctgcgtgccatgggcaactgctgcggaaccaagattagctccgacgccatctcccggaacgcatctggtaatctagcttcttcaattcgctctcgtatatatttcaccatctagctagctgcataggacgtactaggagtagatagattcttgattcaagtaaaaaagtaaccgctgagtagtgaggcatgtatgattaggaatggagatgttcgtttgtgcctgcctgcaatttgttgatcattcctaattgcttgagtttgttgaaatcgatcctagtaggttaggtagatcatgccgtttccagttccagttgaactgaaataagcgatcggtttcagacagagacaggacgacgcctgcacatactagtagtatatcatcttgtactaatccttgatggactagtatagtatgaaatcattcacttttgtaactaaatattatggtcatctcaatcaatctgagaaagaagttgttatatagatgaggcttctgcattgtgcggtggcgttaactggttggtaaattgacaatgcatgcgtatgatatgagctcattaattggtggtcaggttcaagaagaagaagatcaggaagcaggaggaaggggacggggctgagcagccgggtgtcgtcgtcggtggcggcggtgaccccacggagcgagggcgagatcctgcggtgtgccaacgtgaggagcttcgcgttcaacgagctcaagacggcgacgaggaacttccggcccgacagcgtgctcggcgagggaggcttcggctccgtcttcaagggttgggtggacgagaacaccttcctccccagcaggcccggcaccggcatggtcatcgccgtcaagaagctcaaccaggacggcttccagggccacagggaatggctggtatggattttctttctttctgcataactcttgattgatatactactgtagtatataataacttgcattttaatttgcaggccgaagtgaactaccttgggcaactgtcacacccaaatcttgt

SEQ ID NO: 78059 - DNA, 649 bp, Oryza sativa
tcgccaattctattcattcatatgttttgtccaaaagttgaattcccctataggaaaaagaaaaggagtcccagcatgctaggtgcttagtattttttacaggacctggattcttactccgattttgcccctcaacactgttttcttttatatttgtcttctctacattcctctctaccaacactgtcattatgcatcaccctcatttccattgatcctcagttttcaacatgcatatttcaagctcaaggtttttcgaagtgttactgcgattgttgactatgtagaccatgcttcgtaaaatataaattgttgtctgtagagaggaaaatggacaatagacaaagaggccaactaagctaaagttcagcaagggagataaaaggcattatagtatgatctgctgagggcaagactttgcttttcttttagttcaaagcttaattaacctaaccaacagtaaagattcaatagtgaggaaatttagtctaatatgaggacagatcaaactgagatatcacacctcaatacattagcactatttattgtacttataagttatttcgacacagattaaaaagcatacatattcagatgatatatttgactcacatcaaaaaaatgaacataagcatataagaaagccata

SEQ ID NO: 78060 - DNA, 13922 bp, Oryza sativa
gggatctttatctaaaattatttttagtcccttgctgtaaatcaatctctccccacaataaccctaaaccctaaagtgaggatatatttgcgactacccacaagtgaggatatagagcatatactacaggttaacgagtctcgtggctttccaagtatgctaaggagtatagattgcatgcactggaggtgggagagttgtcctagagcttggaggggccaattcacccgtggtgactacaaagtcccaacaattatccttgaagtggttgcttcacatgacctttggatttggcacgctttctttggtgtcgctggttctaacaacgacatcaatgtgctgaatcagtcccctctattccttgaacaagttagaggggaggctcctcgggttcatttttttgttaacgggaatgagtataacaatgggtattaccttgctgatggtatatacccagattgggctagcttcatgaaatctatatcacttccacaaacagagaagcataaattgtttgctgaacgtcaagaaggggcaagaaaagatgtggagcaggcttttggagtgttacaagcccgtttcaacattgtgcgctgtccagtgaagaagtggaaacggaagagtgttgggaaaatcatgctagcttgtgtgattctccccaatatgattgttgaagatgagagagaggatgcgatatgtgacattgacctcaatagaattcctaggacatcaatagtcctgcctcctgaagtaacttctggtgataatccatgttttactgatgtgctacgtagaaaatctgctattcgtgcttgttctgtgcatacccaactgataactgatttaattgagcatatttggcgtcggtttggacataggcaacaggcataaacatggtagggtaataagcatgtggtttctttgccttttctttgccgtgtgtagattatatcaattaacccttgtgtctaatttatttcaggaacatgctctgctcagtatgtccaaatcatggtgctgcacttctcaaaggtagcttatatgaactaaatttagtactaggccagattacttacagacacattctaatgattctcttttctttcttgtgatgatttacttgaactaaatgtactcctagttcagactactaatagccacagttcagtatttctcttttctttcttatgatgcagtagcatggtgttttgttattgcttttacctgctaaactcacttttaatttacttgttatgcatctgggcatactgcacactgttacgaaatggtcaatgaaattctcaatttttatgacagtgcaactatttctttgtaagatataccaactgcagaaaaatgcatgtactgattactccttttagtgaggtttcactgaaaagagatttcattgtttcatttattcatcaagtgacaaactactcaggatattatatgtgtttttcttctcccattaggttgatgatagctcaggcaatggtaatatgatgcaatgatcctgctatcaagggtctatcttcgatgaagaaatcagtctatcttcgatgaataaatcattctcacttgttggacagcatatttatatgtacttttgcttaatgccctattgttgatgtgacttttggatctgtaaaccgttatgtttattttgctttatcctctattaccttgtcagttctttggaactacagatatctttcattaccatgtccttttgttaagacttgtgttcggactggcatgatattatcgattaatctatggtatttgagttattgttatgtagtaatactgtcttgtaattgttatactatagagattttggttgatatggtatgtgaatatgctattggcacaactggctacaaagatgcaattcactcttgatcacacacattgatatgtgcatgatataatttactatttgattatgaggtgtagccagccaacagactatctattgtactagtagctgttgagattatgggcagcatataatgatttaatttattccataaataaatcatgacattacagatgaaaactagcatgaacgcatcattagatctacacatgtaaactacgcagaataacatgaacagatcaaatatgcgcagcatattgaacacgtaccgaggtgacgaaaagaccggctgcttggtcgaaacttttcacaggtgtctacgaaggcacgaaacacgcgagcgaagaggaaggcgagccgtcgcgaacgaacagggagcagtcgcgcgaagcgcttcccaaaaaccttattgtcgccttctcccggtgcaggacgtcaaaggcagaggttccggagacctgctctcctgatcgctggtgcacgccggcgagcgggatggagtagtctacgagcgacggcgcagtacagagtaggaggcaaaccctagattgattttcgcattttttgcgtgaagacggtgggtcggtttatatagagaagggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgagcgagcgcgcgcgtgtgtttctcctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacagtagctggctttagcaaatagctattagtcagcaactggctatactattagccttgctctcagggcggtgccgatgcaggctttggtttgccatagtacgagtattgtgctactggttgctactgcagcgttctagtagtagtccatactggagtacgctgcagaggcaggcgtgacagtaagggaagggaatgagagatcctatcatcaaccgcaggagcagtaacacataatgtatcactagtaccttgtaccttgcagacacttgagaatgaaatactactggaggtgggttagctttacggttggttatttaatttagtttggaacttgatgggatgggatctcactctgctttaatcgcactcgcatcccactgctttgctttctcctgatgcatgatctctttccctctcccctgcaggctgcagctcacagcttgcattgtactagtacactgtactactctactccattggactccaatagcactatcacactcgcatttcatctgattgatacagtacttattcactggagtagtatttcccagccaaagttctctatcagtgcccttaagttatagcattagctaatttgggtgttggtgcctggctagaaggagctactctaggtaattaagatgatggctcctctctgctgctgcctcctgcgcgcgcggcggctcctcttcttcttcttcttcttcttcttcttcttcttcgccgtcgccgtcgtcttgttctcctccgtctccgtcgcccagatacctggtgagtctaataatctctatattttattttatggagttgtgggtcagtgagtgagatggtacgtaatgcgtgggcagggttccagagcatcgactgcgggggctccggcaactacaccgacgaggtcgggctggagtggacgggcgacgaggcgtacgtgggcgggggcgcaggcacgacggcgagcatctcgtccatctcggggcaggggcggcggccttacaggacggtgcggtatttcccagcggacgggcgcaagtactgctacagggtgagcgtgaaggccaggacgaggtacctggtgcgtgcgagcttcctgtacggcaacttcgacggcagcagggtgttcccggagttcgacctgtacgtgggcgcctcgcggtggtccaccatcgtcatctacgacgagtccaaggtggtaacgagggagatggtggcgctggctcagtccggaccctccctctccgtttgcttcgccaacgccaccaccggccaccccttcatctccaccctcgagctccgccctctcaacgcctccctctaccacaccgccttcgaggccgccttcttcctctccctcgccgcccgcatcaacttcggcgcccccaccgccgatcccgtccgctaccccgacgacccctacgaccgcgtctgggagtccgacatggcgcgcaggccaaacttcctcgtcgacgccgcgcccggcaccatccgcgtcgccaccgacaaccccgtcttcgtggcctccggcgagcgcccgccgcagaaggtgatgcagaccgcggtggtgggcacgctgggcgcgctcacctacagactggacctcaacggcttcccgggcagcgggtgggcctgctcgtatctggcggagatcgaggacgacgcggccgccacggcgcgaaggttcaagctctacatcccggggctggccgaggtgagcaagccgacggtggacatcggagagaacgcgccggggaagtaccgggtgtaccagccgggctacgacaacatctcgctgccgttcgtgctccccttcgccttccgcaagacggacgactccgccaggggccccatcctcaatgccatggagatctacagctatatccccatactccctgcctcgcccgacgccgtcgccatggacgccctggcggcgcgctaccagcagcagcagcacagctgggcgcgggagggcggcgacccgtgtgttcccgcaccctggtcctggctcacttgcacctcatccagagtcatcgccatgtacgtacgtcgtcactctttcaattattcccgggcgtttccttccttggagtagtaacgtagtacggaacgggtgcagaaatctttcaggaaacaacttgacaggcgccattccaccggagctagcggcgctcccatgcttacaggagatgtacgtaacacaagcgactgactcgctcttaattccattaattaagctgatcgatgagctctcttctctgacgaatttgcagccggcttgacaacaacatgctgacaggcccaattccggacctcagtgcttgtacaaacctgacagtcatgtgagtaactcaattcaccacttgcacgcacttgcaccaggcttatttctgttttcctttttctatagtatatactccttatgtccatattataaactaacaatattgtcgaattgaaattttcttttgcagacacttagagaacaatcaactggagggcggtgtgccgtcatacctaagcggtctgcccaagctcagcgagctgtgagtcttttatatactgtatgtactactatatatcctagtctaggaacatatataatagtaccatataagtgagagatttgttaagaaaatgcatgctgataattaaattataagagaatcggcatggtatgtataaaatgcaggtacctagagaacaacaggctgtctggagtcattcccagggctctgctaagtagaaccattgttttcaagtgagtgatatatatgatgtatgcctataataataatgaaataaaatgaatggtgaaattaattactccaatatatgcgcgcggcatatgtacgtatgtttgcaggtactcagggaacaagcatgtccgagtggggaagcaagaggaggaggagcggaatgtgataattgggatatgtgcgctgatgggaataggcttgttgcttgcagctgccctgtgctatgcctataatgttagtgttagcgggaggaaacaattacaaggtgctagtgcgggtgggaacagcaagagcaagagcatagtcgtgtccgcggagcagaagaagaaggcaacaccagtagcaggaggaggaggaggagaaatagacaacatgatggcggctatggcagcgcggggtccgttggagttcgaggtgagggagctggaggaggcgaccagcaagttcgcgaggaagatcgggtcgggcgggttcggggtggtgtactacgggaggctgggagacgggagggagatcgcggtgaaggtggcgagcagcaacgagtcgatccaagggaagaagcagctggccaacgaggtggcgcttctgtccaggatacaccaccgcaacctggtggcgttcctgggctactgctgggagcgcgacagcagcagctacatgctggtgtacgagtacatgcacaacggcagcctcaaggagcagctgcagatgatgagcatcagctggctccggcggctgcaggtggcggaggacgcggccaaggggatcgagtacctgcactgcggctgcacgccggccatcatccaccgggacatcaagaccagcaacatcctcctggacgcccacatgagggccaaggtgtccgacctgggactctccaagtccaacaaggccaccaactccaccaccaataccatcaccacccacgtgcgcggcaccctcggctacctggacccgcactactacgtctcccagcagctcacccacaagagcgacctctacagcttcggcatcatcctgctcgagctcatctccggccgcccgcccatcctgctcacgcccggcgccggtgccatggccagcctcgggccctgggccaagtcgcactacgagagcggcgacatcgaggccatcgtggacccgtcgctgcgcggccgctaccgcgacgtgcactcggtgtggaaggtggccgagacggcggtgcggtgcatcgacgccgatccccgggggcgcccgtccatgcccgaggtggtcaaggacatccaggaggccatcgcgctggagatgccgtcctcggagtcggagaggcccgccgccagcttcttctctccgggggcgggggcagccggtgcgcgctcctcggcgacggtgcggtcgcacgacctcgtcatggacaacctcatgtacgactccagcttctgcgattccctcaacctgccccgcacgcccagatagagacatgctcgatcgtctctactcctatttttctgtttaattacttcatcacgcgtaaattacgcggctggtattatctttttataggaggctggtattgtttttcacgcttacatttgctatatcatatttatttctatctacagatattctcttaaattgagctatcattgcaaatattattgtttttcaaacatgatatattaactatgaaatgcagagagatgagaaagaataaacaccatggataaaaataaaatattaatttttaacctgccccgcacatccagatagagaaactcatctttactcctagttttatgtttactttattatattaactagcatcattatattttctctcatataataagcatatgtattttcttaatttattatttaaatatattaaaatgacaagttttaaattttgtactaactttaccaaaatactaatgtgtaatattcatactgtgttttatatacgtgatagttattaattatttttaatatcaaattttagttatttctaaattatattcctatatggactatagactcgtcttccaatatttcttattttttattctgaatttttgttacttgtaaattgtatttctatataaactctaagctcttcttccaatattatttatttctaactctgaattttcattatttctaattgtatttctacgtggaatctaaactcatctttcaatactcttgttttttaatttcaaacttcagttacttctaaatagtatttctatatggactctaaaatctacttttaatttttttcccaaaattttagttcattctaaaatcctatatggattctatatttgtgaacttttgaggtcacaactacgatattttcatgttatggagaccgttggtaccaggggtatatgcgaaattaaagtaaaagagacgtatgcaagggtttatacaggttcgggccccttatctgatatgtaatagccctactcctgttggtcgtagccgatgttgctttatattcatcagaatcacacaagtacaatatttgggataacctatctagttgtcgtcgacttggcgacatagataaccaacacgtagtcgacgacagggtagtctttctcctcgagtacgaactcattgagatcagatatggcgctatatccatcttgtcggcctccgcaggcaccattaggtctatctaggcttatctctgatgtcgatgtttgacggcgtgtgttggtgtctattctgacttgtgtgtcgatcggtctgtccctcctcctcctagaaggtcttgtatttatactcatagatgttctcttgttcaagtagaattagggagaccaatatggatacaatacgagtaatccttgtcgttttcatatagaactctactcgtccttcattatccgaaactctttctatatttgagatatgattccatataagacttgtgtatggtgggtcctgccgagcttagtgggtatgtggtatccataaccatgacaatactcttcttctaatatttcttatttttttaattctgaatttctattatttcttaattgtatttctatatggacttgatacccttcttctaatattctatattttttaattccgaatttccgaatttccgaatttctgttatttctaaatggactctgaccaaattttaatttttctatttttaaattcggaatttctattatttctaaattgtataccggcatggacactagtctctttttcaatattccttaatttatttctagactgtaagagcaaatgtggaggtttttttatttattactttaataagttgttaatagaagatttctactggtagtagtattcctactgtactagagaagtatgcaatcaataatgtacagtataactctgttgacttttgaatgactagcaaagttagtactaactaagtacactaatataaaaaaaagacacacatatgcgcgcggtcagtagtcagagttttgggcttagaatgaaggaacggagtgaatggtggatgggcctttattgggccgtagcaggcagaaggaaagggaggcccagctaagggccgaatgggtcaattcacaagcacgcgggcgggcggggggagggatggattagggtttccttccttccctgtcgtccccgccgctccactcccactcccactgacccgagacgccgccatttccgcctcttcttctcttaaacaaaaagccaacccctcccgcccccgcccccgcccccgcccgctaaaccctaaaccccaaatcgctctctccatttcccgccgcctcccctctcgcgatccatatccatccatttctcttggctctccgcccgatcaatcgatccgcccccagatcgcggccgccggtagctagctgcagctgcagatggatatggattcttcctcctccccggtggacaaggtggatcccgacgagtgcaacggctctaaggcttgcgctgactgccacactaccaagactccgctatggcgaggcggacccggaggacccaaggtgaatatcccattcttcttcttcttcctcttcttcttcttcttcttcttcttcttcttcttcttcttcttcttcttcttcgtttggtttctgtgtagtcgtatgttgttttgatctgatccgagatccgatccatgatcccttcttccagtcgctgtgcaacgcatgcgggatccggtatcggaagaggcggcgggcggcgctcggcctggactcttccgccaccgccaccgccaccgacggagcggagcagcagaagaagactaaggccaagaaggaaaaggcacaggaggaggaggtcaccatggagctccacacggtgggcttccgcagcaaggacgctgctgtgttcaagcagcgccggcggatgcgccgcaggaaatgccttggcgaggaggagagggccgccatcctgctcatggcactctcctcgggcgtcatctacgcctgaacctccaaccgaatcaacctctggcgccatggcaggaagaagaagcagcgattccttcccctctctttttttccctccccccggcgctatggcagtcaccgaagctagctaataatcaatcttgtcttgtggtgtagtagctcttgttgttcttgccttaagctgtaacgacgtctgtaatgcgactctttgtctgtgtctctgtactagtactagtagtagtagtttaccgcctaacattcaagtttggtttctctgcaatgtaacaagagaagaagaagaagaagaagaagaagaaaaaaagagctaaagctggagcttgagcttgagctttggttattgatcaatcatccatcctgtctgttcgtgctggtactgctacttctcggttggttgtgcccctgttactgtgactctatagatgatgatgtgcctgcctgtatttcctcctttgatgcgttggtcaagtcacagaggtcaaagggaaaagccagagccattactactacttgtgttctcatttggcgtatataaagtactagtctacatgatcaggtgttactactatctctacttatagaaagcaactgtgactgatggaggagtcattggccctcttcttttctccaacaaaagttggattaagggctctttgaatcaaaggattgagaaaacgtaggaacaggaaaaatataggattttgataggaatgtaagtgtaaaacagaggattgcaaaacgcatgaaaaacacatacgagaaacctaatacgcgcgccggcaacacgcactcccggcccaccgacgcgtgcgcgatttttcttttttctcgctaacatctatcgtcgttttctttttttcttttttgctttttacgcagtttgatgccgtatgggtaggagaaaaaatcataattagttttactagtgaatagtttcctatttttactagtaatttttaattctgaacttaaaattttttaaatttggacttgaaagttttcaaatctcgaggtgaaagtttttaaatctggatttgaaagttttcaaatcttgagtttaaaatttttcaaatctcaagttgaaagttttcaaaattttcaaatctaaacttgaaagtttttgaatctcgagttgaaagttttcaaatctcaagttaaaaattttcaaatttcaagatgtaagttttcaaaattttcaaatctggacttgaaagtttttgaatctcgagttgaaagttttcgaatctgagttgaaagttttcaaaatttgactttaaaaatttaaatctttaagtcgaaagttttcaaatctaactgaaaattttttcaatctattagtaaaaaaatcttcactttttttttctaattactgtcattagcgttaactaaggggttagttacgcgcgcgcggaagtgcgcgtcgccggcgcgtgcgcacgagctagcttcccccaaacacaggaatgaccgtttgattgaaccgtagaaaaaacgtaggaattggatgagagagatagactcaaaggaaacataccaagaggttgaagctcttgctaaatttcctccaaaatctctataggatttgtccattccataggaatttcaaaggattagatatgattcaatcctttgtttcaaagggcttcataggaaattttccattaggattgaaatcctccaaaattcctatgtttttcctccaaatcaaaaaggccctaaattttggatactcgtggcacgcttttcaaactgctaaacagtacgttttgtataaaaactttctatataaaagttgctctaaaatatcatattaatatatttttcaagtttgtaataattaaaactcaattaatcacacggtactaccacctcgttttacgtgaaacacttaatcttcattttcatcttcaggagattcaaacaccaccattgtgcatcgtcaaggaaaccacagatctttggacccattgtcgaccaaaaatccatcattaaatctttagattttactccttccctcccaaaataacttaacctagaatgggatgtgatccatcttaaaacaacgaatttggacaagcgatcattagatatgcatcgtgattcatgcgctaaggtgcttcttttcctactctgacagcctcttcttctccgataccgataaaagcttaaatttcgacagagtacctatgaattaaggtcctggatgggggttggagggggaaggcaaaagaggaggaagtcatcggacttagagggataaccatgggaggtacctacgaattaggggttctggatgagggttggagggggaaggcaaaagaggaggatgttatcgggcttagagggataaccatgggaggtgacggcggtgccacaccgaagccacgagatcaataggtagtggtatgttggtgttggtggcgggagcaaaacagagcaacatattaagaggcactgagcggtggtggtggctgatctggcgacggggagccatctgaataggggcacctcactattgttggattggaggagggaggagggagtagaccagcccaggaaaggggatgcctccctgtgccgttgacgtcttctgcctagccgacaagaccgggtgataacacgctatgcggaggcaacggtgagaggcatcaagcgtcgttcaagaatgcgacaccgaggggaaaagaaaaaaaatgaaaggaattaaggttgggatatatgcacgaatctcaaagtaatccaacggttaaaaaagtatttattatatctattatattattaaaacagctttgaaaagagacaccatgtttgctgtgggggggttagaaatttccacattaatcggagaaaaagaaaaggaagtccaagtaaaaatacaacttaaaaatagctgaaattcagaattaaaaatagacaatattaaaagaagagtccatataaaaacctaatacaagattaatcaaaattcgaaataaaaatataataaaatctgaaattagaaaagaaaatgagagtccaaataggattgcaatttaaaaataaggaatattgagagaagagtatatataagaacccaatacgagtttaattaatattcgaaataaaaataaaaataaaaataaaatccaaaattagaaaaagaaaagaagagttcaagtaagaatacaatttaaaattaacttaaatttgaaattgaaaataagcaatattgaatgaagaatctataaaagaacccaatacgagattaattaaaattcagaataaaaaataaaataatatccaaaataattaaaagagacttcaagtgggaatacaaacaattttgaaacaactgaaattcaaaaattaaaaataaaaattttaaaagaacactatatgttattaattaaaatttgaaaaaaaaataaattctgaaattagaaaaagaaaaaaaagatttcaattaggaataccatttataaataactaaaattggtgatataaaataaatactattgaaaaaaagaccatctaaaacccatgacgcgataaattaagtaagaggcctataaaggagtagagtagtggcggttaatacgacatataaaaactattagtaaaacaacaaatagaatcctagtaatgattaataggagagacgacaggcatgcagtgaagcagatgggcaaggtggttgctggtacttctagaaagaaaaaaaaaccccattgataattatattcgatttgtaaaatctcaatgacaataagaaggagaagca

SEQ ID NO: 78061 - DNA, 605 bp, Oryza sativa
tatggaaaacctcgtggagatgcttcttgtcgcggggccaatcgtcgtcgtcgggttggggttggggatcgtcgttggcggcggcgctggaggcgaggctggtgcccctctcggcggcgtagccgctgctgctggggctgggtggagccacgtcggcgtcttcgaggtcgtccttccaggcggaggcggaggtgctgatgctccctaccctggagacggcagtgaggtagccctcgtcgtcgtcgtcgtcgtagtcgtcgtggatctcgaagtcgggagggaggtgagaggtgcggagggagagggaggcgagcctcttctccggcggcggggagtcggggggaccaggggggctagggttattggtgggaggatccatatccatggggggccttcccgacgcgatgccgatgcctcttcttcttcttccttgctcgctcgctcccctcccctgtagagaatgtactctattcgattcgatcgtgtctttgctgggttgggtcgcctccgtcggtcggattcgatggaacgagaccggttgttggctccctttggctacactacacacagtttctctcccttccctggatctcttctcctctaca

SEQ ID NO: 78062 - DNA, 1906 bp, Oryza sativa
aacttccaaagcggttagtgcacccatcttatctaattaccatgtatttttttgttctgcattaatgctggagaattttcctgatttcctttggtgctagcaaatgttttatttttatttgaattttgaggtcccaagatacatgtattagaaaagaaatctggacaaccagtactatctgcctctatcgtattccagcttgagtgaattgttctgacttcacagttttaatagtttcctttcgtgcattcaggattcacaatttattttctttagatagcctcatatcatattatgctctttcttattgttcagtatatatccctacttttaatctcttagctatttatttgcccatcaatcaaataacgtttattcttcatagcttataagtgtcctaaattttgatggttgatttgaaggactcattcccacctaaaatgtttcaggactccgataagaaactacaaagagcctagctccttccaaattgaaagggattcttcagcaagtcacagcttccaagagtcatcatctcctaatatgtcaaagtcgccgtcacttcagaaaacacacggttttcttgcattccgtaattcagatgcaaatcataactcacacgaatcaccaaatattcaaagccctccttccgaacaaatggcagaaactaggttacctacagttgcttctgagagagctccatccatcaaaaggcaggacagttttgaaatgaaattgcccgatcttcccaaaattgatgtcccactacaccgacaatcttcaaatacttcagatccagaatcaccaatatcaccactattgacttctgatccaaagaatgagcgctcgcactcaaaaactttcagtcgtcctcttgatatgtttgacaattttcatgctgaggagtcaaagaagcagaaaacaaaagctccatcgttttggaggcttgtagaacttagtcttgctgagtatttttatgctctattagggagtgctggtgctgcttgctttggttcatttaatcctcttcttgcttatacaatatctttaatagtggtggcatactatagaattggtgtacgtgatgtgcatgatgaagtcaataagtactgctcattcattgttggcatgggtataataaccgtgctagctaacttcttacagcacttctattttggtataatgggagagaagatgactgaacgtgttagaaggatgatgttttcaggtatgcctcttctgaaatgtgccatggaaagttccattgcgctatttggttcaataccaccattataacatactcttgattgtttatcacatccatatttaaaataatgtctattttgtgattgtgtgtccatgacactacgcttctatagcacagatgattcggcagtagacatctaacatatccactgcaatcagaattcacatttcttagggaacttacattttctgtttactgtattccagcaattttgcgcaatgaagtagggtggtttgatgaagaagaaaacagtgcagacatattatcaatgcgactcgcaaatgatgctacttttgttcgtgctgctttcagcaacaggctttctatattcattcaggatacagcagccatttttgtggcacttcttcttggcatgttgctagaatggcgtgttgctctggttgccctggcaactttgcccatccttgtaatttctgcagttgcgcaggttagttctcatctattttcaacatttcttcaagctggtaatgccgtaagtctatactaatcttacattttcctatatagatgcatcttatactgaacgcttattacatgctactaagatttacaacgttcttttagctatgtcttggtaacagttgaagttttgaactctgtccaactgggctgcaggaa

SEQ ID NO: 78063 - DNA, 5256 bp, Oryza sativa
aattcctgcagccctctcaatggcaataaaaaagggtggcagcgaacgagccataaaggagtacaatggcaaagccgctgatggtttagcgagacgtctagaaagttaaaaatgaacccaaatgataattatattcagtttttaaaatcccaatgacaataaagagaaaaggtagtggatgggccgtagatgagcataatgaccgtgtttgacgagacttctagaaattataaaaagaaacccaatgagataataaaatctaagattcaatttttaaaggtttcaaggagaataaataaaaatagtggtagatcgagcaagcaaataaagaagaatatgacataagtaaggggtagcagctggtgtaacttttaaaaactatattagaaatacgggatgataaggtttgattttttaaagtcttttgacaacgagatatctacttaataatttttaagtaaaatcatactgaaaaatatataattttgtttgggtgctcgccgcgcaattgcgcgggtcatccagctagttttgttatactacttcgtttttttaatcctttgcaattgtttcggttttgtaactcaacttagcaattgcgtgatacgggtaagataatactagtcgtcagatagttgagaaaaatcaatacttagagtaaattgcatccatggtgcatcaacttggtatgtgggtgtaatttggtacaataacttaaaaaatgagcgttctagtgcaacaacttggtaggtaggtgcaatttagtttaagaactttgtaagtgatagtataaatgcaacaacttgcaaggtagatatgattttgatacaataaattaaaaagttatacggcaacttaattatttggagtattttttatataaattcaatttttaagtacttattttgacaatatagtagcgcggatttgtataagtatatttatatttttatcctaataaataataattgaaagtcaattaaagtggatgtaaaaattattatatttcggttgatatttgagaaggtgaagaaaaaaaaaatcttaaaggtaattggatataaattgtactagaacgcacccatttgtcaagttattgtactcagacgttcaattcccaagttcttgcactataccgcacccacctgtcaagttgttgtactgtaggtgcaatttacactaatacttaatattggagtcgtagatgttgtttaagtcgtggaaaaagaaaattcagaaaaatatcatggaaaggaaaatctgtgggaggggaggggaggggacgaggggacagagaccaaaccaaagcaccatgggctgcccccgtcgccgtcatcaattcatcatattctttctttctaactggagtacactagtgctaacactcttaagactaggggataggagtaataaagtacaagtagtagttgctgttgctaattataatccatactaataatcaaacgacctcccctcccttctccttctccttcttcttcttcttcttgttgcaggtcacatgggatagatagatactccttcctccttccccctctcttccaatcctaatcctaatcctaaagaaagaagttggagaaatctcacggcggaatcaatcccacgcgattcgtcgtcgatctggccacggcactccgcttctctcttctcctctactccagcacagcagtatgagtatgaattaggataggagggagggagggagaggaatagcatagcagcagcctgcaggcggaggaattccgcccgatttgatttggatttgggattcttctctttcgttttcgtgtgttttttttttctttgttactacccttcaattcctccctttatttggggccaagccaaagccaaagcaatcaaccccgatttcacgccgcaagattctcttccttctcatgcaccgcctcttaatttcttcttctttcttggggccagaccccaacccccaatcccttgaccaccaagctcctgcttcttgcaatcttgatcgatagtctcctccatcttcttcgtcaagcctctcctccttggatctttcttactacctaggtttcctggtgcaagtgcaacatggttgggcagacggtcatgcggattgtgcgcccctgcttcaagcccgaccaccagctcgccgtcggcggcaccagggatggattgctctggtacaaggacaccgggaggcacgcttgcggcgacttctctatggccctcgtgcaggcaaacaaccttctcgaggatgccagccaggtcgaagctgcccctcttcttctctcccactcctcctccaccacttttgtcggcatctacgatggccatggtggcccggagactgctcatttcatcgcacaacatttcttccccaatctaaagagtatgttcattcctctatttctctcaatactactactactactacaatctaaagagtatgttgcttccctgcagaatttgctacggaacagcaaactgtttcagttgatgtcattcgcaaatcctatgctgccacggaggaagggtttctcaatcttgtaaggaagcaatggctcatcaaaccgcagcttgcctccgttggttcctgctgtttggttggcatcatcaatgaaggagttctttatgtagcaaatactggtgattcccgtgctgttctagggagacttgaaaggggtgttattaaggcggttcagctgtcagccgagcataacgcaagcattgagtctgtaagggaggaattaagacagtttcacccagacgatccacgaatcgtggtcctaaagcacaacgtttggcgtgtcaaaggccttattcaggtagtatttgtttcactttgatcacttctgtatgacagattgtgcctcaaaatattattccatgtgcaccgcactccggtttattaactgagtgggtgcacaatttgtgacgtttcacaatattgctcacctttaccatataatagcgcaagtactcataccttttgccttgccaatttgtgatgtgctcaggtttccagaacgttaggcgatgcttacctaaaaagtactgaatttaaccgagagcctcttttggcgagattccggctttcagaacccttccacaaaccaattctttctccagaaccatccatagaagtacataaactgtgtacagaagaccaatttgtgatatttgcctcagatgggctatgggagcacctgaccaatcaggaggctgtggatatagttaactgtgcgccaagaaatgtaagatgatatcctaactttctctgacaataattttttttcgtggagttctgaattagtttccatgtcagtcatgtctttatcgttgaaatttaagaagaatcaacattaattgttatgtcagacgtgctgagtttatttgttagaacagcaaacatcctagggatattcaacaacatctgtgctgggtcacacataacatgatgttgcttcagatgcttcaagccatatatttagctctaatggaattaatatcttttgaatttataagttccattcgctgatcagttccttaagttcttgtttcaaaccagattaactgtgcgctttcccctgagttcactctgttttctgaattaattcattgacttatgtttatccagggtttgctttattgttgtgtcttttgatttttgttgtatctttgtagaatcgagtatagtatctcgggcaaagtgaatttgccttgctcaggtagatcttcacatgtctcatgttcatattttgcaaccgtgatccccttttctttataatcgctgcgtgctctgaatgttctgatgctaacatcttgttgctaacttttgccccccaaaaaactgtagggtattgcaagaagactaataaaagcggctctgcgagaggcagcaaaaaaaagagaaatgaggtactcagacttgaaaaagattgatcgcggggtcaggagacactttcacgatgatattactgttgtagtactattcctggactctgctctagttggcaagagattctatggtggcccattactttcactgaggggtggtgatggtgcttcaacgcttacacagaaatgatgaagatcatagaggttttctgagtgaataatccatggtatcttggctggttaaagggtggagcatattaattttgattctataatatgtacggatagacttgtacctttgcatgagctcaggaatgcaaatattgatcatattactcctatgcggttggcgaaacctgggagctgcataacttcaggtaccattgcttaatctttcagtggatgaaactcaagcaatttttttttgaaacatggcttgagatgattatatctcatatccttcctttcattttgcagcatctccctccgcctctcaagtctccgttgtactatgtgctagagagggctttggagagtttgaagctggaggtagccctgtgcaatgagagccggacttgtttgctttcagctttggactttgaatgtatgtccatcttcaccgcggcagaagaaagatccattccatctcgttcattcagtattttcgttctgcggtagtacatatatttatataacagagaacacatgcaagtgagaatcacaattttgattgcagcatcgaattgaactgccctatttgtaaagcgttcctttggcaagtctttggattttgagagcaaattagtgatcgtcatccatcagtttgtcactatgtaaagagttgcagcgatgtgagcaaaatatccaatttatagaatttgttagttacttgctctgcccatttttataggaccattttgatttcaaaaggtcgaaatttgaagattttgaccaactagttagtccatgcatattacggtgcaaaagttagtaaccttcgtcccaaaaagagtacaatgaacatggactagtattggttttataactatcattaagaacatattttatgatgagaagttaatactcaagattaccatgaagactttgtgaaattgaaaatacaccttataatgaggtggttttcacacaagttaaacaagtccattgatgataacaaaaacacattggacgcatgctaatataattacgtggtacttgatgtatcaggatttgtcagcaacggacataggatttgccttttacttatactgcattggtaatttagtggaaggaattactaaactcacccaaaaaaaatggaaagaaaattatgcgtcctaatcatcaatcaacata

SEQ ID NO: 78064 - DNA, 2957 bp, Oryza sativa
catgttagtggcccaatcatgttcaactctctcgacatcggtaattgaggcggtggtggtcttgctagagcggccgtggccgttggcgggcgctggtgcctcctttggacatcacccgcacttgtccttgcacgtcgcagtggcccaatatcatctggcccaataatagcccacacaaccctaggctgcgctagtgtcgtcggtccccatcccattcggccaccgatcccaatctcaatctgacgccgccgccggcatccctgactcaccgacgcggctgcaccaggcgccgccgccgccgcctccgccttgatcgtaaggaagtaagtttggagcaccatggctctgcgatcggcggccggtaggctggcgtcgtccagccgccgccgcctcctctctccgcccaccagcatccacacggccttcctccactcccacgccaccagcttcggtacccttctcctcctaaaccctaccctaccacctaactcttcttcttcttcttgtccaaactccttcctcttggttggttcatcaggatacaagcaagtagctgaagaggacaaaagcaaattggtcggtaacgtcttcagcagcgtcgcctccagttacgatctcatgaacgatcttatgagcgttggactacataggttgtggaaggacaggtttgcttccaatctcctcctcctcctcctttttttcatgtcaggcttaccacattcctcttctctattttttaaggctcatctcaaagcttaatccttttcctgggatgaagcatctagatgtggctggtggaacaggtattcttcctttcttaccttcagcattaacatcctaagatgccatgtaccatgcatagcttactgacccacccgactaaaaacatagccttgctagtcaaaagatattagtgtatttgtgttatgtaactcctctgcatttttttggcatgtctaaaacgtcgatgtgctgtgctgtgttccatgtgctaatatccccatttcctgtgcaatactgcaaattatatgaaatgtgcatcaattaggtgacatgttaatttcggaacttttctttgttctaaaaatgcgcgctgtcctaaaataaggtgattttacacctaatgtttcaattactactagtctgttcatgaatgatatttcaacatgtccaagtaaacggttactcccttctcaaaagaatttatctagttgcttgctaatctcgttttgaaattggaaagtaattcatccaatgactctctatgccttcaggggatgttgccttccgtgcgctcgagagaatcaatagcgtgagccatagagctatgcagggtactcttactgatattgaagaagaaacacaaatctatgtttgtgacattaatccaaatatgctgaatgttggaaagaaacgtgcttcagaaagaggtttggattcatgaaatttcttagcatcatgccacctttatttcacatactgcttctgttgtcccatggttgattttgttttctttttatttcaggatacaaagaaggccattgccttagctggatacaaggagatgctgaagctctgagttttgaggatggatctatggatggctatactattgcgtttgggatcagaaatgtgacacacattgaaaaagctctatcagaagcttataggtcggcccataatattgaactaactgactgtatttatatttgatcatgattttcaaatgttgtgtatgtgtagtatgtttggatcaaatcattagatgtgtccaaagcgcttttcttttcttattaatgtctaatctcagcttctatcaaatgctgttagtttcacatggatttacatgtttcagagtcctaaagcgagggggaaggttcctatgcttggaattgagtcatgtggatgttccgctttttaaagagatgtaagtttctttagccaagtatatgtttcttttctacctaatttagaaacacaggtaggatagtttcatataaggtattttccaagtgtcttcttacacatggtgtaaaataaaagagaaaataacagagttaaatcagttgtgaacaattacatttttagctttcataactggtaatcatttctataaagctatcgttcgtagttctataccaagctatgtattaaagcgttgagggttctaaaaatgaaaatattacttgagatgtctcaatggtttaaaggttcccttcttctggggaaaaagaatatttgatgtttcttcctaccaatgcttgcggaaattaacaattctgaggattgtaaaaaacaaaagtaatacttgtggtgatttgtcagtggacagcttaatccaaccggaaaagtttcccttctgttagaaaatatatttgaagcttcttcctgctggttcttgtggaaatttgacgccaaagtttttggcatagttctgttactaacggagagtgaatctgtacacgtgaacaaagctgtgaccaacatttgtgagaccattagaccagaatattttcagcaggacagtttctgtaaaatatgcatagttactagtagtatttaacaaggagtcattcttgaggcagttaaagttttaaatcaacagaaatagcatatctattatgtgtatatagttgccagttacctttccattgatctattgacaagttgttgattcttttggccttttcttcagttatgatgtttattcattttctgtgattccggctgtgggagaactagtggccggtgatcgccagtcataccaatacttggttgagagtatccgccggtttccaaatcaggtaattctggttctttattatccttgcctacttctgagctgccatgttaggattaactattgacaaaacatggatgtacatttgttgcttagaattttggttctaaaaggctttctactgtatgctatccactccagtataggcaactagaaa

SEQ ID NO: 78065 - DNA, 1645 bp, Oryza sativa
tacatgcagtgtttctgtacatgtttcttgtatttattttttttagatgaaaggcttttgacagcccagctttactgaaaagcataaaatgttgttttgacaaccaaaacaaacaactaaaagggagtcacactagattgacagaaaagttacagcctattctcacgcctttgttttggtcttgtcagctcccgccggcttcagttgcattctgcatcattctttggatgatggcaagcagtgagcgacatgtaacgacgttgttgtgttatacagacgaccatgctgtactagtagcatccgacccagtgttgtaaaagtcggccgaccatacggccgtatatacggaaacgccggccaaaccgttccgtttcagcatgtcgaaacggtgtttgaaaatgcgaccaaatctggacattttgtttgcttaatcacctttttttataattattagattagacctattatgtgtcacaattaagttatattggaacctgttttaaatggttagcaacccacaagagttggtcaacccttccggctatatgcgtaacaaaagttactgtttgtttcagtataatcaaatggtgatgcaagcatattatctcattttgataatatatgttaaagtatgtctataaccataagaaattatcaaatatatcgttattgggcctgtttggctgccggggttgcagcagccgcagccaaccggaatagtccggcaagctctaagatagcaggggctacagcagccgcagctgcagtcccagtttgccgaacaggcccattagtgtgaacgccaaaattccgtttaatcctgattaattatccgtaattcgattaatcgcttaacggtactcattccatttcaccaccgtttttcatcttttataacactgatccaaccacgtttcatccatcaaccctctctccaaccactatttcccatcttttataacgctgatccaactactactcatctatcaaaccttacaatcagcttatctctacggggataagaacgtcttttataacacttatctaaccaggaaaataatagttatgtcttttataagactgatccaactacttctcatacaccaatccttacaatcagcttggaaaacaatagttatgcgtcttttataacaccgatccaactacttctcatccatcaatccttacaatcagcttatctgagataggaaaacaatagtaatccttactatcatcttcctccaaccatcttttcccgccttttataacactgatccaactacttctcaattcttacaatcagcttatctctatggagataggaatccatcaattctcacaatcaggttatctctatggagataggaaaacaacagttatgcgtgttttataaaactgatccaactacttttcatacatcaattcttacaattagttgtcttttataacactgatccaactatttttcattcatcaatccttacaatcagcttatctctatggagataggaatccattaattcttacaatcagcttctctctatggagatattgatcagcttatctctatggagataggaaaacaatagttatgcgtcttttataagactgatccaactacttctcattcatcaatccttacaat

SEQ ID NO: 78066 - DNA, 6414 bp, Oryza sativa
ttggcatccttgttttcctcaaggagcgccctgtactccgccaccaggataaccttcttctcttcttcaaccccttctccttcttgtcctttcttctgcttccgcatgccatcggggtcatccactgcagctggagcttcatcgtcacagcctcccaggtcgtcggaggagatgtgacgcagccgtaccaacgaccctctctcccgcgaacatcctcctgctttctcctgtccaacgtccaccgcctgggcctcctcctgcgtcgctgttgatttacccgcaggatcaacgtcagctgttgatttacccgcaggatcaacgtcatcagatgcagcctccgtctggacctggggttcagcaacatcatctatgcctcctgcatcattgtcctcctcctcctccttcccatccgccactgccaatgtgcctcctacaccaccgtgttcagatgactgcaacatctctgatataccactcagtctgcttatggcttcgctgaagttcgagcggatcgtgctctcgtctttgtggaagcagctttcaagagcctgcactctcaccagctcctcttctagcttcttcagcttctcatttactttatctgggtcactcacattctcttcctccagactctgcagacaactctccaactcgctgttctctcgacacagcctgtctatctgtgagctctgcgatgacaccataagctccaaatcaaccaccttgttaacaagttcatcgatatgttctgtgatttctgccaccgagatgctgccgtccctctcaaaatgttccttgatcttctcgagcactgtctgcgtctcaaattcacccagtttgatatgctgtacctcttccatctcaaagccatgattcttcctcacgtttttatcacaaggatctggagaatccggcaaggatttcccatgcccctccattacagccttgagcttctcacgtagaaccttgactctttctgactcgcccattgcctggctagcagatgtcttccgctgttcctgcagtttgacaatggtgtcttcacaagatttaagggctgttgctgtcatcagtgcccgggcttcatcatcctcaatcaccgcactttcatcaaacttatcttggaaatggcacacctgttcctgcatgtcattgatttgcttctcaagatcccagtactttgcaatgccactctcgtacgagcttttgatgaattctttctcggtctgcatcacaagtatctctttctgtagtctgctgatctcctcccgtgcgttgtccttgtcgattggagctgacgtcgtgttcttgttcatcgaccctgcaggctgctctcctcctttcttcttcttcatcaatccgtcaacagtcgacttgtgaattttacgtggatcgactggggtaaatgccttggggatattgtcatcttcctcttctagcattgcatactgcacttggtcagggaaagctgtcgcgatggtatggtttgctttgtgcagttcccctgaaatgatgtcataccggtcagctagacccctgtacgccctgtatacttcttccacttgagtgatcacctccggccgccttttgtagtacatctctgccctttttgaaaaggaatcagcttcctctccaaggagtaagagcatgcacttcactctgtgttccatatctgcatatatatccacaagaccatttcatgggatcagaaacacaaatttctatgatgattttacagcagataagatttcacatacattattggtttcatagcttcaaaaaggccctaattatgtcacgggtatcaacattattttgttttgctagcaagtataactgcaacagaaactgctgaaaacacaggaataaagctcccaaacaggagaaacagtttcctgatatgacaatattctaaagtaaatttaatatatttttaaggcgattgttttccatctagatgtataatgtttctttgtcccctttatcaggttgcatcatatcaattgtacgcatatgcattcacctcagttctggaggttcaggaatttacacattcgatttggtccaaattgatcctcagtcccattcccataagcaatacatgtttaatcttcagatcaacaagcctaagctgattatgattgtgcagatttacccagaaaagtgaagaggttatgtgtattaatttagagatgtgagatctcgtgctactccaaataagaatatctgtagcctcatatcaagaatcacatggatggaaggcttagaataatttcgttattctccccattgaagaacttctaggattgaacaaaccaacaaatctcccatataagtacatacataactcacagaaatcaaatatatgataaaaaagatcaagattatatattggacggtcaccttggagatggctatcaagccatttggactgcttggtgcggatgtggctcgcccaccaccatgaatacgcattgctcgccgcccgctgcagcatcctgcctcctctgtctcttcctccttcaccttctccaaaatccaaagcattagtctttcctgtgcatgaaaactaacacacgagaacagagaagtggcaaatgaaaagagcaagaaaggaggagggaggagatgccattgagaggctcatagccaagtccattcaatggctaaatatagttaagatggtgagaggttaaaggaaaggagaacacacagcagatgcacaaacatgtacataatagaattgcttaaatgcagataggaaaaataataactgcgctgaaatggcagatcaaatgagacaacaggcacacaatactgctacctagctgtgccccacgatggaatggaatagggttctacttctaaattacttgctatattctttcagaaagaagagcgacatttcatattgttccaaaggcaatctgattaattatcaatcttctcacatgagataaataggtaaaggccatttagaattcatgaatttaatgaaaaaaatatcaagcctctgaaattcctgcaaaattcatacatttcgaacaggcttaagataccagcctatatgttggcaggggatttattttttctctttgaataagttgacatacgccagagagacaagtgtcttccatgcatggaacagtgactctgatgttaaactccctttcctgctcctgtcaaagcggcattgcctcgatgagattattgtggaatctttattgtttcacaataatttgcaacccatgcatgagcactttccaaaactcggagctcgccgacaagtagatctttggccatttcttttctgaatggatgcatgctcctagaggcagggccatcaacaatttcaagttgctgcaatatagaaattaaattagattattcaattttactgtttaattgaagttttgcttcactcaagtctttcatgataatttcaatttgtgtccctatttttttagtatagtatgtattcaaatttttaattggtgaattaatctcccaaacactgtaataatcatgaaatatgattactaacttactatattggaacatccatgcctgagttgtatatatgtgtgtgtgtcttacttcctctgatccaaaatataggtcgttttggagttgtgcacaaagagtaataaaagtgactaatgaatttgatggccttaaattatttttgcattggaaaacatgggcaatttattcatgagagaagcagcatttatgtaacagaaaacaatgcattgaaattctggcatgacttaaatttggagcagaattgagagagctaaaaatgacttatattttggattagagggagtattcgtctttgtcaaagaatgcatgtgtataatttgccaagtgcattcctttacatagccacttataatcgtatgaatatgtttctacttaagaacaatagcaacattgttttcatacataccataaaacataagtgctgacagaatgggaaaatgcaaaaggatatttggaattgtaggttacttttttaatagacaaaactcttgttattcttggtgccctcacctcaatagctgcagaatggccctgaatcatttcagcgaagtgcaagagcaacctgcggtgagcatggatttctctctccatattcttcaaaggacatctggcaagcctaccatcactttcagcagcctccatggccatctcttcgagttctaaagacgttgtaatcatgccattggacatcaacagaaactctttagtatctaacctaaaggggctgtcaggctaaatgcaaaacaagaaaaatatgctactagcatagcacctttaagtgacatggcagagaaaacccgaagaaatgcgcgcagaatcagaggaatcccaatgcctttgctctgagaggatttgacttccctgtttccattctttgaatttaaaatacaagcagagaccattttcttatatcatgccaaagctattacagaatgataactttttgactatttttttcgccgggaaggccgaaggaggccatccgaatgtattaagaaggagtaaaaattacaagaaaaaaacatcacaatgcaccaaggtgcatgaccacacaccacgcgctaccacccaagcacaaaccgctgagggtgaagcctagcaccaaacgacccccgctaagcgtggccgaacgccgctaggcctacggcaacaccacagagacaagactctgaaaacgatgccaccacggtggtcacgacatccaggatgccgccatcgcccatctaaaaaagatgtggttttcacccagagaagctcatcaagaaaggaagaggatacccctcgacaacgccccaaggaggttacgacgcccgaagacgtagccgctgccggcccggtgaaccaccggactaggctttcgcctgggaccctacaaccttgactgcaaatcgccgtccaccaactcagaaccaccacacagacaaatggcaacacgtagcttccgccataccacaccaacgcccctccgtcggccgacttcattgaaccacaccgcactgacgcccctccgtcagccgacatcaaccaccgcccctgagagcaaggttgtcagtatcccgattcgtattctagtatcttacgataatacgatcctaccaagccgaaacgataccgatcccacatagtatcctaatattcatagtatctcgatcatactattcattactacacgatcctacaaaattttaggtggtatcccgattctatgatccctacgatactacaaaatattatttaaaataacatggtttcaaataaataatataaataaatatgctcaaatttatataaaaatcagctaaatatatcaaaaccaacgtggtttctctcgataaatatctctatttgcatgacatatatcattactatatttttttaatatagaatggctatatataattaatataaatattaattaaacttaaaaaaagaaaatcccatagtatcccgatactacaatacgatcctacggtacgatattactttgagtaaaacgatactacctattatcccgatcctgacaaccttgcctgagagctggcccaggacccctccgttccaccacccgctggcctcctcgccagctttggacgaaaggagaacccgggactggatggcattgctttggcagcctaggcttcccccgctgacgagctgccgcctcaatccaacccagaaactccccacagagaaggggaggagctccaagaagggcgagggtgccgacctgtcacaccctgaagttctcctcccaagcctaaaatttaatttataaatgaccctaagaaaatgccggtgcaaatctaagagaaaaccctaagaaagtaatacaaataataatcgaatctggcatgtggaatttttcttgagttctacatgtcgaaagtcactaacaggatttttagtggaattttcagagccctagaaataattttaaccaattaaaattgagcaagcaatattttaattccagggaaaatccttttcttcctttttctttttctttttcccccttttcttttcgagtgggccgccggcccattctccttcctcctctcccctccgctgggccggccgaaggccaaggcccagctaggccggccgcctccctccttccacccgggacgccgacaggtgggccccacctgtcgggcccgtctcctacctcgcgcctgcgccgccgcgcccacgcctccgcctcctccgggccacgtcggtcacgcccgcgcatgcgccgcacctcccgcgcccactcccctctctctcccgcccgcgcccgcgcccgagatggccgggattcgattttcgaatcccgcctatctctctcctctcccactcccccacgttggccggcagaatctcgcccct

SEQ ID NO: 78067 - DNA, 1228 bp, Oryza sativa
aagaatttcgaaatagcgggaaaagatatttactcccggttgttgagaacaaccgaaactaaagatatctttagtcccggttgttgagaacaatcggaagtaaatatcttttctttactcccggttgttctcaacaaccgggactaaagatatcaagatatctttagtcccggttgttctcaaaaaccgggagtaaagatcttttctttactcccgtttgttctcaacaaccgggactaaagattattcccggttgttgagaacaaccgggagtaaagatccaggggtatatatattcccagtgcgccctcgtcttcttcaccaacacttaaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctcccttcatgcatctcgatctctccgatctcgatctctctccgtcgcgccgcccgccacgagacgccgcgccacgacgacgacgcgccacgccgccgccttcgacgccgcgcaacgccgccgccgcatgccaacgccacgccgccgccgccgtcgccacgccgccgccgccttcgccgccgcgcgcgcaacgccgccgccgccacgccacgccgccgccgccacggccccacaacgccacgccgccgccgccgtcgccacgccgccgcgccaaccgccgccccgatgccgccacaccgccgttaacgaacgagaacgagaacgatcgaacgaacgagagcgagaatgaacacgtcaacgtacgttgccgcgacaacgtgaacgagaacgagaacgatcgaacgaacgtgaacgagctagggaacgtgaacaagcgaacgaacgaggacgaacgttaacatgaaatgcaatatatatatatatatatatatatatatacatgtatatatatatatatatatatatatatatatgtgtgtgtgtgtgtgtgtgtgtgtgtgtgtgtgtgtgtgtgtgtgtgtgtgtcggtgacatgggatcaggagtatcatgactagaggtttgaggcagacacaatcgcacacgtggcctggcacccccgagggacgtcgggcccgagggtgatgtgttcgccctcctcttagtccccccgagggggtc

SEQ ID NO: 78068 - DNA, 3049 bp, Oryza sativa
gacttgcctgtgttgatctgcttgtattagaaccgtagaacttggcatggtgtactttatgaggttactaatggttttgaaaataactacagatattagtgcaagtgcatggtgtaaattccttcgtccggatgcatgcacatgcctctgaagttcttaattgtttattataggatctgaatcacctgtcacctgcaagctgattacaggatctaagcgttgtggctacctcaatgaagtatgactaagtttgggcgaggtgcgcataaatgcgactctgcaattttgtagccaaccattaagattgagccagcgcaagtttttgagagggatgctgggatcaataatagtatgtgtgtttatttgcagcgttgttccaacgaaagtaacaagggtgtacatgtttgcatgctagtgttatttgctacctggaagaaaccaaaccttgcagatatcagtgaacttccagacaacttattattgttttcttctttttttttggaaaaattaacttgtgattcttagattcgtattgagagttaacattgtaaatgcgtagggtgaaacagaaaaattttgcttatggtaattgaatagtacatctcctgtacaatatggagtgtaaaatttactgctaccattttgttagttgctagtattatgcacacgtgtcgcactttttgagatatatttgatcattcgtctaattaaaaaaattgtaattaatacttattttgttgtggcttgatttatcattaacatttctttaagaatgacttatatttttgtttgtttgtaaaaaatattgaataagacgaatggtcaaatgtatgaaaaagtcaacggcaatatatatatatatatatatatatatatatatatatatatatatatataggacactcatatggggcaccatggtgcccgggcaccatggtatctaatgcacaaaatcactcaaatttttcaaaattttcaaattgtgagtatatacctagttataataatttgatttatacctttacttatcaacaaaacaactcaaatttaactttatttcacaatccatgattacatacctaacaaattatatgtatggatgctatatacctagaatcaaaatctaacaaaaacaagttcaaattcagttcaaacttgctttaaactagttagtaaagtagttaatgttaatacctaagtaattgaaaaagtttcatactaatttgaattgggtatatactcaatttcaacaatggtgcccgggcaccatggagcaccaaacaaatttactatatatatatatatatatatatatatatatatatatattaaaaaaaggaggtatttcatgaatgtcagtttggatgaaatcgtaggaaaaacatatgaatcaaatgagagatacagtcaaagaaaattttccaataagttaaacttattcaaacttcccttcacattctccttgtatcgagccatcctaaatggttttcacatgagacagtttattttcttcaaatttttgttaaattcctctgtttcgaagaaggcatcaaatggtgtccaattttatttcaaagggctatcttagaagagaggggaaagaattcctatatgattcaactcatacaagcatcctctataaattatcctttgctccagggaggtagcacaagcagcaatggtcagggtgcattccctttgcctgtccaacagggatcccctgtaatactgcagaggcagtagcaaccgttataccgcagaggatatgcatcatcaatacctgtctggcgctgaacttttgcgtgtagtaattcagtttctcaatattaggctcagcttgtttcacttttttttgagatcgaggttacagaagtatataagcagccaagttaatatgaattaataagatggtaggattagaattacgtactctctcgatcatatatagcctctgcttgcatgcagcaggagtatagtatatagttaagacaaagaaaatgtatataaataagattttgcgattaagtaaggaattttatttaggggccaggcggcaacatgacatacatgagacgctaaggtaggtagctagctagctagcagcaaattaaggacttgcatgcaagctaggtagctagtacatggcatatgtagtggtactggtagctcgttgatcaggtgatgaattggatggagataagtttcttctagttgcagttgcagcaggagcagccgcagctggtgccgcacttgcaggtgttgcagccgcagctgccgttctccgcccccatctctgatcctccggaagcagcaccagacctgcaatcgatcatgcattgcccatgtaatggatatatagtgttcatacttatataaaatctatcgatcggagtatgtataattaatcaagcatgggtatacgtacataccccttgttggttgcatcggcaaggaaggtggtcgtggtcgtgggttccacctcagagtacttgcatctgcatatatcgatcgtcaagtttgaattgcatcgatcgatcgatctgcatgtaatatacgtacccgccgcagccgttgccgcactggcagctggagccgcatccgcagttgccaccgcagcacgacatggtgatgatgatgagagcttcttcttccttctctggccttgtcggcaactagctgctgcttacttgtatggagcttctcagttgctggcctgaggagcaatggcaaccgcaccctgccctatttatagccacccacactacacccacggatcatcagtagtgaatgcaatgcatacgcccgcgcgagagagatcgatgtaggagtagcaagcatctaactgcagttgcagaataatcaacagtagtaaaaagaagaaaaaacaatactcagtagtagctagatcgaccactagaatggatgggattggagatgccgcgcgcactagatagcgatagcagctgccatggaatggaaataaggaacggacgacatcatccgagggaccaccatgcgtcttatctcatttgtctcatccatatatata

SEQ ID NO: 78069 - DNA, 5524 bp, Oryza sativa
atgtattatgtacagcgccaatcttgaggaagccgtcgacggtgcggttgaggaagggatggcccatgtcgacggcgaggtcgaacctcggcgacgtcaggctgccggagaagccgctgtgagccatatgctgttcgttgctcgatcgatctcgtcgtcttctattgtgtatacaatcacaaataatatagccagccaattaagttgaagcagtcgccaactccggcatgcactgcacaccttccgcccgggatcgcttacctcttcaattcccttcctctgcactctctctctctctctctctctctctctctcgcatagtccatatcccacgcaattctttctgtttctgggcacacaagtaggagtaatacgcaacacatgggactcccatacacaacaagatggttcacctcgacaacaaagttttcatgtatttatgcattccttgctggttacctttgcgcaagggcacaagaatgaaacatcacaatatcaaacaaaaaccggcctacactgcctcccaaaaaaaaaaaacaaaaacaaattaagaagatgccctacacaactaacggagatttacacatttccccgtgcttttcttgttttaataatatccgggaatgcaggaaacttggaaaacaaaaccagagactataattccactattcaaaaacttggttcccctctctccaaatgacctctttctaatctcattctcaacctgcgctttcctctcattttcttccttttttcaagaaatgctacactaatagcaaattcctgtatcagcgcttcccaatggagaaagctcccccgtgttattcctgagcaatcacaacagtctgctaagtgacttgataagcagcttgatgttccgccttgtcgcgtcgtcaccggtgaaaccagagatgtctgagctgatactctgcgaagtaaccaaggacgggtacagcaaatacatttcagtctgatgatctgactgagaaataaccaaaactgacctaaagaaagttaaaagagtatatatatgcaaacctcaatattcttcagagtaaagataagggtgaaaatagactgcttaataagatcggtgttctcaggggtaagcatggaagacttcagccttctgcagggtagcacaagaaaagtttatcatcacatttatctttggtacattatataatatgatgcagtgtatatttagagaggtctatttgaatactagtataatcttgtagactctttcataataagaaagtcatagcttgatggtttatatcaaattctccaatttatatcattacttatcatgacttacctcaagcaagatgttataactcatagttgtataaataatatgtattaggccacaatgctttccagaagtaccttaaatcaccggatgcatcagccagacctttagctataatctcgacatccttcaccagatcactatcacgaacctcagaaagcagaggttgaatttcttcagctaatgcttcaatctgttccatcactaacatttaaatggatgagtactactattcaggaacatttttcgattttgcacccaaaaaaaaaggattcggcagagctgcacatatggaggaagtaccacccacaaccttttttttttctttctcaaaagcatgtgacataaacaagaaacctaacaacatatcccccctaaatggaggtcccctctcttgacagtgctacatgcatgccaaccagtgcagctatgtgataggacaaaaattgaccataccctggaacattcagtggtcaaccaacgtctgacttaagtatggacaggatggatcatttttttcttggtatatcatacacaaatagatcatatactttggtacacaaccaatttgaaccatatacaagacataaaaaaaaaacatgccaatagttgagttgtacataaaggcatgaaaacaaatgaatgaaggctgaaaatttatttgcaagtaataatcacgataattacatgatttatggcttcatatgcatgatacattgacatgttaggaaaaactgtcaggtataaaggatgagactccagtggtactaactgccagagtaaccactcttttcaatatttaaaaggtacacaggatcaggaaacgctgttgcacttccaagcatggttacgaaaatttcaccataggggtaaagcatatgaaccatgaaatcttattgagtggcagtgagaaaaaaaataggttgcaaagagatctgattaactaaataggacaaattataaatatttctccggatatggaaactatatacaaaagcagaacgatgagaaaaatgtacccgtgaaagaagaggctgcgcttcttccattattgatgctactttttcagccaacttgtagcttttgtgaacaccaatttcctccatatctcttcctagacgagtaaatattccaaccagtgcgtctaagcttactccttgttgtcctttcatcctctctttgtcacagagaattaaaccttctttggaacagtctgggtcaagaggaccaactgaaggtgtagggagtggatcttttggtgttatatcaatcagtgtctccattagaagaccagactgattcacctcaaccactgaattgcggggcacaataattttatcatcttcaacctatcatacaagagatagcaaatattcagcccagggggaattatacagtaagaaatgcacatatgtagacaataggcaagaccaaaatgaaggtgctcttgttgcccaacttactaaaaggagtgatgattgaaaggtaaactcaacctatttgtgtaactggaaagtatccgtaagagaaccaatgagccctgaagcttagtgaaacagcataaatgcaaattaatgacacattgcattgcacaaactaaaccatggattcttttcagaaagttgttctatgaattaataggcatttagggcaaagtcaatgcaaagtcttgctttcaaataagtcgcacacctgcaacaccaactttatattgaaaatgtgaagtctgagtaagtgagtagtggaaaactctaagcatctaaaaggaggacatgacccctcccatccatgaatcatgaatcatgacaagttacaataccaggaatttgctgttcagattaccagcttaggtaaatcgagtggctacacagccaggttaaaataaactagccagcaagagtaaagatctcagcttttccgaatgaacaaaatttgagcaactaactactctagatccaatattttttttagaaaaaaaaaactactctagatgcaattaatttcagcatcagtaagcaatggcaatcttctttagaaggaaatggcatatatctgcatagaatttgacatgcatgaagcagtcatttgattctgattgattaggttagcatcaaatttcagttgataattagaaagaaggcgaagcagttagcaagaaaatgcgttaaaattaaacacaagaatatgcattgccattttgacaagttacatggtttgagtgccaattgtatgagagagtaatataagtaaggtgataagaagtagtcctatggtgcatgtactagatctgccatcttccattttggtttgttgaaggaatgcaaaaggatgcataaaaaaggaagaggatggtgtaagtagggggtacctcaacataagcatcgatgctcttgagggaagagtcgacgcggacgacgttgccgacggtgacaccgcggatgcggacgggggtgccgacgcaaatcccgcaggcctgggtgaactcgaagacggcttggtacttgcggaagcgggcgcggagctggaatccccggagccaggcgagggcgagggcgagcagcgcggccccggagaccatgaagaggccgacgccgccctcccagacgctgcgcttgccgaagccgtagtcacccagggggtggagcgtgcggcgccatagcgcgaggagcgggttgccgccgccctcggcctcgggtgtgggagaagggtcgcccgaggcggaggcggagcagatagcgagggaattgcggcggcggggcctgggattgggagtgggagcgagggtggtgggacgagggttcgaagagagggcgatgaatgggggagggagaaaggatttggtggtggccatggcgatgatgacgaatttagtggatggatgaatagggggattggaagaggcgatgccgatgcgtcaccttggatgattgagcggttccatcgtcggcgattggaggcggcggatcggaggtctccggcggcggcggcggtggctgatggcgattcgatcctctttggctggacgcccctccccgtctcgtcaactaatcacatcacatcacctccaccacacactcctccaaacctttacacaagatttcacattatttttactattattattttagaaaatatttcttggtgaaagaaaatatactgctaaccttgtgtattaactcatctgttctaaaataaatcaacttttgtatacaaatttagacattatcaacgctctaggagccatcgaatttaggtttgttcattgcaaaccatccaacccagcaaccaaaaccaaatcagtacaagcgggttacactggttttctcggttatagatcaaacatgtacgatttgacaacgtggtggattgaataacggttttaacccaccggctataggtgcggcggaggtgttacttttaatctctccgttgttatagcaaggtcgtctcttctcctccaacaaaacaaggactatttgttattgtctccggtatagttactgtttgttgcatcaccatgtgcacatgttccacgtggttttttttccctctttgtttttgcttgtgcccatgcttcacactctatatatattattactctactttttttaaaaaaagaatggttatatataatagtattacaatactaccatacaattctacgatttgatactactttaaggatactgcctagaatcttgatactaacaactttggtattcctagcaattcaaaacacaatatgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctggagagccagagagctcttattctaaaaaccctcttctcccttttttttttctcgtgggatctcctctccagatcatccccccttccagccccctctcttaagtgggcaaggtcctccttttatatctcaaggggataccacatgcaccacttctccttctctctctttttgggtgggggcccatcctatctatagtaaaacttggcttgccttctcttggaagctgaaacactgcctgttttt

SEQ ID NO: 78070 - DNA, 2525 bp, Oryza sativa
atactattgaggtggtttactattaatttagttatcgctgacatgtacatgtttatagataacaccttactttatcattgcgggtgctctagcaagtatggacggcgaggtggagttggcccaaaataatggcaagtgtggtgtgggttggctctttgtagtaggtgtatgtttggtcgagtcgagcgtgtgagaatcgtgtaccacgttggttctttaaaaaaaagacggtggtggaccggtgcgtgtccccattgaacgaattccaaaagaaaaggacaagggcaaaaaagcaaacaggctagtagtatttacgttttttgtcctacggcaaaatcaacacacaacaaggcctattagctcagctggttagagcgtcgtgctaataacgcgaaggtcgcaggttcgagacctgcatgggccagttttattttttgttgcgatttttcttccactctgtatccataaaataaataaagttagtttttctttaacaaattttgagattttttttaacacgcatttaaggtcaggttccaaaatcccccaaaaccaaagcatattatctatctattatattattaaaattgctttcaaaggaggcaccacgttcgctgtgggggctagaaattctcacattaatcgaagaaaaagaaaaaaaaaagaaaaggagagtccaagtagaagtacaatttaaaaatagctgaaattcgaaattaaaaataagcaatattgaaagaagtttccatataagaacccaatacgagattaatcaaaattcgaaataaaaataaaataaaattaaaaattagaaaagaaaaggagagtccaagtagaaatacaatttaaaaatagctgaaattcagaattaaaaataagcaatattgaatgaaatttctatataagaacccaatacgagattaatcaaaattcgaaataaaataaaataaaatccataattagaaaaggaaaggagagtacaagtagtaatacaatttaaaaatagttaaaattcggaattaaaaataagaaatattaaaagaagagtccatataagaacccaatgcgagattaattcaaattcagaataaaaataataatatttccgaaattagcaaaagaaaataaagaaaagtttaactagggatacaaattaaaattagctaaaattcggaattaaaaataagcaatattgaaagaagaatccatataagaacccaatacgagattaattaaaattttaaataaaaatataataatatacaaaattataaaaattaaaagagagttcaagtaggaatacaattttgaaagaactgaaattgaaaataaaaaataaaaacattaaaagaacacaatacggtattaactattttttttaaaaaaatctgaaattagaaaaaaaaagatttcaattaggaataaaatttataaataactaaaatttgtgataaaaataaagactattgaaagaaaagaccatctaaaacacatgacgagataaattaagtaacatgcctataaaggagtagagttggtggcggttgatacggcatataaaaattgttaataaaacatcaaatgaatcctaatggcgattaaaaggtgggacgtcaggcaggccgtgaagcaaacaagtaaagcggttgccggaacttctagaaagtaagaaaaaaaccacattgataatcatattcgaattttaaaatctcaatgaaaataaaaaggagaagcagcgggcggggtgtataagagtatagttgcagagccgccgacggttgacgggacttctagaaaataaaaaatgaattgcaacagtagttatgctcgattttttaaatcacaatgacaataaagagtaggcggcggacgggctgtagggggtatagtggcatcgtttgatgggacttctaaaaattataaaaaataaaactacaagtctaatttttaaaggttcggaacttctaaaaataacaaaataactaatgataatcatattcgattttaaaatcacaatgacaataaagaagggaggcagcgggcgagccgtagaggagtacaatggcgggacttctagaaagtaaaaatgaacccaaacgataattatgttcgatttttaaaatctcaatgataataaagagaagagatagtggacgggccgtagaggagcataatggcaacgtttgacgggacatctaggaatcataaaaacgaaacccaacgtgaaaataaactctaaaaattataaaatccaatttttaaaggttccaagaagaatgaatagaaatagtgatagatcgagcaaacaaataaaggagataacataaggcgtaacaactggtgtgacttttaaaaactatataattagaaacacggggatgataaagtttgttttttcaaagtcttaacaatgagatagctatttaataaattttaagtaaaatcatactttaaaaaatatatgtttttttttggtgctagccgcgcaattgcgcgtagaagtacaatttaaaaatagccgaaat

SEQ ID NO: 78071 - DNA, 1154 bp, Oryza sativa
ttcctgcagccctggtagtgtatgtagcagtttcctccttaaaacttaagtgtttttcccggtacttgggaggcaccaataggtactgataccacctaatgttaatcttttaaacctcttggcacctcccaagaatccttaggaactcaagataaaaaagttaacttataaaagtttgcagaagggaatcagttttttttagacgtatgagtaacattataatgcttattgattattttgctgttccatgttattgattgctgctcataaagtttgaatttagaatggtcaaacctcctcccgagcttgcagtttctgtttgtcaagctagtacttttttttttctgttgttagatgattcctaattatattctttctttcttttttaagtggtggccatattttgtcagtagcatttggcagcaacatacctgctcggttgattagcttattttgcagttaaaattagattcttacagccaatattctggcatataagaactactgagaaggatttggatgaagaatcatgaagatacagctaatcgtaaccaatctaaaaatttttcaagttcaacttttgttttaaataaaaatgaaattagctaattttgtttctcctcgcccttattaactgcttaaagtcagttacctctgtggtgccctgtggaatgagctgtttaaacaaactagtattattgagttctatcctctctgatctgtagtttcctcatgcagatgtgtgatatgttgttttctcaattatgtctgagactgccatcttcaaatgtgatgcatatgggtgggcttcaatcccttggtcaactttttggttgtacaactaagaacatcgagagccatctggaaactcttgcgtcgcatcaaaatgttggaaacaagaacttttgcaggagtgagacattgcaagacataagcgtaaatcaaactgctcaaaccactttactctccgagacatcaatggcagcactacttctgagaggccttgcgatagctcctatgcagcttgtagcacgcgtaccaacttcattgtttttctggccattgatgcaacttgaaggggcagctagcgatgatattgcattgggtattgctgttggtagcacaggtagaggcaatctccctggtgctacgtc

SEQ ID NO: 78072 - DNA, 6142 bp, Oryza sativa
agctagcatcccaaggtggaattagtggagatgaagaaggactaaaatgctcttattgaaaaaaatagtaaaagtgataggtaggtaaagggtattgaagaaataaaacttctcgttttacacactgagagtaggtaggacaaaattcatactctagaagttgagttttttttacggagggagtatatcttatggtactaaactatataagtttatagaaactgataggtaaagtttgaaatgtttgacataaaagaaacctaaaacgataaataatttgaaatggatggagtactgtattttcatgggaaatggagcttgtagactagtagaaatagagtctcgatttaaacctgaattttgaatagaaaatggcccacgcaatagtgtaccaatagtaagctagagaaacccaaggtaaatatggttgaagttgaaagtgtaccaaacacaaccttgtacaaaactgcgtgcggtgcataattaatcaagccggtgatgccaagcgtgcaccgacaaccagtttgtttcttattttaagaaaatcaacacggtcgtctcagatcgcatgtttgatccgtgttataattaattaaggggttagctagctcattaattaacaaccgcttgtttgcatgattgttgcatcccctgtacaatatactccaactttatcatattttaacaaaacaattagtagtattacttagtactaaggcactagtagtaattatataccatcagatatatagacagtactttgatggacttaagcattaattaagacatagtagtacttaaaaagatgtaatgatcttaaacgagctcatcggctggcgcggctcgttttgaacatgagtttgagctggcctaactgtttagaataaaggtcacatccacgttgacaagtcagaaaagggtaaaaggcagctgcgcggccaagattgcaatcaaattaaggttaaaactggataaactctcccaggctccctcaaaaatcatacagtactatttcagtggctgcaatgttttaatttctagtagcaattataagtggatacgatgttcggtttcaaaaaaaaaaagtggatacgatgttatatacagtagtgttcctgtctgaatagcgattttttttttgaaataatgaatagcgacttttccgacctgttttggcgcatgatgccaattcaattggtgtcaccggagtaggttccaaagtttacctccccagaattattgtaacaccactaatgtatgtgaacacacatgtttttatagactcgttagaatttctactagtatgacgaagctagaaattcttgtgggaaaatgtccgttttgagaatatacgttcataagtctggaaacaatcctaactaccggaagaaaaaagggtgaatgttaaatagacttaacgcctttattaattaatatttattattacaaaaaggcacgcatggtagttgaagaagaaatcagtgtagaaagcgaagactaaattgaggaaggcaagtggtttgaggaatgctacgagcgaaaagatttggagtataaataaacagagagcgatggagccggtcgttccaagctgaagcctccactcacttgctctgcccaccggcgccggcgccgtcgccgccctatcctgtcctacctatggggcacggcctgagctgcagccgcgacaccgacgagtacgacctgttccgcgcggcgcagctgggcgacatccacgccctctccgccctcctcgccgccgaccccgcgctcgcccgccgcgccacagtctacgaccgcttcaccgctcttcacatcgccgccgccaacggccgcctccaggtactgtccatgttgctggatcgcgacggcgacgtggacgtcctgagccgcaagaagcagacgccgctgatggtggcggccatgcgtggcaacaccgagtgcgtggtcaggctcctccgcggcggcgccaacgtcctgaccttcgactcgccgcgcgccaggacgtgcctccaccacgccgcctactacggccacgccgagtgcctgcaggccatcctcggcgccgcggcgcaggcgcagggccccgtggccgcctcctggggtttcgcgcgcttcgtcaacgtgagggacgagcggggcgccacgccgctgcacctggctgcgaggcacgcccgcgcgtcctgcgtgcgcctgctgctcgacaagggcgccatcgtgtcggcgccaaccgccgtctacggattccccgggagcacggctctgcacctggcggcacgcgccggcagcatggagtgcatcagggagctgctggcctggggggcggaccggctccagagggactcggcggggcggatcgcgtacgcggtggcgatgaggcgggggcacagggcgtgcgcggcgctgctgaacccggcggcggcggagcccatagtgtggccgtccccgctcaagttcatcggcgagctggaggcggacgccaaggcacttctggaggcggcgctgatggaggccaacagggagagggagaagaggatcctgcacggcagcgacatcaacatcaagggcggcgacgaggaggaggagagcgaggatgaggaggaggcgtgcaacatctgcttcgagcaggcgtgcagcatggaggtgaaggagtgcgggcaccagatgtgcgcggcgtgcacgctggccatctgctgccacagcaagcccaaccccaagaccctcctcctccacccgcccgcctgccccttctgccgcaccaccatctcccgcctcgtcgtcgccaccaccaactccaacaagaccaacagccgccgccggtcgaggagcagaagcagcagcttcaagggggggctctcgtcggccatggggtcgttttccaggataggccgcggctccgggagattggtggtggacggcagcagcgtaggagagctcgccgacaagcctgaccacgacttctcttctgtcgccgccgctgctgctatttgtgacacatgaccctccctctattcattttttgtgcagttacaccttactagcactagagctttgggtaatcaatcaatcctcccacaagctcaagctaggttattcattatagcaaacaggaattggatattgggattggattgcatttgtattgtcttgtgttgcattcaatttgtagtatatacttgtttttggcttgtcatggtaaataatatttactccctatttattgtacgattatcaaactcatactcaactacactaaatactgcagtagtataacaaggccaacaccagtggatgtgcatggttgcacaaacattgtactagtactaccaaagctatgagatctccatagaggtactatatatcttaatgtttccctacaaatcagcaggtgagtctatcacccacctcacctgtactgtactgtacttaacgctaattacttctctaattagtaccatgaccagggatagctagcatgcatgtgtctcccggcgttggcttttgtatcatgtagagtagtataattaagtttatgaccaagacagatttcctcctgaaaattaaattactggacaaacttgacggtttcacacagaaactgcaatacacaatgtgcaatgcaatcgccaagtgtcaatgcagtgtaagcaacacgttaaagctcatagaccgtacctacttgtgtgcctttccggtgttataaaaattaagaagccttcctccttattacacgttccattaccatcatttgaccagaaagattgatgagccgatcaaacaaagatactgctgcggctgctagccaagccttccatgcataagatggataggaagttgattcagggaaaacttcaccagtcaatttggcttcaggaacgtggtgctagtgcttagaattggaattggaattggaagaggaagaggtcgagtggagtgccaccaacctgttggtctcggacgcacgcacgcacttccacttccacatcaattagttagggaaagggcagtttcaatttccggattacgatagcagccggcaagtacacaagatatttacaaggcttcctcctatcattgagcaatatagtatacaatacaacaacctacaataatattttactgaaagaaagaaagaaatatgtcacctttgctagtggaggcagaggaaaggaaacaagtgtatgtgcaaatcttccaacaaattgcgtgcttagaccggacaacttacctgtcaagaggacaagcagacagcaacacatatgtttgacataatcccaaccaaaccaatggaagaaaaaccggctcaacgccatcaggtgtacttgccagtcttacgttccattccagcttcatctaacaaggacaaacacactctggtcactgccaagttgggcatgccatacccatatagtatggccttgtttggatccttcgggctattaaatagcctgaagcatccaaacagggcctatgtcatcaaactgatagaggcatcaacacggcaagatcttgtcaatatttctatgtttgaacggtcctcaagaggtgcactactactagtgtgtgtcccattcaactggacatactgtatctgagagccccataggggtgggtatattctgcttcaaatcatcggtaaactacaacggcgaagaaccacatgtcagccttcctgatagggttgttcaagaacaacattgaagcatgttgggttgcacggatattcacagtctatttccttcacctctctccgatcaaagaaccagtcgcccaccgcttcagccacagtctgttcaccagaattgaagcagatgtgagtatatgacatgtcattgatcgcagaagcaaatgaatcagcaggactgcaaagaatataaatattggtcgacaaccagtaagttaagtactaccctctgatcagacttgatttcagcattctacatcttgctggcattcagaagccatgacgacattgcaataagactacaccatcaaactctaaaacgatgcaatatctaaccaccaaagtctgtaagttcaaatcctacgggggacatgccaacctatagttctataaacaagatcatatcattccgcatgtgttaccttattgtttattctcgaagcagatggggagtgccaagccaaagacttcatggattggcaatgtataaagcatgaatcaatgaacatgccccagccccttttcttcttgaattcacttatagcatcaagcagtgattttctaaaacctgaaaaaaatatttctcgagatggtaaggtgccaaagtgacagcggatggaaggtaaagtcatccagaaggcatgaagcagtagagcacatgtcatgagtttatcatattacaaccttgtagaatttcaagctgtttcgtattacacttggtaatatccattctgcaatcttgccacagattttgagggtcagatccgtctggagtcaagacatgctctacctgaaaaggacaacaaattttttatcacactaatattggagctgctaacagaacatggaacctgccaacagatacggataatggtacctgccaaacatcatatgctggattgagaataaacattggggtggtgatgcctttcgccacttcttgtgggaaaaagcactacaaggcacgattaaggattgctacttagcacataacagcttgaaaagtactgaataaaaaaggtgatgatattaatacaagaaacagtatcataaaaacaactaaaggattacctgccctggttccatatctgaactacaaccagggaaccgtttccgcaaatcctgcaacaaatcaacagcaaacataagaatcatacaattaaaaaaaaacaaaaaaagggtatacgcagagaaaagtgcagacagcgacctgttgacgagcaacatcattatagaagccccgcatataccttctcccagaaatgtcttccctgtaatgagaaaagttaaaggaacagtaaaatgcaagttttaagggctggctatacttgtgttttgctaatggccaatgccccagaagaagtgataagctatcctatgaatatgttgaccccaaaagtggaagtgtgaattatgggttattgggcacattgttggatgatcagcagtaaacacatg

SEQ ID NO: 78073 - DNA, 3337 bp, Oryza sativa
aattcctgcagccctcccttcgctaacttgcaagtactgtaaatgaatggttaaaataatatgaaacacattaaaatgaggagatcaaaagatcaaagcataaaaatcataaaagtgggtgtaaatcatccacaataagggcttaaagagattggttgtcagctacaggtacaagatatagaaaaatgacgaggaacacttgtagtacattattttagaggaatattgtggcgatcaggtgagcatgatcaataattgacagggctttgcaagtgaagacaacattcatgctgaaagtgaattattttccctgtatcaatacatattctagtgtggtgcgtaaaagcagccagaccgatccaatactgcgacaaacaataagatactagtaattcataagtcaaaaggttctagcagtgagtatgaataataatcgggcatcctattttaattggaaggaagaggaaacctgtttagcacgggctagacccttgggtagaagttcagccatgacggcctcccagatgcgctggcctctgaagaagaaagtggcgccatactgtagagaatgacggcgcagtacagtagaacaagtaagaaaatgtggtgaagtgaagtggggagtgtagggtatggtgactagtacagtgtataggaataggaggttggttggtgcaaataaacctggtgttcatcttggacatttccagataaggaggcaccatcacaatacctgatcttgaccttgttccagttgtaaaaatctgcatcactatgtatgtgtgaagtgaagtactccaatagcaagtagtagtaagtagaagtgcaaagaggtgagagagagcgattggatttgacctgggttctgggccttgtcgtcgctcaggatgccgacgaactcgacccgggtttccatgtaagcagatgagccaagactggttttcttgcgatgatcacaggacgtgcgattcctgcaccagctcccgccctctaggtggaggagccatttgttagatccgtcgccgaagcctggcagccagtggtacccaggcggggtcccgtcgaggcagacagcgcccttctccttggcgccgtggactagggtgaggtcgacgagcgtggggaggcggtggccgtaggacggggaaggggaaggggtgccgagcgagcgggggtgtacgaggaggaggaagaggagggcgacggcgaggagcacaagggcgaatgcggcggcgtggcggagaaggcggcggcggtggagcgccggcgcggagaagagaggcggcatgactgagactagttgttgttgttggatctgttgaggattccgtcgtcgtcatttctaatttctaaagccagcgggatccaggatccgggatgtatacaataataatcgcaaatgtagtacaaaaataaataatctcgctggtcttctcttccttcgccgactgatcgaagcgccgccgcctcctaagccaccgccgccgtctcctccagtccctccgcctctgatatcctcccttacagatggggccagccgcttggtggagctgaagcccaatcacatgaatgtattccttctgaccctttccttttttttctttttcaaaatttgatatcgtacatctaaaatgttgtccacctcttaaaccaaaacggtttattataaaatataaattaatttatacgtaaaacttttatatatttattaagaaagatttgggaaataccatcacaaatatacatgagttgcaagataccattatacgtgacaatgatatgtggggcttcaatgacacatacgatgatttttccaatttcgtgattggccctatttattcttagcaagttaaaagtcaaatataaaaaaactacgttgaaaatatatttaaattaatttcaaattaagattaaaaattcaaatttgcttttgctcattaggcctaccgatggagccatgaaattttggttatttgctggtggacatttatcccattaaaacgagctatggaatcgtctcgtttctcccgaccagttggattgcttctgcctcatcccttcttgtcgtccacgccgccatctccttggtcatccgcaacaacgaggagctcgagaagctgctgtctgggggtgaccatcgcccatggcggagtgctgcccaacatcaacctggtgctcctcccaaagagggccgcggagaaggccaacaaggaggccaagtcgccaaagaagaaccccgccaccgccaagtcccccaagaaggccgtcgccgccgccgagtagagtagagtagagtagagtagagtagagtagagtctgaatcgggtttcttcttcttctgctgtatgtaatgctgccgttagatctgatagtggtggggtggtattggtcctagctttgtactccttgcattccttggctaatggaagttccttccttacttttgctcccacatctgtcttgttcttggaaacgcattccgtgttctatttctgcaaaacgggattcttatgtgcttgcttgctacgtccggagtccctggactagcagtaacactgtgcttgagattgttggattggacaatttattaacagtctctgtccgagtccaaaatatgtggatttcacagggttccgattgtcaaaaacgacccgcttctcaaatcagtatttgattcggggatagatctagggtttaaagccaatgctgaataggagaccaaagctggtgccttacgcggcgactcccttcgggattctgtcccatccttcatctactgcccgtgcccgtgcctcttcctcctcctgccgctccaaactcttcattggcggtgcaaatttcctgcctacctgcttcgaattcgatatacattattgtgcaaacattgtctttggttgaattagtgttagctctaattcgctgcaaccacgcaagcctagtgctaatacttgtaccgctctgtcttgttttgatttgcaggtctttcttacgatacaaatgagactgctctcaaggatgctttctctcagcatggccatattattcaaggtacatctcaaaccatctgttcctttccgatgctatcaggtttctgaatctgtgtgtgtgaaccgacagcgtcctctccctgattgattaatgtgttgtgcagtgaaggtaatatgccacccagtgacagggaaatccaaagggtatggctttgtcaagtttgcctcagaagatgaagctgctgcagcattgcacaagatggggggtgaggtaggtttgctctcttgtggtgctagacaggcacaagtcaggatgttttgctataatatgcattactggggtgcaggaa

SEQ ID NO: 78074 - DNA, 1770 bp, Oryza sativa
tacataacatgatgaagactacttggcttcaaccatcatgctctcaacacatattacaacgcatatgtaacaattccatcaaaggaatatcgacacacgagcaaatgctatcgtcatatatattttgcacctgtgtttcggaattattctcatcccattactctgtcaagtccaaacagcggcttcagaagtatagagccggtggtcagggatttctgaattgaacaaatagaactagataagcattcatgtgctcgaggaagtcatataactgcagcatgtgttcctgatgccgctcatgcacatgttctaagcctgctctttgccatctgctgctctccagactatgtaccatacaagcatactccctccgtccgaaaaaacctcaaatcatggctttaaagctggacgaattaatgcttgtccaggttcttagtcaggatttgagtattttttgggacggagggcgtatatgttaccgcaccaactggctgcctgttctgaatcaaagcaaggtgaaacaagaactgacagaaatgagcttgtcagtacatgttcaaacttctaactgagtacaagtagttgtttaccagttgacacttgagagcccctagaaacttcattatttcttattgtagttgtaaataggattttcaggaaagcaaatcaatgatgatataatgccatccaaatagtatagattggagagtataaatgagagtgatgaaaggataatgagaataatggtgtgtgcaggaggtaggtgaaatggaagatagttataattgtgatcaaattacttttctctgttgtatgtactgctatacctactataatgagaagattgaaaagtatgattgatacagtacaatgcagttacagctaggtcgctgtggtaaaggacctgggctgtcaaccccttgtcactggctttcattcacatccatctgttagtttttcaaggacacacaaattaaattgtaggcaccatttgtacgattccaattcaaattaaattataatcaccatagtatatcagtttgagtttttcttttctcttcatcttgagtggctgatatgcaatgctgacatgttcatcaccgtcaccaaggtcaaacacattttagataaagataataactacatacgtgagggagagttaattagcttgcgatttgatggtgcagttatttgtgtggattcactgatactagtatagcacaaagcttcatactagtgctcaacccatgattcactgataagtgtttctagtatagcgcacaaagcttcagtgtagatataccagccactactagaaaaaaaaattttcatggcgttggtctatgatttttgctggcagaaaaatgccaaaaccgctagcaaagtcataacaagggggtggggggcaccgaccgccagcgaaaatggatctttgctggcggccacgctataccggccgccagcgaagatatgttcattttcgctagcggtcacttagatgcaccgccagaaaagatggataattttcgctagcggttgggttatatagtccggtagggaagatacaattatttttactggcagcccacttaagcaaccaaaaattgatttttgctggcagtagaacaacctccatcttttatcaccacgtacccatgtgttcttatccacccacctctccacaataaaaatatcttcctctcctctcagcaccaaatccagatccaaatcctctcctctcctcctcacctcaacaaatccactcctccc

SEQ ID NO: 78075 - DNA, 6055 bp, Oryza sativa
caccaaccgggactaaagatattagaggggtttgacatcacctaccgggactaaagatcaaaaagtagctctaaccttttcaaccggggctaaagataatctttagtcccggtttttattgcaaccgggactattgtggaatttggtcgaccgaccaaagatggtttctccaccagtgtaattagtcaagatttgtattgattagacataattattttatttcattgttatttagtgttgattagacacaattaacatattttattactaattattctttttattttcattctatccaaacttatccatccaaccaaacaaaaaactgcgatcatctcatccacacaaccaatggaaagaacgggacaaccatattttcaaaaaaatagatatatccaaccttgatgatgaaccaacaaaccttaaactttccaacagacccaatactggcaccgcaggttgccattgccgtctctcgtttcgtcctggttcttctcattcccaacctctctcctatgatcggttgtattgtttcctaggagagcatggcatccatgatagcttatgttaactattctcaccttgtgtttggttgtccgattgacatggctttttattggtagtgaactcagatatgtataggtgagtgagtagagaagtaaactatagtgtggagcaagtgggtgtgaaagctataagtgtcccatcccccatggtgtgattttggtgggtttttcccatataaagtttggattggggaccactatagaacccatttatttcctaaccatagtttcattggtaacctgcagtttgtatgaagagagaatgcaaatgtaagttgttacgcatgaacaggtccagtggcagacacaactttaaaaaaagatggggcggagatgctaacttcataagaagaactgaacgcaacatatatcatatttatatttcaatcgtataaaaatatagtataattaataaatcaaggcaaacaagaacattcaagataataccttttatttaaaataaagcaataatctttgctccatatataatttcatcatacaccaaaagaaaagtaaacccgtcaatttgcaaatagaagtcaattcataaaacatagatgagagatatcatttaaaattgattaatatatgagaaacatattgctatcaaatcactaagcctttctagggactgtagggacttaggcaaatctattcttcaatcacccatggcttaaaatatctgcataaccttttcaaaatcaagtcctctaaaaatctcattcttaatgtagcacaatattgaaccattcattggacaccctattgcataaatatgtattatattcatcgcccaaaagactcatttaaccgttgccattgccatatataggcagaagcagtgctaagtcaataaagatgatagaccaatgaaaaagcaatatgcatttgcgtttcaactatctttaaggccaaactaccaagatcatgacacgtagtggaaatatcaatacgttgcacgtgtagaataaatgtttcaagtcaaaatgtgagaaatcttggtcatagatctccatcaatcatgcgattttatcgacattaaactttagaggactctcttagatcaagagaagacaagggaacaagcaacacagatgatatatacctcattgaatcgatgatccatcttcatgataatagaatgtagaccctattgcagaagacctgaagtaatgcagattttacaagacaacgtgcattacatgtgtatatatggcatgcattttagaatcgtatcctattggtttggctttctaaaaataatagaatgtagaccctattgcagaagacctgaagtaatgcagattttacaagacaacgtgcattacatgtgtatatatggcatgcattttagaatcgtatcctattggtttggctttctaaaaaaagccaggtagtaaaacatctgttgtcgtaatcttgagataatagtcatatgcagctttttgtcaacttcgaaaggaggttcaaaaataggatccaataattgtgtactctttatcttgtattggtgtttattagtttgtgtttgcttcatgtttgggagtgtttctataagttttctttgagctgcgcacgacttaagtgaattggtgtaataattggttgtaactcgttgagcaaaggccgagatggtattctattccattatctaaaaaaatatatgttgtctaaaaaaatatattttagaattcgtggggctttatgtgtaatacttttgggctcctaggtatgtctgtactcggcatatggcattatattgcatatttatttgttccctgcctttgcactctgtttagtgttaggttattagttccctaatttttgcactcttcttagtggtagccatgcctagtaggtggagataatttcatttacggcgttgatcatgatctagaattcattccttttcatacttatcggagattgttgagcactactcaagtcccattgaatctcttgtttcttattttgtaataggattaggagacatgggaaatttggtaacttgcttatgattgagaggcgaggaaaagaaaagattgagaattttgccaaatttcacagaattaacgagctgaatgcctcggtaagagagtttttgtggtgcgatgtactcatcaacatttctcgttgggttccctagaggaaattgtaaattttgagactggtaatgtcaataaagagatgcatgaactgcaactttggggaaatttcaacataagattgttgttcttttggatactttacttatctgctacttggactttgcaattaaatttcaaccaagatataattgagttttgctaaaatttcagtaatggataccactctgggggaaccattcaatcagtacaccatgtactaatgacacaaaaattttagtggacttaacatgaataacggtgaggtttaaactctatgtttctctaaaaggtaaagtgtgttcaaaactggttattcccctgaaatttgaaaaaatatggttatatttccagttggccatcaaaatgtttcaacagtccaatagggccaatttgtgggataagtacaaaaatttttttttgttaggttcaaaatgctgcaaaagtgacttataaatcctcctcattcacctttctcatctgggacttataaatcatgcatatatttgtgcaacaccaaatcctcttgaaaaatttgtttcaatctgaatatcttccctaacggttacctgctaatccactttaatatacacttcagcccctatagatttgcatcagtttgtctggtgacctaatccttctctacgatgtcaaattactgtagacattgtatgcatctctgcttaggatggaacaacattgcccatgtgtacctcttatgtaatgattgttatgaaaatagatgcataacggatacacaaatttaacatggaaaagcgacgggcaccaaccggtaatgatcaatatagacgagttggatacaaactcaggggatacattggcctatcacaacctccccatatggtttgcaagagatatataaataagaaatccatgagtcctaacaggtaaagacacaaagtcctaataggaaaactaatcctataatacaaagtactttatgttcttcttgttatttatttgtataggggcttggatttggtattcaatactttacatttattttttaatcagttttcagtttaaactccttcatgttaccaaagtttcacgttggccctctctgtgtaatgtctatgtaaaaactttctttaatattttttataaataagcttggttgcaccatcttagtcttgttgagagtttatgtgtcattctatatatatggtagtcatgtgttggggggatgataagggtattattgtctttttcaatttttaggcttcgccatgtattctataagattcaattatatatcaggatgataagggtattattgtgttggggggaaaatgaattcaatctccatttatctcttctccaaattaatcagtctcactattttttgttcaaaaaatatcacgcgcatatccatctagcaccattcctcttgaacattttgttttgttgtaggaactgtatatttcggataccggatgatgcctaatgttgaagctacgctgttttgaagcatcaactatgttgtgcatcaagttcatccattggtggatcgcacttaaaaattaagtggatcagacatggtgaggtgatagggggtggtggtggcgcttgcgctacggtgaaattcctcgatgcattggtgagtgtctcagtggttgtgtgcatttgttgagctgctcgagttggggcgcttgaggtaggcacctcagtggttggccgacagcgaggcacggatatttctaatttttcatgacaactaacgaaaggaaaaaactaagccctcccccgctctccgctactgaaatgcatgtgtagcacatatgtgatggtgaaacttaaatagcaatagttctatcaagtgattgaaattaagcccgttggaataatatatggtgaaattcgccttgactttgcttaattataggtcaaattaattgagaaggagtaagattaggtgccactgacaggaaccaaccctgaatgactgacctgcatgccaatagagacatactccctttgtcctataaaaagagaatctttgatcagatatgacatattctagtactaatttgtagttctagaatatgttacatccgaactaggtcggttttttattgtacagagaaagtatgcctaaatttcactgacctgcagcaacaaggcaccgatcattgagttgttcgcggatcatggtacgaaccatattcaagatgccctagcgctgggccaggtggcctaccctaccatacggagccctccatacagttggattggaacaactatgtatgtgtgtacttctgcttatcggaattggaggcaccaggcaaatggagatggaatggaggtccttctaaatcccataatcacgaacatttcgtactacaacgctataagatattgtgcattgtggatagcctcacagtcgcgcattcacctcccgggtagcacgggcagctgcttgggcttcaatgcaaagttctctggcacatagcactaatccttcactgtgatggattaattcccgggaaagatttgcatgtgagagttagaaacggaaattagtatggagagttaagttagcaaagcatgcaggcatttgggcctgggtcctcagctgcctatggcctctgcctgcctcattgtaaaaagaaaaatgtattagtgcggtatatgttttcactcaaattaagcttcaacgtacttgttgttttatcctttcttttctccataaatatttacatgcattttggatccactggtggagaaaccgtttgtagtcccggttggtaaccccctacgaatccgggactaaagatagctatctttagtcccggatgaaataaccgggacgaaagatcggtgcaccattttttttatttgcatagccctgtttgttgcatggttgattatatatatatatatatatatatatatatatatatatatatatatacacacacacacacacacacacacacacacacacatatgttacaatacatatatatgcataatatataagcatatatatatatgtatatatgcatatgtgtatatgtataaatcatatattacacacatatgtataatttaaagcacttaacattttatgtgcatatatgttaccaaaatatatattaacactaaagtaaatttgtacatatataaatatatatatacatgcatatatagtacaattcatttgctcggtagctatagctacgacttcgacgccggcgttatgacagaagaggaaggaccgacgttatgaattgttgatccgtcgtagtagaattcaccatcgggattaagaacttcttcgttgatgaatcccatcagttgttcttgaacagccgtgataaa

SEQ ID NO: 78076 - DNA, 5241 bp, Oryza sativa
atgggctgaccattgcaggaggaatgtacggctggggatcctgggaccgatgtgcggccatacgttcaatcaccttccttgccacctcctcttgcatgctgagctcgtagctcgataccctgtactcaaaatctgcaatcttcgcctcggtatctctcttgctcctcatccaactcctatacgtgtggatgtcctccttgaacccaatcttccaaggaatcactcctttccctcgtgttcgtcctggatgctctggagtctgcagggcgagtaacagctcgtccttctctctgtccggtcggaacgtgccctgagaagaggcttccactacgtctgttagtcaacgcgcagcctcgcgtatctgatcgccgaacatcagggagccatcagctgggttgagcgttccaccgtgagcatagtaccagaacttcgattattctggccatttagcggtggccggttcgatacccctctcaagcaagctagcctctatctcctcccacttcggcatcgtgacgctatagccgcctgaccccaagtggtgatggtacttcttcttggcggcattttctttatttctttccatcatcgcttgcccttgttgccctgtcttataagccacgaacttgtcccaatgatcccttagctttgggaatgtgtcgaagttcggtgttagacccttcaggatgtatttcttgtagagatcccccttgaagctctggaactgttctgccattttcttcagagtccactgtttcactatgttctccgtacccgcgagtagcgtgaacgtctcgagcattatggtccacagcatctctttctctgagtccgggacaaagctgtcattatccccgcgtgcccttgttctgcgccagtacaccgtgctgacaggcacgttgtccctcacaacacaaccgcagtggcgtacaaaattcttggctacttctgccggggcactaggtcggccatcttcgtccacatcagttatgatgtgccgaccctctatcttcttcgcggcacctcgttgtccgtgtgccctcttctgtccagcggagggatgacttccactagcttcctcctcatcgttcccctcctcgttcccctccgcatccctctccacgttcccctcctcgttcaagtactggtttggatcctcgttcccctcttcttcgttccagtactggctgcttccctctgcgattgtatcatacagtatctgttcctcatcgcgatcagccatctgtgcatacaaaaaatatttgttaggtctataggtcatatttgctaaccgtaatattaaaactctactaatcttatattaaatatctaataatcttatattaaaattgtaataatcatatatatatgctaagtctaacaatcttatattaaatctctaataatcttatgttaaaattgtaataatcatatatgctaagtctaacaatcttatattaaatcgctactaatctcatattaaaattgtaataatcatatatatatgctaagtataacaatcttatattaaatcgctactaattttatattaaatctctactaatctcatattaaatcatactaatcttatattaaaattgtaataatcatgtatatatgctaagcctaacaatcttatattaaatctctaacaatcttatattaaatcgctactgatcttatattaaaaatgtaataatcaaatatgctaagtctaacaaacttatattaaatcgctacaaatcttatattaaaattgtaataatcatatatgctaagtctaacaatcttatattaaatctctaacaatcacttctttacatcacttgcctgcgcgaattcctttgatggctagctaccacttcggcttgagggacgacggcgacgtcttctctgcaacattaccaggaaatcttggtaatatatatatatatatatatatatatatatatatatatatatatatatatatatataaaatcttgtatgtattaccaggaaaatgtattagtctaaacgcgttcgttctcacacttttagtacaagcgcattcacgttcgtaagcgtttcgttcacgttcgttcacgctcgttcgcgttcgttaacgtttcgttcacgttcgtaagcatttcgttcacgttcgttcgcattcgttaacgtttcgttcacgttcattcgcgttcgttcacgttcgttaagcgttcgttcacggtcgtccacgtatcattcacgttcgttcgcgttcgtccacgttcgttcacgttcgttcgcgttcggtcacgtttcaatcacgttcgttcacgttcggcgatgttgggcgcgcgcggcagtggcgtggcggcggcgtctcgcggcggcgtcggggcgccgttggccggtccggcgacgtgcgggcgcggcggcggcttgggggcccggcggcgtagggcatgcatgcatgatattaaattgttaaaaactctaattaacatatgtaaatagcacatgcatgatttaaaattaataaaaattctaataatcatatataattagcatatcatgatattaaattgttgaaaattctaattaacatatgtaaataccacatgcatgatttaaaattaataaaaattctaataatcatatataattagcatatcatgatgttaaattgttgaaatatctaattaacatatgtaaataccacatgcatgatttaaaattaataaaaaatctaataatcatatataattagcatatcatgataataaattgttgaaaattctaattaacatatgtaaataccacgtgcatgatttaaaacttttaaacattctaataatcatatataactagcatatggatgatttcaatttgataaaaattgtaataatcatacataattaacttatgccatacaacaattgatttgtacggatattcaatacatccaaaatagtttacatcgtgtacacaacaattacgacaatacatcggcggtgacgattgaccgcacgtactttctcctcacaattgttccttccttgtgatcgctacgtgagtaaggggtgtcttcatttgataggaggatgctagggtcaatcgtcaccgtgaaagggggttgcccatcaaactaatcgtaatcctcgtcagtcttgtcctctactccgatgatttttctttttcctaggagaaccacatggcgctttggctcgtcaggccctttggccttttttcctttgctggacatgtccttgacgtaaaaaacttccgttacatcattggcaaggacaaaaggttcgtccaagtatccaaccttgttaagatcaaccgttgtcatctcactgtcattaatcgttacgcctccaccagtcaatttaaaccagtggcaccggaacagagggaccttgagagatccatagtcaagttcccatatgtcctcgatggcaccgtaatacgtgctagttgtaccatcgtgtcctatggcatcgatacgaacatcactgttctggttcgtgctcttcatgtcttgggccctcgtgtagaatgtgtacccattgatttcatatccctggaatgtcgcgatcgagccagatggtcccctcgccaggaaggccagttgttggttaatcgtctcgttacccatgagatgttgtcgcagccacgcggagaaagtatcaatgtgatgccgtgtaatccatgcatcggacttaccgatgtttctggcgcgaactagagccaagtgctcctcgatgtagggagccaccaatgaagattgttgcagaaccgtgaaatgggcttttgtcacagcctgattttcgtttaaggatttataaatcatttaataaattattaatagaatttatattaaatgttcattaatttacaagtgaagttaaatatgggaaataaaatttcctaaatataaagcatggttggatttaatttttattaaattctccatgattaattatactctctggaattttctcagatttttcagagctcaattcatagttttaataatacaaagaatatttcagtaattatttaattaataaattaatcattaaatggtctggttttaatattgttaaatactttgagtgtccaagtatgttcaagatttttcttggaattatttgagcaatgaaagtatttttaacaattgaaagatcatctcattggttaatttatttggaaaagtaataaaaatcctcctcctcagcctgggccgaattcagcccattctctcccttcctcccagcccagacaaagtctgatttacctccctggcgctacagtactccatcttcctcctccagacagagccgagccagccgtgctcgtgcacagtgccgcctcctcatccgacctccccgttgctcctctttccaaattagttgcgggaatggaatcctctcaatctcctcttccttttccccaagaaatccccaaaattttctatggaaattctttacaatttcgcggatcaaatccttcctttttccggcgagaaccctagactttcccgattttttttctcgtcgatttgggcccggacccgagctcccgtgcctatataaaggaccccctagtcgtcctctccctatcccctcaagtcccgtccgccgccgtcgccggaaacgctctccccgcgctctccttctctctccaagcgccggcgccgctccagccgtccctagccgccgcctcatctgcctccttcctgcgccgccacctccatcggctccgcaaggtcgagctccaccccggccgccgttccccttgcgccgaaacttcgccggaagccgtcctcgccatgaaccagtgggttgccgtcatgttccgatctccagccgcagctagcagccgccttagccgccgcttttggtcgccgctgctgccgttgggttcgcaagaaggagagggagcccggcagccatctccccgaagccgaaatccaccggagctccatcgtcgccgtcaacccgaagctcgctgtcgcattttgatttccggcgaagccctgctgctcctcccgtcatcgccaagcttcgccgctgcctccattggattcgcagctgcgaagtgaagcccggccacccctccgttgtcgccgcacatcgccggaaagtcgtcgcctccgtggacagtacctcgccgcccttcgaagctcgttgccggccatcttccgttgccgttcgtcgtcgcttaagtggtggtaagggtcactttgatcccctctcgctcccggtgccc

SEQ ID NO: 78077 - DNA, 11804 bp, Oryza sativa
  unsure (1)..(11804): unsure at all n locations
tgaaagtatatcaacttttttgtatcaatatgtgcttccaaagtacatctaaagcactcctttctgaactcacaaactaggattgaaaccacataaaccctaacttttctctcataaaagtcgatatatttctgcctcaacccctcgtctatttatacatcaaaaaacccctactcaaattaggtgtagaacttctattcacaataggactcaattccatgctaccaaaatcatacgagccagaatcctatccccatccatgtcggactctgcgcttgatctccagcccacgtgggccctgtctccagcttggtctccagccacctactaccgagccgctctctgccgaaatgcctaatcggcgactagtcgcgcgcctgctcccccgcgcggcgcggccacgtggcgcgcgcggagggggggtggggtggaccgggcagcaggaggacgcgagaggactgatgcgtgtctagttttttttggttgttcttcggttttcctctggttctgtcggttttttagtttttcttcagtttccctctggttcttctggtttttcaggtttttaatatatatacaaactttgtatacacgtatataaagtttgtattcgtacctatacaaactttatatatgtgatttttttgttttttttgattttttaatatgtgcgcatacaaagtttgtacatatcataatataaagtttgtacatgttgtatacaaagtttgtacatatcataatataaagtttgtacatgtcgtatacaaagtttgtacacgtcgtatataaaatttgtatatatgtatgtttttttatacatcaaaaatatatacatacagtagagtagtagtattagtagtagtagagtagagtagtactagtagtactactgtagacagtagtagtagtataggaggaggaggcggcggcggcggcagcagcagttaggagtagtactagacaagtactccagtactaggactagaggccacaaaatagttaaatggatagaatcgactaagcagagacatccataatcttctttacatcaagtaaatcctttggctcctatacgcctttttctttaagttatttattgtttctctcgagccatagggaaagtctatgataaataaaaaaacatctcactctttctctatggcccacatttcatgataaataggggaagatgttttcttcaaattctttgttcaattctgaacaaaaaaaagaaaggaaagaaaggaatttttcaggctgtggtatcctatatttcctaatgtatattgtaggaataatcaaactattccttacagcagtctggaacacttacgtcttcgcaaagcaaataatgatcattgtaatcgtaattgtagaatacgactacaattgaaatgcatacatttggttcatacgctattgggaagagtaggtttattttacagaccgggaactctctaagtcttaaagtaaaggaaagggccgcgatcgaagtaccaaccgcaaactgtgagtaaccttctctatttcattaactaagagggaattagaatctttctcgaatggctacccttgacaaagggtagctgtatggtatcataatttacatgtagtgggtatagttaagtggtaaaagtgtgattcgttctattattaataattgaatttgaaatgatatacttaaggcgtccttatgttttttatattccgatgaaaactttagttcttagaaaggatttactcctttttctctcaatagcatattgaggaagaatatgcattttcgcgatttgtacccaaagactaattgaaattgcatgcaaaaaacaaattggatttggattacgagtacagagtcacgaagcatggattccaatttttaaaatatgagtaaaggatctatggatgaagatacaaaaaaatttatttccaatcataactaaatcttcttttgttaaaaaaaggaaatggaagccaaatagctaaaaaacggtagttttggtttacaagaaccatcagcaaaanggctcagnnnggnggnnncccnnnnnnnnnnnnnnngnnnnanaaattttattatttaaatttatatttttatttttttaatccgcccccccccccccccccctcccnnnggccnnnngncnnnnngngnnccncggnccccntcaggcaaaaagagctganttagatgttaagtggtgagaatacccataaaggagcngaatgaaattaaaatttcatgttnggttttgaattagagaggttaataataatcaaccaangnngannataacttctagctttccaagctatcgactcgagttcattctcaccacccgctccattctgtataaaataactattctatttgtctagacatgatagaggcctgtattcaacctttttcgtccaccggtttccagcgctccagagcagagtagagcagtttggtatagctcacaaggctcataaccttgaggtcacgggttcgattccagtctccacacttagcagtctgtataaaaggactattctatttgtctagatatggtagagggctgggtggttgggcggtatccaaccctttttattcattagttccggaccctataaggccaaatttagcaggttgcgaagtaacttgctaccacaagaggaactctcaaggccccctaccttgcagaaaagaaaaaaatagatgaaagaaaggcacagtctatctcccttccctttaaaagttgtttgctggttgtttgtttcgatgaatccccagtttagggagccctgttgccgagttcgattctcgccgcagtagtgctctttttttgagtggggtgcaaagggggctaagatagtaaaggggtacggtactagactaacacctattacattaataaaagtagactaaattttttatcatggtacgtaccttactaaattaagctggcgagcggcgggaatcgaacccatatcttcttcttggcaaggagatgttttaccattgaactacgctcgttacgtcctatattttatagggtatatccacttgggtcgactgtctatgtatgggtagacagtttcattttctatttgagttttaattttattaatttaattgtctgtcaatcaattcggggcgcaaattacatttaagaaatgagagaatttagaatagctaccagaaagaccagtcctatccataatgatgtatcgaaaaatacaacgtttttattgtttgaacaaccatcaagagaagcaaatacaaggggtacactaaggactaagactgaggaagtcacaattaatgcaaaaacagctaattggaaagcaatagtcatatttctaatccttcaagttaccatcaaataaagttaactacgtattatatttgatccctcacttaatcaaaattgtaataaaatacaagtaggaggggtttaaaagggctaccacgagttaaaagagcttcctattcaattccaaaataaactaataaactaatacgccccacgcgagcagtcgcccattaggggccccgctctctgctgcctgggcctcgactcggcttgccacccagccgaagcctgcagcccaaacaactagctgcacgcctgcacctgcacgcagtacgcatacacatccatgtactgcatgctacacaagcatacacaccacgatacagtatacacacatatatgcatgctacattacctcaccgtactgtaacgctatctactccaatccaatttcttccaatatccttcgcgaacactgacccttgtacacacacttcgtgaagcccattgcaaagatctctaccacacgctgtccatccaccatatgccatctcgtatccaacttcgtcacccggtatccttgatcgtctggacatcaactcctccctaagtcttgccccgatcccaaccgttgaccaaagatgactcccaaaaatcctgactctagtcaccttctcacatggtatcccgatcgcagtagacctctgctcctccttgaacatagtcccggtcctcaccattgaccaaggctgacctcaagttacctgcacacaatcagacaaaacaactatttctgggtacagatatcacaacctgacccacattagtcacacgcactcacaccaacatccacacataattccaaaccaattcactaaataaatcattttgcaaagccaattgttcatcacaaatattaatcatgacaatgatttcatggtctgaccggcggagctatggcggtctgaccagtggcaggtggacggttcgaccggcggcaacaggacttcgtcatctgtctcgttcgaggtaaatcttttattccgcaaaaaattttgggtttttggttttttctgccattcaccccctctctgatagatttgtttggtcttgatcgatcatacatgctcttcgaattcaacatcaagaatgagatcccgatgcatctgggtgtggaggtggtgcggctagtgtacgttttcctgacgccactcatgcacatggtctaagccaggctgcaacttatattaccgtgtgctgctctataggctagcatgtgtatgtgcattttgccatacgttacagatatgttacagtcttgtagagctggttggctgcaccctcttgcatatatatcctctagttaattttatgatttctggaattgaatctggtggtccttttatttatagtatagaactaattggacaattggttggttccttgtggtggaaccaacccacctgggttcaagttttagacttgatatgggtgcttgcatttacagttaattattcttcggacgcgatggccgatcaacggaaatattgatcccagaagatggtgggcaaaatttgctacaagacataaaaaatatgtaattagccagggggcaccgtaagaacatgtatttgttgcagggcattgaaaaaaactggtaattagctgctggacactcgcaccattaatttattatttttggaagaataggatagagaaacaaccattaaggacaagtttgcccttggctcgaatgaatccaacgtgggccccacatgtaagcccctccacatctttctttcagatgagaggacggagcagcgagaccaggccccttcggccggcaggaggtaggcggtggtggtggcacaaccatccgtggtgagcgcgacggagggcgtggccgggacagtgtgctcggtgacgagccgctatggcgagaccagctaccgtggtggcgtccgcactgctgctggtactgctcctcatcttctcccctacatgtcctcgccaccgtgtttgcgcctcgtcgacgccgaatcaagcaaggcaaggaggaggagatccttggatccagctccctaccacccctcgccgcccaaggaagtggatctagagactagcaaaatgaccaagagatggcagagatgagggatctcaatggtgttggcgatggtgactaccgcgtgctcctcgatgcaagtggggccaagctgttcgcagacagcatgcacactgcgtgatcctctgcgctgccgtgcgactgcttggtcggttgggccatgtggtccaacgaatagtggtggagactagaccggaggggtaagggccggcgccacctcgtcttctcacccgccaccatggccaccgcctcgctagcgctcgtcgctacccctctatgtgaccacgcacgttggccctccccgttgatggctccgccacgccgtatgtactggcgtccccagagcatgctagccatccttcgtgtggtcaacgggaagataaaggaagaaaaggaagaaagaaagaagaggaaagaaaatagagcgcctaaggtagaaccgtacttacatagccgtttctctctccaattcttccggatataataaaataatcctgcgagtgtctagcagctaattaccagttttttgcaatgccttacagcaaatacgtgttcttattgtgccccgtaactaattacatattttttggatgtcctgtagtaaattttaccaagatagtatagactccatccacaagggacatcccaagcgccatggtgacaaggggcagcacacccacaattagtgtctaaacagggtgttattaaccttgatttggtttctgaaaaattcttacaagtcgatatccacttaagttatttggttatagagcaattttagcgtactatctttggtacttaaggtaccataaatttttgatacctccagatactttctagtgtaaaatttggtatatcgagatattaaaaatttgtgtgtaaaatgtggtacctcgagataccaaatgttggatggtaaaattgttgttggttacctgttcccagtatcccatattaccaatgttatgtgtgtagagttatatatcttgcgacctgagaagggcagggaacatatgtaatacatatcagattcttcccatttggaaacaccagctactcttgttttttccttaaatttccttcagtcctttgcctgaatgcatgctcattgctattgaacatacacagtaagaaaaattgtatgtatcccagcatcttggatttgggggaatcaagtaaagaaagatgacaagagaacatagacagtagaactgtgtatagctctgcatgttggatttggaggcgtcggtaaaatggagatggtatcaagctgcagtaacccatcgatgtttgcccctgatcttgcatacgagctcagcactgaaacagtttgaacaacatcctgagcggaagattgcggatgattctttgatgttcatcaagcatgatatctttcactttctataactgataaaagatgtcactcactttacagtgacaaaaaaaaaacagatttacaggatagtggttgtaaaaacatgatgtcactcactttctgttactgacaaattaaatgacaatgaaatttagacaatttttcttgaaaattggaattccagattttctttaaacttcataagctgtgtttgataaaagcaaaacatggtaagtccgataaccacgtggtgacctttgcatttgtcaaccttgccaaggagttacgtttgtttttagtcaatgccttatgtcctaagacaatttccttttctttctgtaaaattgcatatctcacatgcaaattattgcaaggtcaaaatttatgaaagagtagtttgatgtgcagagcgctactatatatgtacccctattgacatataaaagttgaaggaaattccagatagtaataaggtatacgatatgcatggagcttcactcacctgccacatcaacttaaacttatgataggaaacaactagtggtgagggaaaactttagaaaagggaggaagagtaactgaacaaagtgaaattgtaaaaatgagttgcagttggtgttgttttcttctttagttccacctcaggactcacctcttcataggcttgcgggcatacccaggggaaaaatcacaggtccgccactgtatacacaagttggataatgtgtaaaatagaatcagaagggaagaaatggaagtaacttaatcacatgcatcatcgttggatgtttttcctcttgcttcggctactgttgtttattgcgacaatgttagcgccatctatatgactgctagtgcagttcatcatcgtcgaacgaagcatattaagattgacattcattttgttcgagagaaggttgctttgggacaagttcgtgttttacacgttgcgtcctctcatcagtttgctgatatcatgaccaaaggcttgccagttcagttattcactgagtttaggtccagtctttgcgttcgtgatacatactcccgcttcgagtgtgggcgggtattagagttagactagatttatagcctatatatctactgtatctgtatatatctcttatttaagagtttgttataatcactattgttttggctatataaatacaatcgccccccacgttcggttgtgtggcgtccaattattctctatatctaaggagaaaatctgccaattgtaaaaatctagagatgagtagacacatagtacaaacattcattggcagcaaggtacaattatgtgataatcccatcttgagcatgctatacccagttatcaattaaaatgaataagtagatcaaaacatgcatttgataaaagaaacgaatggagttccctggatagcaaatcacagctaagatttgaataagacaggttgctaaattcagtggtctcccaaaaagtgcataagacttctttttttggagaggaagagttaattagttaattgtataacatgaattctctcaggaattattaatgagtccactaattgactagattttaaagaaaaaagagcaacatagtatggcacaacacaatgaaactatatatggctaactacctttttttaatttagggacaaataagtggattaggaatttggtttagcaaaatatacttctccatttgaagactatacatttatacaggttgggctagagtgttcagggtatctccgatgccatgccatagctatcccataatttttgttttacacataaaagatgcacacgcacctgaacaaccacacaagcaacgcacgcacccactgacgtatgcgtcatcctttaacgcacactcaataaacagatgtcaattattaatccctaacattactaatttataataaaaagcattcatggtgtacaaaattgtgggtacaagctaggatttaaaccatggaggatagagtcattcatccactactaggatttaaacctcgagcaagctgcagtcgtatatatattagcgtgtttgtttaaaaaagggcaaggatccagaagtgtgatttcaaattatgaacactcattttttttccaacttgttccccaaaaatgcttcagttatcaggcttctataggaagaccaagtatcatctttgaagttctggtgtacacactttgtttgcttaggacagcgaaatattaattaattgttggatttggaggtgttgagaaaacggggatcgcagtttgctaggcatcaaggatattatgtactagtacaatttcaccctaatgtgttcttccaagcatacattgttgtcgtcaatttcagactcaaaaggttgttggtgctacatcaagagcgtgttagctagtgagtgagacaatagggtgagctatttatcataaaagaaagaagttacattttctagctaggtgcagatgactgaaaacgtgattcaattctccactgatattttttgctgcactgatcgatgaaggtcattaagaaaacagaaaaaatagtatttcctcacctattgcttgctaactccttgctgttgaataacttttagagagagcttgggacaaccgtgcgcctacatttgaaaaattactggagaataaaattcttgagcctgaggctggtctatataaagggaatggagtgcttgaggatttttcatgcttgcatcctttttggacgatggacatgtaaatgtttatatgttcatttctccgtggaaacttgagtaaaaagtaattccgtggtacgcttacggtggctttgtgaggcattgggaatggggaaaccacacacttggttgtagccacttatagcactcagtttgcatgtgttaaatccatgactcgaggagcaactaggtgttctagctatactggagatgatggggaaagttgcctactatggtgattgtgtttacctaatcgtactaaaattctagctaattgattgtgggtagaaagaaagagtaggtgatgatctgtttgaattgggttccacttaaagttttctaaggtggatctaggaacatcagtggtaataaaaagaaaaggtgtttccaataaaatcgtgtaaagcacatgtcgccaaattgaacagttctatggataggtcacttctttctatctaacctgtcatttcgagttcgtctcgtgcaaacacagggtgtatattggtggctaggccagggtaaagcaactaatttggttctttagcatcattgcatacatggttgattatccaaggacaaagaaccatagactatatataaatatctaatattttacctactaactggatgacaacaacatgacctgcacagatagaaggactaggtctcatccaacataattacaattttcttcacttccttcttgcaagtttcggactggccgagaaatgcatagggatatgctggctagctccacaaggtggtgggctagacggcctgagttcgaaggcccgccccttctatttattgatattaggttctaccctaatattcacgtttctaagtttctgactggccgacagagtcaaaagaaagcatgttttatagtcaagagtaagaggctacgcgtgcacaaagaaatagagaggagaggccatatatatggtttacctctgcttataggaattggaggcactagggaaatggacatggaaatgagctcattctacttgcactatcaatagtagtgtcaagttagctacttgagttggccatgcaaaaatctaagagtttagaggcagtcaagaaagcatcttagaagggctacataagatcgccggtatttgtggagccacgtgcattccaatcatatggcgatttgggaaggaaacatgagaaaagtatctgaagaacctataataagcatcgcactgccgaaaagattgtttttggtttaattttctggttttaacttctctgttttgaatagactgatgatagttagctattgtagctactgcactgtacatcaggaagctcaaatgttgacttgaatggacaaagcagtactccaaacaaataatagaacaaggctggggaaggttttttttttttggcaagaaaggttaagagactttccgactttatgctcttataattttttaacaacaacttgctagtaactacactctaatagctcacttctcacatgaaaaaaaaatgatatctccatcagtatatcacttatgtgtccaaatcagaacatcattaattgtgctgatacccaaaattcagtttaaatacacaacttgggagtgctgatcaaatctatgcatggaaccgtaaatcctcccaaaacgttaaaattttcatccaagaacacacaacaatcagagaacgaaaatttatcaagcatgaattctgcgaacctaatgtgtagttgtgtacaccattgattgctgacactggacattttagccaccacctgtttgagttgtgtagctccgcacctcagcgtttgccaatctattattgttctccatatcttctgagaattacccaaacgtttggccgatgatcaacatagaaatcataaaagccagactaaaaacctacataacatgatgaacactacttggcttcaaccatcatgctctcaacacatattacaacgcatatgtaacaattccatcaaaggaatatcgacacacgagcaaatgctatcgtcatatatattttgcacctgtgtttcggaattattctcatcccattactctgtcaagtccaaacagcggcttcagaagtatagagccggtggtcagggatttctgaattgaacaaatagaactagataagcattcatgtgctcgaggaagtcatataactgcagcatgtgttcctgatgccgctcatgcacatgttctaagcctgctctttgccatctgctgctctccagactatgtaccatacaagcatactccctccgtccgaaaaaacctcaaatcatggctttaaag

SEQ ID NO: 78078 - DNA, 1513 bp, Oryza sativa
  unsure (1)..(1513): unsure at all n locations
agggagagaaaggaaaagaaaagaaaagagaggagaggaaaaagggaaagaaaaagagaaagaaaaaaaaattaagagggaaatttaaaatatttacaaatattgaatttaattgtaggattaatgaaaatatagttagataaactcttactaattaaatacctaaaatactagcatttaaatataggattaatgaaaatataattggataaattcctatagattatagataacttttagtactctccataagaaatcaattcgcggtattaatttagatgtagttaataattaaacaaatgtatgaattctcggaaattattgtggattatttgtgggaatctctataaataatcgatcaacggtagcattcggatttaattactagggtgttagccgtgtattatatttaatcatagactaaattgagtcgtataatattataagataattttaggattccgtccgacatttagctcgcgataagaaatttctaacctaatatatggatataatgctagggcnnncaaattaaaaacatacgaacaacaaatattggaaccggcaaaaaaatttaaaccaaaatgggggtttgccatagttcgcggttagtaaaataaataaaaaggaattgactttcgcattgaacttccattgggatttactgggatttttatttgaattctaaccgaattcaaatcaattttcgcacgtaactatagagaccgagggagccgcggatccaggtgaaagccaagaccgcaagacctcgagcaaggcaagtcatcactattccttgaacatgttgatcccaattgcgaaattattttgtttataaataaaattgcatgcaatgatgaatatcctacttgggattatgccatgccttgattattgtttacccttaaatctttgtaaccatgtctacgtatgagtccctagtcaattatgacaattgcttagaaatgctattctagaatcatgcatactcatatttatcaaatgctatatgcttgggcaattacctttgggaaggtaattgagatgcggcatgtggagacatgagcaccacattgccatgatgttgatgacatgatttgtgaaaggagaaataaaattaaacaaatgttttcgactggggcggctggaggacttgggtggtgtccggtaaaggctagtgccgtccctggtcagttaaggactgagccatgaagttaaacatgaaacgacctcagtacagccgtacttctcgaatgggtatagacctagcggagtagatagccgagcggaggcagtatccctgcatagtggtttcacttaggtgtgtggacgaacaagcagtttgctggcggatacccgatacggatggccaatggcggatacccgatacggatggctagagactgacttggcaagactacaagactacaaggagataccccaaaggggacagcgtggattgggttcaactacagaatgcgatgttaggcttgcgtgagttttccccctcggg

SEQ ID NO: 78079 - DNA, 1862 bp, Oryza sativa
  unsure (1)..(1862): unsure at all n locations
acgattagtatgaatatctcagtgataagcttcaatgtgttcaatctgttcactatagtcaccttactcttcattgacagctttgtgaccatcgattggagctccgttaagatgctgaagccgttggctgccctgttaattgcatcgataagaggaggcaaatcttcagcatccattaagtttcgtgtcatcgtcacaatcagagataaaactgccgccagcatttgtctgtccacagattcggcacgaagtgttcacaagcacctgcaacattatgtttatctcagtatgacaagcgtaacgatccaacacaaagactaattatcaccctatatatgatgctgataaaaataaagcaagtgtttcttttcttgcctcaaaccagactaaacctttggacttttaacctttaagggttccttgagggtctggataaatttcttcttaccagtgtgatgaacacccagttgttcgaggatttggccgggggttattttgtatccctgggaaatttgtttggaccaagtatttttgtgagatcaccaacggcatcatctttcacttgtaagattaacttggcatttgctttgccatgggaacatagcgtcgcaagcttttcacctaccactgccaacccaaaaatgatgttggcctccttataaactctgtgagtgaagatgagtaacaatttctcaatgaaatattccccatcactatgttagaaagcatgcgctcttgcattcatgtgtaaatgtccaatgcttgcataaacagggaactatgatggaacgatcccagcccacatccttggcaacctagaatcctctccatactatccatggcgttccacagtatcctgagatattgcggcagacttcctagccagtctgaccacagaacatacacaacccggacaatcacaaccatcaaaccatgcactgttctgaaccacgcactattagggtcatcgttgtggttgagcaggccgaaccgcaaaggcgccatgatcttggctagcaggccctccgtcttgttgatnnnnnctgacagttcctcgtgtgcaacgagcttcatgaagatactcaaggcctggcacatcagttcttcgtaattaacagggatgttgccatcacaatccgtagggggaccttcgagcagaaaagctgtgcaatggatcccttgtggaaactgctccaggtggaggtcaccagcaaggtgcgccacgatccttgcagcgtgctccctcgcctcggcattgtatgccctcgtacaatcaagtgactgcagcagtgtgtgcaggccgccatcttggctgtaggatgccgtaggaggagctgctttaccattgctttctgctcttcgacctcgacctcaacctcgagaaagaaattgtacttgtacattggcgtattcaggagggagtccaggatcctcaccccagagaggaagccatcaggggatccagacttggttaaaccgacggcatatgtgaccaggttccttcctttgacgaatgacgggtccttctcacacccgatcatcgtctcttgcatgtacgccatcactgactcgctcaaactagtaacaaagcgatatttgttaaccaccaaatccaccagccttttctgctcatagcacaatgtgaaccggtaacagaagagcacaccctgtagcaaggcgatggagtagacgaacttcagcgcagatttcaggttggcgccgccattgttgacctcacccccgtagtcatgctgtatcagacgacacgcggatatggcagtggtgatgatcagcccaaacatgtagagcaccgctagagggcagatgatggtggcaaacacgaacaaatggagcagccatat

SEQ ID NO: 78080 - DNA, 637 bp, Oryza sativa
gcgcccgccaccgcctgcgagggcgggacagctcgccgccggcgccggcgccgtcgtcgtcgtcggaggaggaccaggagaggagactcgtggaaggagccatcggtggaggaaacaatggaggagaggcatggttgcggggtgatatagaggagaagagaatgggagggaaagctcctggaacgagctgggaatgttcgcttgagctcacattttgttactgtgttcgcgagcgagtgcacaagtggagtgtttttgagtaatccatgacgtgttttgagtaatctatgactctgttggctcgtaattgtcgattggttttgggtttgatcccttcttttgtggcaatgggtttttgcacttttttttctttttcagtttgagatgttaaaagtacactttagatagcataaacttttattttgcatatttgtgctcatttaaaagaagacagttgtggtggactccgcctactcttattacagtaagtttttacaaattaccccttgaactccttaatattaaaaggatccaatctaatggatagccacataaaattagattaagatgaatatttcgtttagaaaaagatgggtaacacattaatacattttctttaatccatagcaaagcaccg

SEQ ID NO: 78081 - DNA, 4120 bp, Oryza sativa
tgtgtacaaagtttaaaattccacaacttgatcttgctgaattacctgtattgatccatctgtagctatgttgcgagctatatacgacaccacaagaacttcttaacactcttaggcgttgtttagttcgcgaaaagaaaatctttagggtgtcacatcggccgtttgaccgaatggtggaagggattttcgaacacgaatgaaaaaattaatttcataactcgcctggaaaccacgagacgaatttattaagcctaattaatccgtcattagcaaatatttaccgcagcaccacatgatcaaatcatgacgcaattagactcaaaagatcgtctcgcaatttacatgcaaattatacaattagttttttttcgtccatatttaatgtttcatatatatatctaaacatttgatgtgtctaaacatttaatgtaacagaatttttagaagtttgaagagaactgaacacagcctaaataaagccttattttgcaacagatgtgcgtccgtctagttactcgtctactacttttgtttgtttttctttcctgaccagctgagctcagcaccccgtaatactgtagaatactgtagtattgtagcgttatcatgggccggccattttgggcctagatgggcctgttgtgatacgtgggctgctctttatatctacgtttaaccttttgttattttgatgagaaatttgcatatatgccatccatagaaattggctttgctagaataccatcacttaaattggatttgatcaaatgccactctcaactagggtgtattcgctggaatgccatcttaagaccattttgtccttaggcttcttcttcctcccatcaatgtaggaaaaactcgcccatggccatcgcaagctatggccgctaacagctgttcgcgtgcccccgttgtcttcttgctcgtggcagtgttgacacaaaatttgtcgtacacacgaaggcctcaatgattttcttagctctggtgcagatcctatcaatccggtttagggcgtgacaattaatttgattctacaactaacaagaaaaaaaataaaaaggttagatcatgggggccaatcggccaaagggtcgatataataccatgtgccaactgaatcctgaataaacttgccaaccgaatcatctataattacgacgttaattcattatttgactcggtcttgactaaaggtaattgcctaattttttgattgggctcttaatccagtggcacggtgattgggcccaattacaggtattttgttgggtttatgggtccaatattccataggcttggttatgaatataatttttcctcccctttatgtttatttcttctcaactttggtagttttgtcatatacatccaaatatacatcaacactcataaaaattattagaaataaaccctaccactattctggatgttttatactttcatatttatgcaggtatttgatagtgtaaaattggtatttaacaaccgtcaacaaccgcctcgccggacgccggccgctcggccggttgccggcttggcggcttgccgctgccgcaggcccacagcggcgcaacgctgccgcccgccttctcctgtctgcccatctccgttcccatccggactccttctcagctgctccatgcctccaccgatccggcgctccacccttcagcccaggtaacgaagagtgaacagatcaacagaatagtttcctagtgcctaaatcgatttgtgattagagattagtgaatctgtaaataacttaatatgcaatttataaattattactgataagtgaatgtggaccgttgtttttaggattggtaaaacatgaagaggagcggagatattgcgtcgctatttcggaaccatgaagcaaagcaaagaagattgcggtggtgtttgaatctcataaagatgaagatgaaaaataaagattaagtgtttcacacaaagcgaggtggtaataacatgtgattaattgagttttaattgttacaaagttgaaaaatagattaatctgatattttagaacaactttcatatagaaagtttttacacgaaacgaaccgtttagcaatttgaaaaacgtgccacttttatcaaaattgattttcaaaatgctcaaaatccgtcaactttataaattttgagggttcaagtcaagtccctctttccctaataaaaagtccattttacttcctaactattgtaccaacctctgtagaagaaacgaacaggaccgcatgttgcttatcttcggatgaggtcattggtaatgaagctcctgaacctggagaaccaccaccacaagttcctacagttgatgatgaagttcctataccaagaaaaaatttgtggctacgccactgccgagtacgatacttcctaattgcaacaaaaaaatttctggctacgccgctgccgagcacgacacttcctaattgcaacaaaaacgtgaaaaacacatcaaagtctaggtacacatcaagtatgaccgaccggccgaccggattttctcgtcaatgaattcttgtagcgcccgttccgtggtggcgcctagcgggaaaattatctcttaaaaaccctaattgcgaaatttgcttctttgcttattgtctagtgtctgtgccatctcaagatctcaatccccgatctatcgtcgagttcaattccgaatccaaatccttcccatcaaattcctccgcaaaagtctattttgcctcccccgaggtcgatgggccgaaacccgctcggcccatctctcccccggccccctctctcccgggcgccctcgctctctctctctctctctctctcgccctctcccctccccggcgcgctccgcttctccccccactcagctccgctccgcctcgcccgcgcgccgctcgcgcgagcgcgtgagccgcgccgcccgcaccgagccaagccctcctttccgctccctcgctgccgctccccgcgcgttgatcgcgcgcgcgtccgcgtggtcctcgcccgcgtcgcgtctgcgccgcccggccccgctgccctgccgcgcctgcagccgctcggccccgcagccagcgcgcgtgccgagccgcgccgctccatccgccacgcctcccgttgcaagccgcacgcgcgtgccgtggtggccgaccgcctggtcgccgccgtcgtcagcgtctgcgcgtctgtcgcccgtgtcgtcgcgccgctccaaaccgcccgccgtcatcgccgtcgtcaccgcccggcccccgccactccgcgcgcaagccgccaagggacggaggcagcgcccctcctctctctgccgggtagcccccgctcccctcctcctttatcccgaatcggcaaaggggcaagcccccctttctccccctccttttccccttttcctcctcgccggcgttatcctccctgtcgccgctttggccgcgaccgccgagcgccagctcgcgaccttgaccgcgcaagtcgggtcccaaaccgacattgccgcccatttaaaccccagcctcccctttcccttcctctcccattcgtctccgcgccattgccgccgcccccgtgctcagtctcgcctccgccgtccttcgccgagcgccgggagagccggtgcgttcgaggacgcggaaggggacttcggccgcgccctcttcttcctcttccccggcccgaggccggagagattactcccgcgccgtcgacctcttgtcacaacgcccctcctcatcacggtagtgcctccctccgttcttcctcctcgctccatcttccccccttagatttcggtagtagctcgagtagcctccccgtagttagccggcgctgccccgaccgttgccgtcgctcgctgtgtgctcgctgccgtcgccgctcgagctccgtagcacccgcacgtcaccagcctcgctcggcgtagctccgtccaatccgacgctagcgtcgagttcccgaagccgcgtagatgctctcaccgccgggaatcgacccctcgtggcctcgtcgccgtttccttcttccctccccgccggttgtcgccaccgcaattcgccgccgtcaagctccctccggcgaatccgagccgttggctcgtctcccctcatcagggtaccgagct

SEQ ID NO: 78082 - DNA, 8998 bp, Oryza sativa
tcttccctccccgccggttgtcgccgccgcgattcgccgccgtcaagctccctccggcgaatccgagccgttggctcgtctcccctcatcacgaacaaccgcccggtgtgctcgcttttgcccgtatcgccgtggttcgctccgccgctcgccgccgccgcccgccatccattcgcggccgggtcgtcgtctaactcccgccagcccacgtggccgccacgtaggcgccacgtcggcgccagctcagcctagaccagggtcgagccgaccccggtcagtccctccccgtgcgcgcgttccaccgcgagccgtgaggctgcgcgtgggcccgccgcatccgcgtccaccgcgagccgcgcgcgtgcaccgcgtccctcccccgcccgcgcgcataagccgcgtactccctccgcacggtgagccgagccgctgataagcgggtcccacccgggaccgcgcgtggtgagcccggtccaccggactctctctcctccctccgcgcgcacgcgcgtcttgggccttcttgggccggccggcccgttaagctcggccgagccaccccatttcccttgggccgcgccttagccgcccgaggaaaagtctataatccctccctcttttcttttcaattcttttcttttccaaaaggatttaattaaatccttttcctttagaccaaaaatccaataatcttagaaattcaatatcttcccaaccgtaaatccgtttgactccgttcaacttccaaaattcctcaaatctcgagatctatctaatggcatgcttagaggtcattaatagggctttattttttcgccgtttgttgagttgtcccatttcgcgtgtagtttcggagcccgaagacccgcagcgcgaggatttcgaggatcaagctccagatctcgagcaaggcaagccacctttgaacatcttgagcctatatttgaaatttaattaagttgcttgaaaaatattatgcattgataggatcgcacttaatctgtttgtcccgtctgcaaggcagattggcggacctacctagtttgttgcatatgatccttcctttgttaattgttataccatgttcccttgtaaccacccagttgcgcctcgggaatcgtgcactctgtgcgagtaccgacggtcgccttcaaacttaaaatctgagtaacaacttgggtaaaacttgggttttacaaaagacttggaaaacccgacacctgggtcggtgcttgcgaactaaatgaatttccaaaaccgcggaccggggaacgtaccgggtgtacggttttcccgctctcgcacttaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgttggctttggaaatgccttgtcatgaaagcttggaggtctcccgacgtggctgatccccacgggctgggtgatccgggttagtaatgttgtgtgggtaaagtgtaccccctctgcagaggttaacaaactgttcgagcagccgtgcccacggtcatgggcggatgtgaggtgattcctagcgtagttttgtttgactactgcttgtgaaattgctgttgtgaaaaggggttcgatgtttgaaaaatcagcagctgacgggatcagctaggcccgggtggccgattgtaaagttgttggcccgggtggccgtttgaaaagctgttggccgggtgccaatcttgtttcaattctaaagactgatacattgcacatactccgaccggacgagacgcactgtctcatccgtgtcgtttgagaagcactcacttagttgtttttagaaaagagttcaaataaaatcaattacgaaaacaacagcctttccttgaagcctacattaaacacttatttccctggcttgctgagtactcccgtactcacccttgctctatataaatatcccccccccccagttgctgaagaagatgaagcggatcctgctgatgaggagttcttccaggagcaagccggctatgatgagttttagggtttcggcctagttcccaagtcgcgcctgtgttgtttggtccaagtcctggcttccgtttcccttctgtaatgcagttgtgagctcgggatctgtccgcagcccaacatgactgtacctctactctataataaagagacctctgttgctgtgatattctgtctccctgtcataccagcactatttcctgggactggtatcgattaacaggttaaattggagcgtcacgggctagttccggtcgggactagttcggggcgtgacaattctactattatcaagaggtagctagccatggcatgaatgatatgtatccatggcaatgtggatgaggtcctgtttagttttcacgcaaaaacttttcatcatgtcacatcgaatatttggacacatgtatttagtattaaatataaataaaaaaactaattacacagattgcgtgtaaattgtaagacgaatcttttaagcctaattgcgccatgatttgataaaagtattaattaggcttaataaattcgtctcgcaatttacagacggaatatgtaatttattttgttattagactatatttaatatttaaatgtgtgtccgtatatccgatgtgacacgccaaaacttttcaccgtaaaactaaacagggcctgaccacaaaatgccttttagcctagttcaccagaatgcagcaacatcagcacagctgcaagttgcaagagaaaagccacacagcttgtttggctattaatggagaggcagattgagacgtgtgcgtgccaagttgaagactggatcccccgttcgaatcttctaaacatgaagattaagggattaagggggtggttaggtatagggatgtaaagttttagcgtgtcacgtcggtatctaattacataatccctcaataaacagtgagatgaatttattaagcctaattaatccgtcattagcaaatatttaccgtagcactatattgtcaaattatctcataaattagtcgcaatttgtgcaattaattattttttaagcttatattcaatacttcatacaggtattcaaacgttcaatgtaatatggtgtaaaatttttgtgtgggaactaaacgatgatggaaaatgaggggtgggagggagaaagaagaaggtcagaggtaaattggtcgaggataacattctagcgtagattgagtaatggcattttagcgaatccatggtagatatgtaattttgtacgaatatgtggcacgcttctctagccgaacggagctttatttgtggtgccacgtcggtttataagattcctatctctatatatagcagccaagtaagttagggaaagaccaagttagtttgtagctcagcaacaactcatcctagagcttgcagagcaagagggagttgaagtatggcaacctctgttccgagtgtactactactacctgtgcctacctgcaccgatatgctagtctcaccagtagaaggaggagatctgctgcactgtaaaccccactttgatcaccatcctaatgtctggggcgattactttcttaccttctcaccctgcactccatcaatggtaaaacagcacaattaaatcagtaaattatatataatttactactacccatatgcaattttcctatctatctattattcttcatttagagatatatagtacgtatagtacatataaatatgcctaacaaataattaattacttcgtagcataatcgtcctcgcatgtatatgtatatgtagcttctgaatatgaagagaaaagctcatgtttccgaggaacaagtgagaaggatgatacttgagtgttcttctggccccaatttgcacgtaaaacttgagctcgtcgacaccttagaacgtctttgcattgactaccactacgagaaggagattgaaaatgtgttgcgccgggttcatgaggaagaagacgataccgacaatcactatgacctccacactacagctctccggttctatctgctcaggaagcatggatactatgcctctccaggtgggtgtgtgtgtgtaattgacgatgatataccatatttttagcatgaactaatactctcccttagttaactaagattataagtcgttttgagtttggtcaaacttaaattgctctttatttgaccaagtttgtagtcaaatatagtaatatctatttataataccaaattagtttcattagatctaaaattgaatacattttcatattatatctgtcttgggttaaaaatgttactactttttcctacaaactcaattacatttggaacagtttgattttgaccaaagtacacaataacttataatttgaaacggaggtaattgaatatatgcaatgaaatatgttcgttgtagatgtgttccagaggttcagggacgaggaaggaaatttcacacgcgatgataacaataacggcacaagaagcatgctgagcttgtacaatgctgcccatctcaggattcatggggaggagatactcgacgatgctatcgtcttcactaggaactatttgcagtctgtggtaaaacatctgcagtcgccaatggcggacgaggtgtgcagtgcacttaggacccctcttttcaggaggccaagaagagttgaagcaaggcactacatctcagtttacgacaagttgcccacacgaaatgagaccattttggagttcgccaagctcgactttgggattttgcaatctctgtattgcgaggagctcaatatcctcaccatgtatgttctaaaaatcactagattaggtccaattatcgtttctgctataggaattggatgaaaattatcatcttggtgacatgcttttcaaactactaaacaatatgtttcgtgcgaaaactttctatatggaagttgttctaaaatatcagataaatctatttttaaaatttataataattaaaactcaattaattatacattaataccatcttattttacgtaaaacacttaatcttcatcttcatctacaccacaagagaataccttattatcttttcgtgctagctataatacctgaaccaaccctaaaattcaaaacatgcataggctcaattttactgtccttgccaaggtattgggagttaccaaaattcacctatatatctatatagatgtccaatttaatgcatgtacatacaagaactggacctagaatgtgaatttttatttattatttcggtgtggtgaaggtggtggaaagagctccaactccaggatcatctaagctttgcgcgagataggatggtggagatgcacttttggatgcttggagttctcttcgagcctcagtactcatatgggagaaccatgctcactaaattgttcatctttgtctcgattttcgatgacatctacgacaactacagcaccttggaagaaagcaagctgttcacagaagcaattgaaaggtcaattgattaagtttcttcttttaataatgaaattcattccgaacttaatttgtttcaaagaagctgcatggagccaaaattcttgtctttaacttgaatttaatttttatcaatgattgaaccataaaaatataatagatgggatgaggaagccgctgaagaacttccaggctacatgaagttcttctacaagaaagtactgaccaccatgaaatccatagaaactgatcttaaactccaagggaacaagcatgtcgactatgtcaaaaacctagtaagtagctagtctcatcaactacctgcaggcaggcaggcagctgatctcattgatcacaactttaactgcttggttaatcttgcagttaatcgacgctacgagatgcttttacaacgaggtgaaatggcgctctgaaggtgcagatcaggtagctgctacggtggaggagcacctcaagatttcagtgccaagcagctgctgcatgcacgtccctgtctacgccttcgtcgccatgggaaacgatgtcacaaccgatgatgctatcaactggggcatggcctaccccaagatcatcacatcttcctgcatcgttggccgattactcaatgacatagcttcacatgaggtatgtttgagtgttttttttgggtaattttaccatcttaccaggaggtatcatattttttatgtattggtacctctagatacttactccctccgttccaaaatataagcatttttagagttagacacggttattaagaaagcaagtagaagtgaatggtggagggttgtaattgattaaatagtgaaagtaggtgggaaaagtgaatggtggagagttgtgattggttgggaagagaatgttgatggagaagttgttatattttgggacaaatcttgagagctaaaagttgttttattttaagaccaaaggagtaatatttaaggtttctgaaattttgatgtaaatttaggtacctcgaggtactttcttaaagatcgtaaatttctcttttttgaaacttttttacatcttataagccgaagagacatgattgaatcaataaaaaaaaacaagctctatatagtatctgctaattaattacttattttgtccccaaaatataagaacttatgttcggatgtgacattttctagtaatatgaatctgaaaaatagaaaatgtcacatccgattctaagttgttatattttaggacgaatggagtagttaactagttgctaaatatttctcttaattaatctgttcgctaacttggatcggccaattaatttccttattattgaagagagagcaagggtcttcgtcgtcgtcgtcgtcgacggtggaagcctgcatgagggagcacggcggcatcacgaaggaggaagcctacgcgaagctgagggagctcgtggaggagtcatggatggacatcgccggggagtgtctccggccggcggcggctcaaccgccgccgctgctggaggccgtcgtcaacgccacacgcgtgctggatttcgtctacaaggacgaccaagatgcatacactcatccaagttcgctcaaggatacaatacactccatctacatcctctctgtttaattagttttcttctaatgaagcgtgactgtatttcaattattaggtcttctatatatgtatatgttgaactttgggaatatttttgccttgtaaaatatgttttttttccattgaaatatgaatacagtggtattacttttgtgttacttccagttccgtttggacttatttggttttgtaggagaacttctatatataaatttttttcatgaaaaatcaacaccgtttaatggtttcgacaatcgtgctcatgggcaacgatggacaaacccaaccgagaatctacattttatttttcggggaaaaaggaatatgttactcctcacaaacaagacgtgagatgaaccgagaatctacactgatcacagcaatctagacgtacttactacttagcttacatgttggttgaaattaacgaatgtcaaatcttcaaatatgagctcatgtatattactacctccattccaaaataagttcatctttcacccatcccacacatactgatacaaaacctaaaagattaaaatatctctactttatcaaatccccatgtaattatttcttactttatctacttccaatacaattattctctactttcacaaactacaatacaaaggttactttaaaaatgattttttttgagccaaaaatgaacttattattatggtcctatggagcagaggtagtatatgtagtgtaggatactgctggctagtactgatctttgatggttttgaagtgttctctttgcaaaaaacagtcaaacagatcttgttgtgcccctctgaagtctgaaccccaccaaactcctgtttcagttcactccattctacccttgctctccgtcctgctgcagatatcttcagagtttcacatcccactctgaattatattgttcagcatatatacattgagagagagagatcaaacataatagtagaacggtagcactgatattggcttctgaaaggaatatatgccccagccaaacatcgattgagaagcttgtcaagaatggcctgcagcgggttcttcggtttcaggtgaatatgttgaatatggaaagcctagattatatatcacaaccttcacatgcatggctgatgaactctccacccttgcttacctgcttaatgtggaaaccaggtccgcagtgaaatgccatgtagcaaagcatctccatccaaacattcatgatgatatcccatcgatcatttgcttctttcatcttaagcagctccttggcaagttggccactttggattaacacaggctcaactgccgtcagtattcttgggtgctcgaaatcctcagttagattatctatctttgcagctacacttctgacaacagcatcttgatctagagcttcctggcggtcttccagacattcaacgatgaattcctgagcatttctaagccgcatgtgcccatcattgccagataggatgccatgctttgcagaaaggtacatgacatatttagatagttctctgcttggacctctggatggagagctgcagcctagctcatcttcatggaagaaggatatgtccgtcgcaatatgccaagcaaggacagcagacatgaaaccggcacgctgaatgctatcgctgatcagcacctgcagccgagctcttgatgaactttcaatgtgcagtttgctcctcatgagctccaactttgcccattggccggtgaatttgctgatgtccccacacatcatctgaatgcaatctgctaccaacctg

SEQ ID NO: 78083 - DNA, 1115 bp, Oryza sativa
aatcggagggataagttgagtcggatgaattccgcatgaaaattaattaatctgaatgaaattaatagaatgacgcatcagcataaacaaattcagcatgaacattcgctattgaaatttttggacagaattatcctgagttttcaaaaacattggccacttgtagacatgttcactactaaaaaatggccaagggggccggttcttaaagggccataggtgtcggttttccacctggcacctatgggtcagcattgatactagcaaccggcacctataaaaaaaataaatcggcacctttagcattgctcgagccaaaaaaaaaaagagctggctcgtaccaagccgaactcactaagtgctatcagtgtgcatgcgcccatcccaaaatcaaatcccaaaccccaaaatcatccacatatcgtccccaatataaattgacatcacagaatgaacatattcaacaacaaattcacaaaaacatgttctacaaatgacatcacagaataaacatatactagcaaccgctagccgcctcccctcttgagccgccgcctgccgctctccacctagcggaatcggcagaggggagggcgccgccacaacccgtcgcccgccgcctgccgccttccctcccgccagatccggtggaggggagggtgctgccgccgcccgtcgcccgccacctcccctcttgcaccgccacctgccgcctcccctcctgctggaatcggcggacgggagggtgccgccgcaacccgttgcccaccgcctaccgcctcccctctcgccagattcagcagaggggagggggccgccgccgtccatcgaccggcacctcccacttgcgccaccgcctgtcgctacccctcccgccggattcggcggatgagagggtgccgccaccacccgttgcccggctgccagtctcccctccagccaccgccgtgcgtgagagagaagtgagaagcgagagagagaggcaagagagagacagacgagagagacgagagaggtggagtattagataaggttgagtgcatggttgactcatatatccgtagggtataaggccaatgcgttggcctagatcagctcggaggctcggctcggtt

SEQ ID NO: 78084 - DNA, 1100 bp, Oryza sativa
cgctcctagtagtatctctatataattcatagatttttcttttgttttgtaaggagtactccctccatttcatattataaattgttttaacttttttgggtttaaccaagtttatagaaatattagcaacatctataataccagattagttttattaaatgtagcattgtatgtattttgataatatgttgttttgtgttgaaaatattgctatatttttctacaaacttggtcatacttaaagcaagtttaactaggaaaaaataaacctacttcatatataaagtcacaagaccttttatccaaaaattgaaactttcaactaaaagttcaaaaaaattatactcttggctcaaactttcaatataaaatccaaaaactgaaacttcccaaaaaaaaatcaaaaactttgtgctcttggctctcaatctttcgatacgaagttacagaatttgagaaaactttcaactgaaactcctcacgagggtgtcaagtagggatgaaaacggtcggaaacaatcggaaaaaaggctcacccattaccataaccatattttttctcagaaacaaaaacgatatcggaaatatcgaaaaaccagaaagggcagcttcgctggatgggctctccaattaatcttaattaaataattccctcaataagaagaaaaattatcctcagtcaatttcttgaccattgttctacaattttacttataaccaaattttacttataaccaaatattacttatgactttatagtaataaatcccgtaggctgcagcaacgtgctggatatcacccaacaaacataaaaaaaaaacatgccatgttctagtgagcatcttgatcgcggtaggatagctagctaaataaagggtcggatgcgatatggatgctagcgaatagagcttttctgaatcgtcattaatacaaggaaagagggaggaggaaccagaaggagaggagcaatagtttgggggatgatcccctccattaatttctcattctggatctttgctagggatggataaataatcttatcccaaacagaaaaggctagagtacgggtatgtgcttcacgtgaaatgggaaatatatat

SEQ ID NO: 78085 - DNA, 1421 bp, Oryza sativa
tttgtgcacccctggattcaactcccatgggagcgattttttcaagatttaacggctttgtgctttcaggggtaggtaacgtatccgtcgacagcgaggcgcctgtgatgactttgtccactccaggatgaattggccggcccagtcttcaaaaatgctcatagggatagggtttgcgtgcgtgcgatcataggggtgattgtgcgtgcgttgtgagtgtctgttttgtaccatgtaattctaaaaaaaaaccatcaacaagatccaagtgaaaaccgaagagaaaaaatgaaacactaaaaaaacccattaaaacacttcgatctaactaatgaaacatccaaaccatttttgttcactggcatcgagtttcgcaagcaggcgtgctaagacagccgctagcaaaaataccatttttgcaggtggcaaactaaagaggatagccaatgaaaacatgttttgggataaaaaaaatttgaaattcgagatgtcatcgtatgagggtagggtagggtcgacgacagcggtcggcctgcgaggatcaacggccgtggtccagaggaccaccgctgcctgatctacctccttcaccgcccctcatcttcgccgccgtggaggcggatccagtggtatcgaacaccaccccagtcagatctatcccctacactatcgccacccgtctcctttgccgctatggaggaggatatatgccaaggggaaaccatagccgagaggaagtcgttgccaccagatccatgccatcgtcaccccccgccatcgaattcgcgcggccgcaacccactgtcgccggatccacgcccccgtgactcgtcggcgccggatccgtgcccccgtgacctgctgctgccgaatctgcaccctcacgacccacgatcgctagatccggaccgagccacccctgccctccagccaaatctaggagggaggggagagccgggccaccgtagcttctccttgcagcgcgaccgtctcgttgtcgcggccgcgtacgggacagaaccacaccaccgcctcccctccgctgccgccgacctccactacgtggctctccttgccgcccccaagcatggccaagtcatgtcgctgccgctgagcgccgccatcgttgaccgctgctcctgcaccacttcaccgctactagctatacagagagagaaatcgcgagagattcagagagagaaaaataaagaaagaaagaaagaaagaaagaaagagagaagggttggatctggggggttgagaaaaaaaagagggagcacgtgctgtttattctctcccactacttttgcaagggagctcccaacaccccgccagtaaaaattgttttttttactggcagcatcttaagagcaccgcctgcaaaaatacctctatttttgtcggcggccctcttaacccgg

SEQ ID NO: 78086 - DNA, 548 bp, Oryza sativa
caaaactaatttaatgttcttgattatgtaattttttttataaatttggtcaaatttaaagaactttgactaaaagaaaagtcaaagccttataatatagtatgaaatggaggagtacttcctagtatcatgcaagaattgtttgttttctccatcgacaatagttctaattgctactccatattttgttttctccattcacaacatggttgttaaggctaaaaggcgtcctaaggcgaccccggactgccatagcggtaaggcgtaaggcgaggcgacgccttaggcactccataccaattagatgacaaataaaataatctaatatgatagcaaatcaaagatgcattttaagagcagtacaacacacacacacatatatatatatagatggttgtaataattacttaaccagatatcaatttattaactaaaagagcaccatcttataaatacagagtgagggtgcatgggggaaagagcaaacaaggtaaatatgtgctaagtactaactacaatacaaagtgagggtgcatggggaaagagca

SEQ ID NO: 78087 - DNA, 714 bp, Oryza sativa
atcgttgatgaaaatttctcaatgaacctaacattatttttatagaggtggtaccgtttctacaatttctaattttagacaagtgtatatataattaaaatttgagttttctagtttttttcagtgtgagttttctagtttctttctgccatggattgcagtcaccactaaataagtaaattgataaatatataaattctcaactaatcgagaattttccaaagaaatagtaatgatagatacagtttccaactatttacattcctaaataaagtgatttttaataaagcgctttaagaagtcgagtgtgtgtacggcttgtttcgtggagctgcttctggctgctatagcttctcctaaaatcaaaagctccactaaacagtccaacatttcgatcagattctgcgaaattatagttgtaaaaattaaaaaataaactagaagttagaaacttggataccagcttcttcagattctcagaaaatggttaccaatcagctgctttttaaaattttaaattcctcaaatagactctaaattaaggtgacaatcgcttcactactattggtactggatgtcctacgtacccgttgcagcaggattttaaagttctttcctgggaaacattaatcttggtactcctagctgatatctcactgacatgactaaatatgacagcttctttataacaattaatgtcgttactagtgacta

SEQ ID NO: 78088 - DNA, 736 bp, Oryza sativa
taacaaattaaagtgaaaataattattgcacattcacaactatatttgttatttttgttacaacttgtagaagctgaatttaaacctgcatatttgtggagtgatatatttcatattaatatatgttgctaacttcttttgtattcttttagtgaatattcaggtggcatatacgaaacgagagggtatcggatgaaatcaatttccctgtataatgttaggcagtctgttcgtgtgaccatgaccggccgatggctgcgaccgacgacgaaatgaggagtgtcaaactgtgaaacttgctgacatgggtgcatgcggcgatcgattaatataagtcagggggtgcctgggctgggctttcgatcgtatatcaaacataatgcggggataattgattgcttggccagtttatcagtttctgcatgtatggttcaggggcgcagccatgcatgcctgccttcatctgcggtacgtactccctcctccgtacgttgtttacagcatcaacagtctctataatgatacttaattgttttcttatgatatttcaaaaaatatatattccctccgtttcaaaatgtttgacactgttgactttttagcacatgtttgaccgttcgtcttattaaaaaaaaattgtaaaatatgtaaaactatatgtgtacattaaagtatatttaacaatgaatcaaatgatatgaaaagaataaataattacttaaatttttttaataag

SEQ ID NO: 78089 - DNA, 805 bp, Oryza sativa
caatcattaaaccggcacctttagcattgctcgaaccaaaaaaaaaacagagagccggctcgaatggagccgacctcactgagcaccatcgccatgcgcccaaatcaaattaaaatcctcaagtcacccacaaatctccaccaaaattgattgacatcacaaacatactccaataaaatcattcacaaatccaccaaaacatctaaaaaaatcttgtgccggcggcccaaggcttatctacttcgtctgtttcatcgccggcgggccatgttgtgcctcccctcccgccggatcgggcggaggggagcgcgccgctgcccgccgtcgcccgccgcctaccctcccgccggatcgggcggaggggagcgcgccgctgcccgccgcctcccctcccgccggatcggacggaggggagcgcgccactgcccgccgttgcccgccgcctcccctcccgccggatccggcggaggggagggcgccgtcgcctcccatctcgccgccgctgacgcctctgccaggacgctgccccaccgctgtcgcgcgctacagagaggcgagagagagagagaggcgagaaagaacgagagggatcgagaggcgaggcgataaggatgagacgtctgaggctataaggatgaggctgatgcgtcggcctgatcggctcggctcggtatggatagatgtcggttttttaaaaaatccggtacctataatttattattagtatcggttttaaagaagaaccgacacctatagtataggtgctggtttttctttagaaaccgacacctatattgcattaaag

SEQ ID NO: 78090 - DNA, 1345 bp, Oryza sativa
caaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactatttttatattctatgctctggatctacacatatgtgctgtgtgctacagatctgctaaaatatatggaactaaaactaaaacgcaacatatgtactcaaacgt

SEQ ID NO: 78091 - DNA, 7036 bp, Oryza sativa
acatagtaggcttaggtgtgttatatatatactagtttgtacctctttccaacttctactctctcgtttttcacgtgcacactttttgaaatgttaaatattgtgtttatttcaaaaatattctataataacaaaaggttatatttttaagttttttagctaataattagttagccatgccaactgctctattttacgtgaagggaaaatttttgaaccgctactatatattgaacacatccttaaaagacattgagaactttagattcacattatatgttacagttactattgtaattgtaatgttttttcttcaattaatgccccaacagctctagctagggcgctaggtggcggatcgtctgatattgcgcccaacagcaactcactagaatgctttagcttttgagaaggaaacaaataggtggaacactactcccagtggatgatcccgaagtattggcattagataatgtaacagctttgttgtgatctctagactatattcaatatgtagagtgtgatgctaccatcgggtaccggacaactagaataatcacatcatgtgagtaaagctgtataaactctacagagtctaaaactaatcgattagccatgctcacggttatgagcggcttggtgaaatgatacaagtatagtgttggtgatttactaaatgatttgtgaaatgggtatggtgggtaataatgatgattttgcccggtgcgggctgagaaaaaaagttcacttactgccatagaaggcacaagaatgatactatgatgatatttatgctactattattatggtttactctttgatttaaatattttgttgtaatatattattatttactattgcgaaacaaaattttctttatgctaaaaatgagccacaaatatagtcatctttaatttcagcttgcaatagtcctaggtttcccatggcttgggtaggacttgccaatatcttgtgtattggcccatccctcgttgtgtcttttagtcttatttgtaggaagcgggtgcttccgtttatcggagtttctagggatggttcttttctagggtgattcttagtaggttgcatttgtgatttgatagatacgtataccggagaacttatgtatattttccgctgcgtttgaaactctttttgtttggccaattggtggaaccattttgtaggactgttgccacctctaagttataagagccactttatgtacttatgtgccatgtgcattatatggatttgataacaatgttgtagatgtttatatggctagttggcgggactagtacagggtacgtttctaggtatttgggaattaaatccccaggtgccgatagttttaaagtggatctgataccatggttgaggtaccaaatatgatttattctctaaataatatgaatgaattaaataatcaaacagtactggatttggtggaggtgttgatgggtggtttgaagccaaaccgagctatatatatataacaatcaaggatacacaaatattcaagaaaatgcacacaaatccaacataaaagactcaacttaaatagaaaaatattgagtgttgcacaacatgtaaaatattgttgtgcttcctctgctttggcctatgtaaatccagcaccactttggacatctgctactagagagaggctagagttcatacttatctcattgttttttttaacaagcctatacatgagcatgtcttttgcataaccatgataaatctgtttattattaggtgcattaatacaatctttagtagtcttaggaggcatcggtaagtttgtattcaccgggaaaattcaaacatgtattagattgtaatatgcttgctctaaatgccccaatagctgccgagcggtggatggaggtgaaactgaaggggtgccaatcactagggactaaacatggaaatgtctatggcctttgtcctgaaggactgaaaggagtcttttgtcgatccctgtcttcttggaaaaagatcactgtgttgataaacgagttatcatgcttatgcttggataattaaattggcccctttagccacagagttttaaaagaaatattgtacagttggggctaagcacagacatacaacagtagtagagaagtcttacataaaatacgttcaatggagaatttttgtcagatccatttatttatctccagctaccatccatgtgttatatatatgcatgtgtttattaacgcgtatgtacaattttgcctcttctatgccatcccaaaagtaaccatgttagtggcaaccaaagaaatcatttatttccttcttccctcggttttgacgtagctatatagagagaatccattatatgcccctgagtttactctagttcaatgatttcccatcgactttgtcttcctctataatataccaccgactttatcaattttttctataatatgccatcaggatggataattttcaaaaaatacctaaaatgcccttcaagccatacaaggattgccgattgattggctctttataagttttgaaaaaaatatgaaagttttagtgtagccttcttatacgatataaagttttttttatatattttaagatttttttcaaaatatttttatgtggtatatgaaagatgaatcacatacacaaaacatagctacattagaaaaataattttgtgtagcatatgaaagattatttatataaacaaactcaacgttacagtattttattagcatatgaaacataaattatattttcaaaaaaattaataaatgcaaattgaaaatcttaaaatccacacacactttatattatgtgtggggactatgtaaaaaaatttatattcttacaatacttctggtaggtaaattaattgtcaaccctctatggcttgaagggcactttatgtattttttaaaaaatatccaccctaatggcatattgtagaaaaaattaacaaagttggtggcatattatagagggagataaagtcaatagcaaatcgttgaactggagtaaactcaggggcatagaatagatgctctcgttcctatcatgacttatatatgttgcttgtctgctcagtgcttacaatatagtcacggacagtcatctgatttggtcttgctctaattatacacgaacgtttgttcgtccatccatatcgccagtggtagttagctaggtgcaaagcgtagctaggcctaggaggcgatgggaaattcggattcagcttattcaggatactgggtaatgaattatcagattgttgcacacatcaatacatgaagcactcaatccagtggaatggtttattgttgagggatatccatcaggttaaaagtgacattattattttatcatgttatcaacatcttttccggctaacaaacctttttttgaaaacctttccagctaacaaacctaaagcctaactgaggttcgccatgtataacttcttatatgtacatatggataatgtttgggcatgtctccatgtattgcatacatgccttttaatctttggtatgcacaatatactccctccatattttaatgtatgacaccgttgactttttgtctaacgtttgaccattcgtcttattaaaaaaattatgtaattattatttattttattatgacttgattcgtcatcaaatattttttaagcatgacataaatattttcatatttgcaaaaaaaaagttgaataaaacaaatggtcaaacgttggtcgaaaagtcaacggcgtcatatattaaaatacggagggagtatatattaggcttaggaggcaaggagtgtaatgctgagtctaccctctccgtcaccattgagattatcctatatatagttgaaacttgaaacataaacttgatatgcatttacatcaattcagtgttcaagcatagcaagtgaaagaaactggagcatttacatacgtttacatcaatttcgcatgtactataaaccaaccaggcaaccacatatgttttacgtgtagttagggaaacaccttagctttacttcaatttcgcattcaactacagtccagttctacgtgtagtcagggaaacaccttagctttatcatggtggtgtagttgtggtcgtatgttttttgcacactagaactcaaattttgtattttgcagttgcacacatggaggtccttttttcagtatgaattttcgcttctgtgctctgttccggcctacataaattcagcatgaaactttgcacatctgcttcgattccactgctccatctcattgatctctgcctgacatctctgtttcataggttcctagttattactcctagctcagtaggcttatgacacattgagaactattgatccgtatgcccatctaatagaacacttctcgttttcaccttaagaacaggggagagatggacaactgcttactaactgcagaggagtcttttttatagttcgggggggggggggggaggtgcttctagtaactcccttcctattaaacatctacagtttattttaatgggtagcgtggagattatgggtacccctatagttggccataaggcccgaggcccgaaggcccagcccacggcacgcctttttggcccggcccaagcacggcacggcccgacttgggtcgggcccgtgccggcccggctcgaccgtcgggccgtgcctgggcctccccaccagcacgctgggctggcctggcacggtcgggccggcccggcacgatgggctggcaggccagacccggtacacaaagtatagggactaaaaatagacatataaatgtcaatgtctaaagaatagggaccttaaatagacttattttagctatttatataccacatcacaaagaagagggaggtaaaatagactttttttagctatacaatgtcacagcccaataggagggagaaaatttagacttattctgaggaaaagcacgatggcccatcgtgccttcgggccggcccggcacggcccgaggcgtgttgggccgtgcctgggctgtgagtgcggcacgtgggctggcacggcacggcccggtgtgtcggtcgggccgtgccggcccgacaagcctcggcccaggcacggccgggcctgggccgtgctgtgccgggcggcccacatggccatctataggtaccccatacctacacggtatggttatccgactagttataggggatagcttgtatctatagaatatataacggatcatgacttgggtattacgttaccttgtatattatagaacggcctaaagtcctgatttgataatattgtaaagtaaatttaggataccgataccgtattggttatggtttctatgttgtaatcctacctccatcctatataaggtgggcaggagaccttctagggggatattgacacccctgatcgtcggatctacaatacacttggcggattcaaattctcaaatagtaatagggtattacctctcattgaaagagcctgaacctgtttaaatcctttgtctccgcatccatccacttttagatctcgtacgctacccctttatattgctgaaatattgtttcgacaggtagtttgaattgaaagtagtggctttctacgttgcttggtatgtataagaggcattgatcaaatagaatctagcgaactgtgattaaaggtactagtgagagggtacttaaagttgtggatcgggtacgaaagtggaaggttagaatagcaatcggcttcccattatgtcctccttagttttagggcaaattagttcatctgttacggtaattttcattgaatcattattttatcgtctggttgaatgaccatttgttcgatttgtgtggtttttggctgcaacaattgacgcggaacaaaaatgtgatgtaaattgactaatagatcgaatctgatcatctgaagagtgtgcatgagagatttaatttgtcgttgtcaaatggaactagaaggcatcatctactaagaagagtaattctgcatcatccccacaatcgtgtagcctctgtatggtaaaaacagcaagtcaaccagaaatactcgtgattgaccaaatgaacgacggcatggatgcaacatctgatggcataagcaagcgatgcagagtaaagaacactccaggatctctttgccatctctttggagttataacgcaaaactagttgatcataaaggtatctaacgaccaacgattttttctgtaaacaattactacctgtatttgtgtcattgtttgttaccaatctacccttcgagattcttctgtaatcaacggtggatactcatttctacaagaggtatgggagggacctttcaagcaccgtaaaagatctcgttaattcctatgtttcaacattaggtaacataaacagaaagtaacgggtaactttagccgtgatagccattccaatgtttcaacaactaatccaatataagtaacttgttctgtttaccggttgtctaaaattggactattgtgagagagcacgcatcatctttccgtggaagacaattacttggttgtagtataaatttaataaaaagataagttctctaaacatcatgagcccatctctgtctactgaaccattcagggcatcaaccatgcagctaatactactacggaaatgatttttctgtacaagaacccctataggttgtagatgaaccataactggttgtgtttgcaaaaatgaacccctattttcgcacacgtctacttatgatgcccttatgcaaaaaatcagcttataaatagccttattgttgcttgttatctagtcagatcatgagttatcaaagtgagagagcttctagacgcctagttgattgccgtgcactctctctctatttttgtaacctataatattgaagttggcatgtgtgatccgctactctgctctcaatactaacagttgtctcgatactctttatttaagcccatttcctagtgttattttgctaacaggaaatatgaaatttcgtgtatataaccagggctgcagga

SEQ ID NO: 78092 - DNA, 2985 bp, Oryza sativa
ggagatgggccgagagaaattcggcccatcaaccccgggggaggcaaattagacttttgcggaggaatttgatttggagggatttggatttggaattgaactcgacgatagatcggggattgagatcttgagatggcacggacactagacaacaagcgaagaaacaaatttcgcaattagggtttttaagagataattttcccgctatgcgccacgacggaacgggcgctacactaaaccgtatcacaataataagattaaaatattcttcacccgttgcaatgcacgggcatttatttctagtatatatgtgtgtgtggttagtatgattattagttaaaagttattgagtttgatttttcctgaaaaagagggtgcatataatttgggacgaagggagtatcttaaatgtatttaaatgatggcagaatcaaataattaagaaaaagagacacaaagatattttttctgatatctgtaggtttaattatccatgatctctctaaaattatatagatgaaatgaaacggccgaatcatctatttgattaacttggtaaatcaatattttcataaaataatctttatacttagcttataacaagtataagcaattaatgcagtagaagatagttttttttttagaatcgtatttttatttttatttttttccaaacatgcatgacagttgtgaatcattttattgagcaaaaaaattgcaatattataagtgtggagcaaataatcccgcaataatctgagcagatttttgccgatcagaaaatctagatgctgagtttggcgggaaaaccaaatacgccaacttcagaaagattttggcaatggccgtgatttggctttccaatattttgataattttcaaaattgctacaattaataatttaatacaaaagatcccaagcttcatgtgggatctaagatactgtaatctgccttgcttgtagctccgtagctcactgccattttcaaaaactaaaaaggttcgaaaaaaatttaatatatttgggaacaaaaagaaaactgattcggcagctaatatcggctataagaaacaataatcctatgcaagtgatctccctggagaaaaatttcagaagaaatttggttcagaaaacgcttccaatatctcattcattcccttactgattctgcaactaatatatatatggtttgcaatccggccaagagcaaagcattagcaacgaaggccggagagatctcagatggctcacttctgaacatacgattctatatcaacaattcgaaatgctcatatttgttgggaaggtttaagcaaagaggcaaagtcactactggccgttgggcacaaatcaaattaggcttagttctttaatttcagctactgtcttgtcacagatttcaaattgtttaatgatgtgttttgtacaaaagctttctgcatgtataaatttctttcaaattaaattcaaatatttttttttcaaaattataatagttgatactgaattggcttaatgactatattgtttcgcgtgcgtccattaagcccacacgaaacgctattacgaacacagtctaaatttgttgaaagtgagggactgatatatttcaaacatgacgacaaagcgcgacaagatatcatgggatccattccatcaacaatggcataaattgtatccctctttaatgtaagtcaaattaattaacctcactcacctctccatcctttcacggaggagcaaattgttgctgccttcgaacaaagaaatgacatggcctgaacggcttttgatctggcttctattaagagccttgccaacgtgcaggcttgaatgcttgaactgaggaaatttgactgaattttatccatccgaaaaattaagtttgatggccagggtttctgagtttcatgccctatcagatagctataatgtattgtttttaattggatagttataataacaaaataatctatcgatttgaaaccgaaattcaaaagtaaatgcatgcaaataatataatttccgagcaattcgactaatcaacatattcattgtctcaggttatgaacatggtaaaacacaaaattgaatccatgagccaatgatctattataataccagaattaatcaaaggtatatattagtgtttttgactaaaatgcacttgattgtcaagttcatgtacccgtgtactcatttttcaagttcttatactaaatcacacacacctaccaagctcttgtaccgttgcaacaaaactttatggaaattaaaaatatctcttaaaataaagatttttatgtggtatcagttcaaaggagtaatattaacgaaggataatttagcaataatgaatgaattggaatgacaatatgagatgttgttttttaatgaagagtgaaactatacatcatttatttttttgagtgccattgtttgctagattcctgtggagatcattacatatttcttttggtttgaaacctccaaatagtacttctcatgtttctgggaattggcttgtacactttgactaaaaaacaaagaaacacattctactagtagcatctactatatgtcgggttctttggctaagtagaaatgatatggtttttaacaaatccctaatgaaatcttatatacaggtactattcaggataatgtactgctccaattttgaccacaactataaaggtgtaaaggtgtgatgaggacaaggaactaatatatactacgtaccagaagctagaaataatggtcatgcagatatttgccaacatcggatggagatttacaaataaatttgaataaatgtcttctatattttgtgttgatatcattagttattgtctagtcttttgatttttttttatgttccccattcagtaataagtggttgtagcttgtttgaagctaaggctgagaatcttttcattatctaaaaagaagtttcatagaatgagatgaatctattcttttag

SEQ ID NO: 78093 - DNA, 1265 bp, Oryza sativa
tattgccttttcgagtagggtgtctgtttagtcttttgcacttttgttgggctcggatttagctatttgattagggagtccctagccttttgcacctttttttttgtctggtcggccaaccaaattttattaagaagaagagagggttacaaggtttacgagttcgacattaggccgtcgagtcaggcaacaattcaattggctgcagccccaaagaaaaaaaaagactaacagctaatcacattgcctaaaagttctagcctccttccatactatgataacctctctgatgtctcaaatagctaacctgctgtgcgcgatcactgctcaaagatacgggctttacgctccttcgaaatcagccaacaaaccatcatgagtgaatcaaaagctttccctgtagctcgcactgaaattcaaccttgccatcagccacaagtccacaagctgagcaccactctctgccggcagctgaaactacaaaatatttttcttagatgttctcaacactgtagctaggcttaggaggcatcaagaatgtagcgataagtttatcttctccatcgacataatatgattatggtgcaaatatgataggccattgataggatgaagtaagcattatcctcatgcgaataatgggccaataagaaggtgatcgatgtggcagtgtgagtttttaattcaccaaagaatgtggtgcaaaagtcaatgtccatgcatccagtggagtatgacctcatatttgtttctctaaaataaatccgcgcaatgcaagcgtatccatgcatgactaacgcaagcgatagagatagaataatttgtgcccagagcatcgaccaattaatagtgagaagaaagtacacaacataagccggttcttttgcaaagcatgtccttgcttgatcggtgacataaattaatttcctctgtgctgtacatcatacatcacatttattttctaagatagtggacattttttaagaaaatggccaaagcgtacacggccaaaactccatgtacaatgtatgaaaacaaggtgttaatttaagagtaaagtccatcaccggtccctaaacttgtaccgctgtgtcatctcggtccctaaactcgcaaatcgaccatttaggtcctcaaacttgttcgactgtgtcatcctggtccctaaacttgcagatcactcgtttaggtcctccaacttgttcagttgtgtcaccccggtccctaaacggggagtccactagttatagagcggccgccgcccg

SEQ ID NO: 78094 - DNA, 5390 bp, Oryza sativa
agagaagataaattctgaaaaaattatttttattaatgataaatgacctagtatttgaataaattattttacttatacacttctatgcagttaaatgcacttttagataaagtatggttttagccgattaagaactacagttaatctagtttttattagtttgactgatttatttgaggtgcaaatttagttattaaatcataccaaaattacagtgagttgtatgtgttgagtagagcctacatgaattttcccatgattttatcttgcacgaattattttagataattctcaagatttatgtcttatatgtgtttccctttcctaaatgcatgtaaatgtttataaaagttatatttggactctcattaacctgaggtgataatgatatgttagaatttcagtttaccttacacaggtcataagctccttacctattatgcacaagtttactttagtattaaattaagagaatgcttatagagatgattaagatagaatatatcctatatgatataatttatttggtcacttccatgttcatgactagtcttcagatggatgaccaaaatagttttgtggggcttggcattggccttgttgatatattttaaggtgtatggttcctattttaacttcctctagctagcactaggccctaatggttcagttgtttatctagatcttagttaatattcatgagacctattatgatatgcaaatcgaaaatccgaatgcaatccaaatccaaatgcatatgaaggactcaagtcaaacatgtctatgagagtatgcatgcttacacataaatttatatttttgtcctaggttagagatgcaaaggtttttaatttgttctaaaattttatcatgcaagagttagatcaacttcacctaggtttaaaatggaaatttttggtttacaaaatagaagaacttccctttcaactagttttgatggaaattccttaatcctagaattcaggtatgttacagtattccgggaatcatcaaattcctatccatccggaggaccaaagtaagactacgttcacaagtccgtacggtacctatgcttattgtaggatgtccttcggactatgcaacactcttgcatcttttcaaaggtgtatgatgtctattttctcggacatgatcgaggacattatggaggtcttcatggatgacttctctgtctatggaaagaccttcggtcattgtctgcagaatttagacaaagtcttacaacgatgccaagagaaggacctggtactcaattgggaaaagtaacatttcatggttctgtgaagggattgttcttggtcatcgagtgtcccaatgaggaatcgaagttgatcatgctaaaattaacttaatagttcagcttcctcctcctgtgaacatcaaggggatccgcagtttcttgggacatgccggcttttatagaaagttagtggaaatggaaggttcgggttgtgtctcgattgttgaaggtttctctatcttggacacggatgcctctggatagggctaatcagattgtgtcatgaaggaagtattttctagaatgcgatctagaattacttttccttccgacggtgttttgtgcatgaatgatcctccgacggttatgtccagatagaatgccgattccttatccagactcgtatgaaaatgttgcaaaagcacatactcaggaaaggaaaaggttggtccggactgcactaaatcagtgaatatggaccaggctgcaccgatcgattcgtttttgatctgctggaaactgaggatctctactcgaagggcaatgatacgagtaactgggaagaaggcaaggcagaatcggtcacgcaaatatacaccaacacttgtggattatgtgagattaaacacctattactatgttcgatgttttattatctagactttatgcagatgttggcgatatagaatcagcatttaataaccgccaacatggacgtccaggattgctccataatgacagttggagggcgtttaggacatttcccatacaataaccgtcatctgaagcctataaatagagctcctctccctcattccaacacacaccaagatgtagagctgaattacaagaggctctaagtatactttagcttctttatatgttctatagtatacttagaatagggagagagtaaagtaaaagaagtcggaggactcccggagttgtcggtaatccactccttattcttgtacttttttaattactttggttcaatagaaatatcattctgagtaattaagattttcttagtgagaattattctttgttagttcctaataagcatatgtgatcattgttcactatagtccattaattatatatttattgctttagtgtttagctagcacaagagtagttattaattgcgtagacgtgttgtctgggcaattgatttccagtggttgctgcgtatcccacggtacgttagaggttggtgtagaggtggtgacagcgcataagagcacttaagtcctccctgtccaggtacgtagtcgagcgacatctgggaatagcgggttgctagtgcctgaagtatcgtgttaggattaaaattaagctttacttagacactgtttctcactaggaaatcttctctacctttatccatatttatcttgtgtcattgatgaaccggaggaagagataatcacacatgtttccttggattcgatacccttgaaatactccataggggaagtgctacatcggtatatccgtgcgcttgcggattctatctgtgatcgtaagaaacaccaacaagcatttctggcgcctgtccatatttttctattcttctacgttcaccctgctctatccgaagaagtttcctggaatacacttcttcctcttctatggagcaacctatctttgaattatctgctcatagggatgaattttatgagtgtcacgaccggaattaacccaacgggcgttccttacgtgtgtgtattattccttgtgctaggaggcaaggtacaccaaaagttgatacatttcagagtttatccagcggaagcataaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacctacaagtgcaggttaaatgcaagggagtacaagggggttataatataaagggttagggtttgcagtaaacagcattaaaagacacttagttgctcaaagctattttgtaaacacgattccagagctatacaatattattaaccaaggccgtgaacccacacgaacctgccttaacccaaggcctacaatgattcagaccgaactggcaacccgaccctgggtcccagcttgtcccaagccaacccaggacaaccattccacattttagttgttaagcaggttttaagaattaaaacactaacttcggtacattgctcggcttgcccataaccgagggcgcggctattcgaatagattatactctaatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccacgggacaggtaggcaggactgagcccctagcagcaggacaccggccctgtgccatgacatctcgactaccgggccgcagctcgtgtagccttcatttgtcctagagatgtccatcgacccccgacttcgtccatctcaatccgtgtactattgtttataaccagactgagccacaaactaagccttacccactagacatgtggaagtacggtagtgctttgcaacagaggcccgaagaccggtccttatatggccgaggtgctactatcaaaaccatgcaccccgagcccaggctaaaaccattttgaggattttgaatagagggggaggtgtgaatccaattccacaataatccaaccattccatagtgtccaggtgatatgaatatcctaaagtctagagttgtaaaaccacctaatgttgcctaattaaccagcgaagcatctacctaaaatcatactagtggtaccatgagtagagtgtgcactagttggggttttgtttattctagggtgaacaaggaaataataacaataacaataataagatcataacaaaggtaaataggcatggctatataaaacagtgataacgcgggaatttaaataaagcgataatgcaataatttaaatcaacataattttataaactgggtgtcacgtcccaaaacgactctaaaatacatcctctaaattatgcctagaatcattaaaatccgtgggaaagcctccaacaaataaaaggtgcaaagttaaaagtcaaataaggcttggaggatttttgtatatttcctaaaagcgtaaaatgcgtaaataaattttggtggaattttcagagcacaaataataattattaagaaataaacaaagttaaaatggttttataaaaagaaaagctctaaaaagtccttttttccctcctctaccccttgggccggctcggcccatctccttccccctccctctcctctcctcgcggcccattcggcctcctctccttgctgacgggtagggcccacccgtcatccccttcctcccgccgctcccgccgccccgcccacgccctagcgccgccgccgccgcgaatcccgccgcccccgtgtcacgcccagaaatttagcccaaatttccagactattttgtgtattaaatccctgtccaggaccagccagggtacacaaaacgacaagtaataaacagttccaaacgtaaataaacggaaaatacttacagaagaggcacttagtcctcacaccgaaacaaaagcagcagcagcggaaaaaggcgaacctagcggggcttcagctccactccacaggcaaaactcaactggggtctgagccttggtcctctaactccatcttcagctcagaagcactacacttctgaaaaagggggaataatagcaaggctgagtacaaccaccgtactcagcaagccacaccaacgatgcagacgtgcaaggggatacaaggaggggtttgaggctatttgcataaaggcagttgtaaaacattttattgagcaaaacagtaaaactgttgagtaattaaagtaataatgaatctccactgatcaacgctacaccacgttg

SEQ ID NO: 78095 - DNA, 2432 bp, Oryza sativa
ccgttgcccacgctggcttgtggtaagtacgataagttcttccagggcatcccgcgaaccggtcgttaattgccatgggtgcgactagcaaaaccatgcacccacagcccaccattcagttgcattttagttggataattacgaccatgaagcatggccagatgtctcgagcacgcagctcactctgatactaaaaaggtctaataaagtaattatcccatcaactgagctagtggtaattaagcatggctaagcatatagttctagctaagtcacataagtaacacgagctagtcgatttattacccaatgttgacaaaggatagatatcaagtaaacatggcacaagcgagcagataggtaaaccctgatcccgtgtaattagcaaaatatgcatatttatttgtaaacagtaaaacatttgtaaattaggatcaaaatgctcaaggggaatgtgtgacttgccttgcttcttcactttgatcttccgaactcttttccttgcgaccgcggacttccgaaacgacggaaactacacgctggcacgcaaaacgaggaaaatctctaataaaaaccaaggaaacagtacataaaaactaaacaaacatgtagagctcaattttagatgaattttgcaagttgaatggctcaatttggagttcgaatgaattagatatgaattttagaagttttgagccatttaaatgaatttctagaattattaacgaattatgacgcaattattatttatttttccaaaggaaaagagggttgctgacgtcatcaaaggggaggggcggcgccggcaagcgggccccaccggtcagcgggacaagggcgccggtccaccgtggaccgggaccaccaaggcggtccaccgccggtccacgggaaccgatggcccggatcggcccaaaccgatcgagcggccaggggcggcgcggctggggcacagcacggcacaaagccagctggccaaacgacggcgcgcggcggcgcggccacccgcggcgacggccggcgacagcgcggggaggagaggagggatgctcaccaagggcggcgacggcgagactacaacgaggaagccggcggcgggctcctcggggaggcaacggtggtccggtggcgtaccacgggcgcgaggcggcggacggtgaccgggacgaccggggcgcggagagggcgatttcagtggttcccggaggcgaggaagcggtggccggggtgcggctcggagttgccgatccgagggaggaaacggcgcagtccggcgtcgaccggggaggcgaggcgacacagatggagatgacaaacacggcggcgatctcgggttggtggtgaagttggtgctcgggcggcgagaggcgacaaccgagcggcggccgagcttgactttgaggcggcgaaggtactggcagtggtggcgcattggggcgacggctagggcggcggtggtgcacggctagaggcggtgaaaggggcggcggcctcgggtgtgcggtgggagtggtgctcgagcggtggagagggggaaataagaggcggccggacttccccttgcggtggcgaagctggcggtggcggcggctcggcgcagcgacggctgtggcggcgggaaacggcgaccggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgatgtggggtggtggaggggttaaccggcgccgattttcgcggggagagtgggggaaatggtggaggacgtggagaggatcgttcccacgtcgttggatgcgagcttcggtgcggaagggcgccggattttgcggcgatgtggacggcaatggcggttggggtcggccggcgagaggtagaagaaggagctgacgggtggggtccacgggtcccacctgtcggggagagagggagggagggaccggctgggaaggtaaagcagacttgagggagagagagacccgagcgggccgagggagaaggccagcccgagagggagagaaaagggcgcgcgggccgagggagggaaggaatacttgggccgaaaatggcccaaagagaggaagggggattttaattgttttctttttattttaattgatgcaatgatctttgtgctattaaaactatttctcgagctccgaaaattcacggaaaattccggagagtacattagggcacaaagaatattacaaaatattcccggccaatgatttttaaaggaaatttttaattccctcaataattcacttgattgagttgatttaactttaatttaatttctagaaaatgtattattaattga

SEQ ID NO: 78096 - DNA, 3197 bp, Oryza sativa
  unsure (1)..(3197): unsure at all n locations
ggcccacctgtcgggcccgtctccctcctcccgccgatctcgcgctcgcgccgccgcgccgaaaccatttttttgcccacgtncccgccttccccgggccacgtcgaccacgcccgcgcgtgcgccgcgtctccagcgcccactcccctctatctcccactcgcgcccgcgcccgagatggccgggattcgaaaatcgaatcccgcctctctctcttccccattcccccacgtcggccggcgatttccgcctctcccggccacgtccggttctctcttcccctttttaagcaccgccgtcgccccctctcactttttccccatttcgccgcactctctcgagcctcccatcgcccccgcgtcgtgcaacctccgcagccgccattttccgcttctccggccgccgctagccgccgttagggtcgccgccaggccgcgccgtcaccgccgtcggattcgcgtggccgagatccaccccgtccacctctcctccgtcaaggttcgtcgccggagccctcatcccctcgcgcacgggtgagcaccacctctaccgctgccttcggccatggtttccggtcgccgtggttcatctccctctctctaatccctctctcctccttccttagggcaccccgaagctcgtccgctcgccgacgtcgtcctcccgtggcttgccgtcgccgttcgccatcgtcttcctccgcgccggccaccctcggtgaggcacccctcccttcttttccccttcctctcctcttagtgtcgcgcgccgtcgccttcgactgccgccgccgcctcccgtgctgccggtcgccgccgtcgttggccgcatgccgtcgccgctagacctagccggccggtcggttttgatgccgagccgagccggcggccgcctttatcgccgcccgttccctccccttcctagccgccgttagcgcagccgcctccgcatcgcctttgcgccgtcgccttcgccgccggttgtcgtcgccggcaacgcgttcgcgcgcgcgccgtcgccgtcgccgcggtcggtcggccggccgtgagccaagccgagccggtgccgctgccccttctctcccgcgccgctgaccagtgggtcccgcgtgtcggcgcccttcctccctctcccgagtcgctgaccggtgggccccgcatgtcggcgccgcgcccccgtgctgacgtcagtcctggttaatattgcgcaataaattatttaaggatttttgttatagtaataaacacagtgaatcttctaaaattcataactaattcatccgagctccgtttaatcccattcaagtctcagtaaatcaagaaaaatgtgtagaatccattaaaaatggttttgttccctgtttcagtagtcttatagcctgtttgcaatgtttgccttgtatgtcgctagattccggctcttccgacgctccggtgtacttcgagatagtcgccgaggtccctccagcagcagagcaaggcaagtcatgcttgtcacttgatcatattgatcctatattgcaaatgtcctaatgttttctttcaaatatcgcatttgttttgcaatattactatgggatggttacctattgttacagccatgctaatttgataccatgctcctttgttagcttgggttataacatgattagagttaggactagggtttgcttagccatgcttagttcaactagcacacaatggggagatctcatttaaaacctagactataggtttatatgataatgttggactagtgacaccgcttgggtgttggttaattaaaatgaatcacatggtgggctgtgggtgcatggttttgctggtcgcacccatggcagttaaggaccggtttgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccgggatgtcgtggtggcatgtcggcgcacggaaacgtgtcgtggggctgtgtcttgtgggtacatttgtacacctctgatcagagtaaaactattcgaatagccgtgcccgcggttatgggcagtcaaccagattcaccgtaattagtctcaccctagtgtaatcttttgaatttggatagtttaggtggatggttgggcctgtcgcaacgtggtgtagcgttggacagtggatgattaatactgcttaattattacaactgttttcgcattcaattcctgtttataaatgccagtatttatgcaaatgaacctgcttagctatcccttgtggaatccctgcatcatacccccgttccggtatgacttgctgagtacagtgggtagtactcagccttgctctattttccccaatcccagagctcgagtatgtgtccgatggcgggttctccgaggagtaggctttgtccgtgccgtcgaggatgcctgtggagtggtgttcccgctgcagttcgagtcaaggattagctccagttatcttttgttttccgctgcatttttgtaagacttttatgatgtttgtaagacgtggatctgaatgtcaacattgttgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggattttattccgggaaaattgggatctgtttttgtggttcaagggaaaaaatcttggtcgctcgttaagtgagttttttcaaaacgggtcagtctagggttttagtaaaactattgggatttattcgtcagtcagttggggtttgatgggtgaaatgcattaggtcctagctcaggaacatgggttgcaaggtatttatgctttatttggtattattagtatatatctaatttctcattattttatcgttatgtgggtctgtcttgtttattcgctctc

SEQ ID NO: 78097 - DNA, 5419 bp, Oryza sativa
aaaagaagaaagattttttcctgggatttaaaattgcactttggtgatttttaattggttaaaattatttccaaggctctgaaaattccactaaaaatcttgttaatgcattggagcatggggaactcaagaaaaattccaccacgctatttccgattattaattgcatttattaactggggattcagctctaggttaattaagataatttcttcaggcaatttatttaaccaattttttttaaagcaagaaaatggggggaaacttcagggtgtgacaaacctacccccttaaacggaatctcgaccccgagattcggaagagctggcgaagaggtgcgggtgggtggccttcaactcatcttctctttcccaagtggcctcttcttctgagtgatgactccactgaaccttgcagaatctgattactttgtttctggtccttctctcactggttttgaggatacgagtcggcttctccacatacgtcagatcttcctgaatttcgatgtgatccgtacttgcctgttcctcaggaactctcaaacatttcttcaactgagagacgtggaacacgttgtcgatgccaagcatgttggagggaagctcaagctggtaagcaacttcacctctacgttccaagatcctgtatggtcccacagagcgtggtgccaactttcctttggtttggaagcgatgtaatcccctgagcggagtgacacggagatacacataatcccctgtttcgaaagcgagctcccttcggcggttgtctgcatagcttttctgccgagattgcgcgattctcaatctttccctgacagctctgactttctcttctgcctcatttaaaacttctgtaccaaacaactggcgttcccctgtctgatcccagaagagcggagtacgacaccttcgtccatacagtgcttcaaacggtgccatctgcagactagcttggtaactgttgttgtacgagaactcagcatacggcaagcttttgtcccatgctccaccaaagtcaagcgcacaggctctcaacatatcctctagtatttgattgactcgctcggtctggccatctgtttgtggatggtaagcagtgctgaaattcaaccgggttcccaattcttcttgtaatttctgccagaactttgaagtgaattggcttccttgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtagctgtagcaaacctgctggcctttggtgttctgcctttactcgttgacagacgtcacagagtgctacgaattcagctatttcccttctcatcctgacccaccagaacttctctttgaggtcttggtacatcttagtactaccgggatgaatggaatactgagtttgatgagcctcggttagtatcaggtcttttaattccttgttttcgggtacacacaatctttctcccatccagattgttccttgttcatcctcaacaaaacctcgggcttttccaactctcatgttctttttgagctctgctatttcaggatcacttgcttgagctatgcgaacctgctccaccagtgtgggttgtgcctctagggcaaccacgaatccgtgctcaactataccaaggttcagatgttccaaatcgcgttgaacctcacaacatagttgctctacccatgcaacattgcagtagctcttcctgctcaaggcatctgcaaccacattagccttgccgggatgataatgtattcccatatcataatccttgatcagctccaaccatcttcgctgtctgagattcaaatcaggttgagtgaagatgtactttagacttttgtgatctgtatatacctcacaacggttaccgatgagatagtgccgccaaatctttaaagcatgaacaactgcggccaattccagatcatgcgtcgggtagttgccttcatgaggacgcaactgccatgaagcataagaaaccactttgccatcctgcatcaacacacatcctagcccctggtgagatgcatcacaatagacctggaaatcttttgtctgatcaggcaggattaagactggtgcagacaccaactgtcgtttgagttcttcaaaactcctattgcattcagcagaccagataaacttttcttccttcttcaatagctgtgtcattggcttagcaattttagagaagttctcaacgaaccggcggtaatagcccgcaagtcctaagaaactccgaacctgagtgactgtccttggtggggtccatttggtaactgactccacatttgctggatccacagctactccttgagcattcacgatgtggccgagaaactgaacttccttaagccagaagtcgcacttgctgaacttggcatatagttggtgcgcttttaacttttcaagtaccagccggagatgctgctcatgttcttcctcggacttggagtagataagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactagtgatagcctgatcgcaggtctatcttagagaacacagtagctcctttcaactgatcaaacagatcatcaatccttggcaaaggatacttgttcttgatggtgacctcattgagtgcgcggtagtcaacacacatcctcttagttttgtctttcttctccacaaagataaccggagcaccccaaggcgacgtgctcgggtggatgtatcccttctgtaactgttcatcgacttgcttcttgacttccgccaactcgttggctcccattctgtaaggcctcttgtggatcggtgcagttccaggtaccaagtcaatccggaactcgatatccctttttggtggcattgttgtcagatcgtccagaaaaacctctggatactctctgactatgggaatatcctccagcttcttagtggttttctccactgctacctcttgttcttcaccaacagcctggtttaaactgatccctggcttctgcggcactggagactggaaggttaccacctctccttttgcattggtcaactcgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctttgcagatgcatgattgacacgggcctgaacgaacttgggtccagcacgtcttggcttctggcactttccaaccgtgtgtccgggtttgttacaattgaagcagagttcgggtttttctcccaacctcttgggctgttctggcagagctagctgaactgattgggctggaatctttagtgaactcggagtagggttgaggctgtgctgctcactgttgttgtgactgccactatggtggttcttgttgaagctacccgggtggtaggggcggtgtcccatcgtgaaacgaggcttctgacttttcccctggggagtcctgaactgagctgccttcctcttacggtttattttgttactgtgctcctcctgacggatagccttatccaccagcttctcaaagtcctcataatctctagagatcaactggttagtcaattcatcatcaagaccagacagaaacttctcctgcctcccgtcatcggtacgcacgtcctcaggggcgtagcgcgcgaggtggttgaactcatgcaaatactctataactgttctggttccttgttgcagggaacggaactctctcttcttttgtgccacaattccctcgggaacctgtgctttattgaaactatgacaaaactctgtccaagtaacttctgccccagctggacgggtcaccatgtagttgtcccactaaacagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaagtgggcggcttgacctgaagaaattctaacagtttggactgaggaggtggaggaccaaactgcaggttctgctgctgctgctgtgcttgctgctgcacctgctgcaacacctgatggtactgttgctgcatctgttgcatcatcattgtcatcatctgagtctgattgtccaacacctgagcaattgttgggttcttgggcagtggggacggactgttgtcagatgcactgttggcacgtgctccattgaccggctcttcgctgccactaacgttgttggagtcgcgtgaaccattccttgtctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcagcgactctgaagctcggggcggcgcttgcaaacgagggataggactgacatctaaagtagacaagggataggaaccaattcatgctcaaatccaaattaagcaaagcaaaagaagactcaaataaataaccgagcatgatgatttttatgcatagaacaacatttttcacgaaccgagacaaaagacactaatgcaactgactaaacaataacttaatgcacgaaatagatgcatagtcatactgatacgcataaacttaccctaccgaacatagacacgacctaatgcatatcacccgacaattcccgaccgactgccgactaaattctgaataaactttt

SEQ ID NO: 78098 - DNA, 1780 bp, Oryza sativa
tgtttaggcttaggcttattggccctagacttttaagtcagcttattgggttatatgatttataagccagtggatttaatgtcctaagtttagtggtggagtcatacatatatctcatataagccaaaaaagcttctccaacctagcttttggcttaatagtgttagagtggcttatggcttcaaaaaaagccaaatgaaaaagctgcttgtttgttttgacttagacttttcgacttataagtaggcttataagcctaaacaaagagggccttaatagtgttagagtggcttatggcttcaaaaaagccaaacggaaaagctgtttgtttgtttaggcttatacttttcgacttaaagttggcttataagcctaaacaaagagggcctaaaataagtgcagtcatggatatccatgtccaatatttgaccgtccgtcttatttaaaaaatttatataaaattaaaaaaaatagtcacacataaagtactattcatgttttatcatccaataacaataaaaatactaatcataaaaaattcaaataagatgaatggttaaatattggacataaatagtgcaaaacaatacttattttaggacggagggagtagtaaataagcgcaatgtctaattgataaatgataggttttgtataagtgtggagccacagcccagctaaccctggacagatgcctaggagtggtatagttgagtttgtctaggcctgaaaatatttttggctctatcattgttttgcatgaagaacaacaattgatagccactaagggcctctttgaatcgcaggattgaaaaaacagaggaataggaaaaacacgggattttggtaggaatgcatgtgtaaaacagatgattgcaaaacacaagaaaaatatagggacgaccgtttgattagaccgcaggaaaaatacaggaataagatgagagagatagacccaaggaaagttttccaagaagttagagtagatgttaactttcctaagtttttgctctagaattgtaggaatagggaagtttcctacatttttcattttctcattcctacgaatcaaaggcatgaatagtgtaggatttcaattcctttgtttttcctccattttccctccaattcaaagggggcctaaattcgctatgtaacaacaagtagttaattgtgtgatgggttactaaggccccctttgaatcaaaggaaaaaccataggaattctagaggattttatcctatgggaaataatcctataaagtcatataaaacaaaggattgtttcctatcaattcctttgaaattcctatggaatgaaccttactagagcaattttggagaaaaataagcatgaggtctcacctcatattttcctcttcatatgtctaacgtttctgcgtttttcctgtgtgctaatcaaacgacagtttgaagactttcctgtgtttcgaaatcctgtggcattcaattcttacattttttctattcctctgttttcttaatcctgctattcaaagaggccctaatttttagctcttggactcttggttaactatatatacgactcttgtcgggatctatctgccccacacaactaaacatggagaataaaattattttcactagaaagtcaaaatgtttattggttaaacatgttatttacaacgaaaatcatgctcgattatttgactaggtagaatgtgaataggggtatatatgaaagcaagattcattcccaatgatgatcagatcaagatcaatatattgcaatctggaa

SEQ ID NO: 78099 - DNA, 3523 bp, Oryza sativa
cctcccagagggcggtaggcgactatttccgtcaattttcaaaatggaaaattatttttgtaaaacttttaataagaaaaattataaataaaaaaaattctgattgtattgtggataaaataggtgccaatttcatagaataaaagtcagtatgtggctttttggtgtgtctggaactaatctctatgtgtcgttgatattgatgtttcatcattggtattggtgaaagtaccttcatgtttaaacaagaggtataactcttagtatccttgttactactatatcgaaagaactaatacgttatataaccatcattctcatcaatcacccactctaaatattattggttttgtgcggtgtttaacaccatattgtaagccatggttaaaaaaataacacgattccaccatataattattagcaggaatagtacattgcatcagcaataatagccgcttattgtaatgtctattttagaacgtatttacatgatagttgttctcaagactaagtatacataagattgatataaccacattaatttgtgagattattaatatcaccatgatatcaaccatacacaacaattaatatatagttgcacatagctcatactatcagttactcctacttaatgcgtattactttgcaaaaaatatccataagtccatatatatactacatgttgcctggagctacggtgacaaggatgatgaatagatgaaacgaaagccataagtccattgcttgttaccgttaataatgaaaaatatatataatgaaatattagatgtcgttttatcaatcaagagtaagaaaagtattgacctactagtatttttttagactagtccatctacaaagaaaattcaactatactcagatgtcacttgtacaaatagagaaaaccgatattatgtaatacaactacgggtaaaccttaaatgcaacttttttactatgattcctctagaacgtaagattcttaaagtataggaatagagaaaacatagaattaaaaatatcatgccatgtaaaatcctacaagaaagaaagctacagaatttattcaaaacatgtatttggtgtaccatagaaaaaaacaaaagaattttaagattatatgttgatttgctagagagataatggagagagaaaatgccttaaaatatcaaaggaatttgaaataatgaggttgaacctaatgctaaaattcatcaacattgtggaggaatttttcctatcctttaaattgccttaatttgaagcaatcctgcaatcataaggactcattcctttggattggatcctgtcttttccttaaaaaatccttcaatcccaataagccctatatgtttacccattaaaaattactcctacctactttctccgtcccataataaatttattttgcttgtccgaaaataattttatttttagagtaactattacatcgaagtttgtgaaataagaaataattatattatgagtagataaagtgaggaatagttgtattgaaattcgataaagtaggggaattctagtttttttattagtatgtgtggaataggtgaaaataatgaatttattttagaacggagataggacataacttctgcatgtatgttaatatagtgtctaaaagattaatgtttcttttttctggtccagcagctaccaatctacttctactataccatcacatgcctgcctatctctgacaataccttaccaaaatatcagaggcaccattttacagaaacacatggataggaaagagcaacttggagaaaggggaacaaggggctgtggctcaaacggagcaacctcaagccgcggcttttgtgtgtcgtttgtgtgctcaattgttgagagatcggcttcttcttcttcgtcacctacaaactgctgagagggagagcacgtaagtacgcaatcaaggctgacacgctaacggccgacatcgcctacctgccatcaattaagctttagctatatatactaccactgtatagctaggtcccatgttgcgttggtgacactagctgctgctgtcatcacgcattccgaggaaacacatgtttttaattattttgttaattacaacagctttgatacaatttcgatcattttattcgttttaagtcactgagcgtttcaagagttgtccttccggctaggacaaattaaaatggtagtataagatattgttttttaataaaaatgaaacaatctattatttatttattaattgtctttttgttagatttctctggagatcagtacaaacttcttttggtctatatcctcgtataatatactccaactcatatttttggaaactggcttgtgggtattgataaaaggaccaataaattcattcttgtaggacaaatcactgtttaaatcttatatgtaggtactttttggaggcaacgcactagattcggttttggacgtaactacaatggagtgatgaggacatcaaacttattcacactgcatgctgcaacctaggggcaatggtttgcagatttttttcaacttcggatggagattcacaaatagggtgcaataattgtgaagtcttttgtctagtgttggtggttattagtgggtgcatcacttcatgttttcttttggaggtgccattatgaaattgtttgttgtgtgtgcttatcaatgaactgattttttaataataagctgtagctcttagagcaaagaccgaaattatattccattatttagaaaataatttatggtcagagatagatgtttgacataggataaatctaaaacgacaaataacaagcagtaattcaaaacgatgagaatgttcattcgatgcgtttgtaatgccatttggacttctaatacctatgtggtggtttgtttgcacattccaacaaattttaatgccatgaaagcattctttacatggatgtcgttgaaggtgtatttttaatacatccaatgtgaattaagatattgatactcaaaatttcaatacataatattgacattgctgttgttttgtttgtctcaacggttttcaatgcatatactagcttctcgaatactactacattttggtggtcccacggtgaaagaccagcagatgcctgcattggagatttggagctgaatctgtatttctagagacagaatatgctctttagtagatttatgggctacgccgtttgcttacatccataagattaattggtgagtgtataattagtgatatgtgtttttcaagctctttaagtagcttatggattataggcacacttctcaagcttctaacgatactccctccgttccataatataagacacaaccacttttcttagatgttacataataaaaggcatgcatgcaagcatgcaattaactatagcatcttctccattaaattattacttttttaaatcctccactctcatgttatctaattctattggatacatgcattatatttattaggatgatccaaactacaagatgataataattattt

SEQ ID NO: 78100 - DNA, 2776 bp, Oryza sativa
  unsure (1)..(2776): unsure at all n locations
tcaactgaattatcacatggttctctcgttgccgagttggctcataccgacaaagcttccgcttgatccaaactactactaaatttactcctagaatgcacatgtagacaacataatgcccgaaattcccatgcaaaaagggtgtgctcacctggcacgcatcgggatcctcccgccaaaccctgggatcaaatcatccaacccagccgatgaagcggccgggtcagggttccttttctcctccggcagcacctccttcacctccgggttgctcccaaaaccccccagcagatcatcgtacgcaggtggcggcggggcgtggctgcccccgaatacatcgtcaaaccgggccgaggaggtgctcttcaccccgggaaccccctcgaagaagtcgtcatcgtagaccggcttgtccaaccccggcaagacgaagggcttcgggttgggtggggcaaccggggcggagggctccttgaaggagtcaaagaaggcgtcgagggaaggcgaggggccgcccttgggcggcggggcggagggccccccggccccgaagaggtcatcgtacgnnagnngcnnnnncggtggcggcggcggcggaggacgccgatgcggatctggagttggaccaggcggatccggaggacgcggcggcgcgggcggccgacatgggcgccgccttcccctgcgggcgcagcccaaagtcgcgggccaggaggccctggaagtcgtccatggcaaccgcaacagcgcacagatcaccggatctgactcacgagctcaccccccgcccacaccaccaccacctcccgccgcggaggctaagagcgagtacgcgagggggggggtgtggatctggggaaaggaagaggaggaggatcggggacggcgacgagacagctaccgatctggggaatgagggggagcgctccttggcggcggcggggtggcccggtcgccggagacgccgccggagagatcgccggagacgggaggggagagagagagacggtgagtcgaggaggagagagagagatggggagagagagaagagagagaggtggtgtgtgggcgatatcatcgggacccgtgctttccccactgccacgtggagcccacgaggaaagttggagatcgtgttacggctacgggggattcgtccgaaccgcgtcactgacaggtgggtctggtttttgttggtcccacctgtctgtgaggtgtgagggtggtgaggagggcttgaacgtgggagtgccagcgcgtcggtggcggcttacgcgctgtgcggggggattcggtgtgtggggccgggggatgtttgggggtacgtggacggatgtgattggtcggaccggtgttgtgtggtttgtgcgatgcggtgtggtggacgaagtggatgggcccacgggtgggtgggtccacttgttcggtttgttcctttctcgcgctcgtccgtctccaccgtgctgatccgcctgaaggcgtaaaccttgaggtaccgcgttgctgtataaaaagcgtcaactaggtttactaaaatgaggtgttccgtttggtctatgcatgtgtacaccggtaacatgtgttttgaatacaaagtgtatcatttgactttttaccgtaagtaagccagtaagcctcatgctttntatactggacggtcgtcagatgccacatatacaatatgggctaaagagtttacataacaacgggtgaaatgagctagtactatataaaaaaaagtatattacaataataattttgttattgacctccataaattaggtgtaggaataagcacctcggcaaccactggacaagtgggcagtgtggaggaagcagtggcaacaatttgacttacttttttctgcacgtgaaataaaaacatttaacatattattaattaagtattaaatcgataagctagatttgtttgattttttttaaaataagcttttatataaaaatttattttaaaaatacaccgtctaataatttaggaaacatactcatagtaaacgaacgagttgcaaaagctaaactcactttcaaattggcaacagccaataagatgaccttttgttggctctaaagaataatcacctaaatttgaaagccatatacatatacaacaatatttctcaatgctttctttaaaaattattttatcttttaccgagtctcaaatctttctcttttactttggactagctcatgcacaacagctagtacttggtggctatgcgctcacactcaacgaacatatgattacttctttctcattcatgtaggatgtaggttgatatggcttgagtgataacgtttgcatgtaaactaaggttattatacttgccgtacatatatgatactaggatgaagtagatatacatttatgatagatgctcacaatttttctttgtggaatcacacttttttggatggcaattgttgattaagtatgcaaccataaggggtgtaaggaaagtcaatcattgtgcagctatggtttattgggcatttggatggagaggcatcttttttctcttctaatgaagtgaacattgaagaaaagtatgttattcttcgctccaagtatcaatgcatatacttgtaaaataagcatcacatcacatgtatatacatgtaccatgccaagaaggtaagcatcaccgtttagcgatgattcgaggaccagcatagtgtagaagagcggtgtacatcttaccttaatttatagaagaatggtatctcccgatgaataaaaccatatagaacacgg

SEQ ID NO: 78101 - DNA, 608 bp, Oryza sativa
acttatgtttttgtgatttttccaactaagaatgaatcatttgaatatttaaataccactgcattttctgagtttttttctttaattgaatgccatttgatttttttctttagtgtcagttaattctgttatgctgcctgtaatctaattacttactttgttccaaatttctctaataacagtcacatttgtcacatatttccttttagttgccatgatatttggactatgatctgatgtgtgcttgtctgtttaatttatgactccaggcaatctatgagggcatacttgttgatctgccatttgcaacattcttcttgagtaaactaaaacacaagtatgtctctcaccgtgtgctcaattatgtgttatttatcgcgattgtcgattgatggttgtgaatgtttgccagtgactaggggtgataatggcccaattttttagagtacaaaaaataagggctgggtctaaaatgcggtgagctgagtttctatacatttttgacctaaaagatatatgtgggctaggtagggttgtgaaagaacccatgggagacccattccacccctaccaatgactgggttaaattttctttaaagcatatcaat

SEQ ID NO: 78102 - DNA, 24011 bp, Oryza sativa
acctttaaacatgtctttaacttgtgtttaatctgtgcttaaccgaataaacatgttttcataaattgcgaactgtcaatatgatctttactaaaattaaataattctagagtacttttgaccttttttgaaagattccacaaatagaattgctgatgagagttgaaacgttgttgcactgagtttctctatatgcaccaaaatgttgaatggaatatgaaaagtctaatgcaagcacttgcacaagactaactcagctagcttagcatgtggtagttctacatcagcgataatgggttaatttgattaagcacttgcgcattaaggtgttttttactataaaattgagtagatgggtgagcatttacaacaaaataacttatgtgatggaacgtcaaactttaagtgacttatagggttgcttttgtaatttttttctatattttaagatgaagagaataatctaaaattttcaaaatattaattaacacgtttctttctgattttctagcattccagagcgcttgccacgaacgaactatatctcacttgattctacccaacttttgagatgaaaattttcttttgtagaagcttccatgtagaaacgtagaaactttacaaaggcagtgtttagttccatgccgaattttttttttacatatatggacacacatttgaagtattaaacgtagactaattaacaaaacaaattatagattccgactgtaaactgcgagccgaatcttttgagcctaattaatccgtcattagcacatatgggttactgtagcacttatgactaatcatgacataatttggctcaaaagattagtctcgcaattttacagtcggactgtgcaattagtttttctttttgtccacatttgatgcttcatacatgtgtccaaatatttaatatgacggaaaagttatggctaatcactgtagtactgtagcactatgcaattagtgtagtacttatagttaatcatgaagtaattaggctcaaaagatttacagtcggactgtgcaattagtttttctttttgtccacatttgatgcttcatacatgtgtccaaacatttaatatgacggaaaagttaaaagtttaaagaaaaaagttggaatctatacacaaccaaagatagaattcaaaaaataagttaaaagaaataccgtatgaacttcttattggccctaaactgtcccaaacatgcaggcacgtgcgagggagaactagcttgttcgaggtgccctcgcgtacatctctcataatgcacaaatcggtggtgaaatatataggaaaagaagattctccaaaaaaaaaaagatcacgtatgtgattctctcaaaaaaaaaataggagtgcgattctctctttaaaaaaaataggaatgcgattctctaaaaagaaaaaaaaagaataggaatgcgatatgtttgtgctcgcgcgttccggcggtgttagcttcgatatttttcttaaggtacgggtgtgatttgtgccaaataaggttgcaatatactgtaactccatataggactagctagtttggtagcaagtcatattggattgttgtcacatccgcagaattgtgcaagaaattcagatttttcacgagaaatccagttagttgctctggttacatctaaacacagaaactgggaaacatccactgtactcgctttgagatgccgcgaattattaaaggcattgaaaaagatacgagtgatctcttcatttaatataatacgtaatatatctcacggattttaatttagactacactgtttaaatttatagaactagaatatattatttcacgtagtagattaacttattttaggagagagagtacataacttgacggtgttccatgcatcatatgcatcttgtggggattcagaactgcaagatagctatacagcctgaacccgaacaagttgtcagcggcaagagtacaacctgttggaattaatgaataggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcagggcaggcggcgcgtgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgtcggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagttttgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatgtaataaattaaatcattatatgcccataatatcaacacaaccaagaaccaccaaaaatcattttcctatctctcttcgtgcacgcttaggtcattttcaacccaatgagtaggatagtgtccatagtattaaataagctgtcatttagaatgaaagatgatgtggcaaagtgaataaatgatgaaagagaatgaaaccatgtcttgcatgagatatggtttctacacaacatccaaaatatcatgtgagataagtagcattaaatttaaatatggaatagtggtgtttgtattagaagagtagtgcctagaactagtttcttgatgatatgaagtttattaaaactatgtttagtgtcttgggttaaaaatggccttagcacgagcatctacaacagttttttttcctgattactagtactcccacgtggccacgtcctaccccatcaccgccgacaagtccaaactgatatgcaagtccctatttaagttgagctgtctgtgttcatcagcccatcactctcttctgtctatgtaggtcatggcggttgcaggggcaatggtgatgtcaggtgctcttctccttctccacctcttagcttttacctgcgtcgcctgcaatggcggcagcgagctgccgccgatcagccggaggagcttccccaaggggttcatttttgggacgtcctcgtcgtcatatcaggttaggctttcgcttcattcttcctacaagaatttgggaataatttcataaaaactgccgctgaaactaaattatcgcaagaacatcagttggaacagaatgtgttcttttcaaattggaaaaaaaaaaggggttaatttcaagacagtataaatgaatagccccaccatgatgctttctattagtagtagaaagtaatatgaaccggtaatttcaattgatcgaagagttcggatttatttgtactactatcccagttaacagtagtagaaatatggagggatattattgtcaaaaagaaataagtgtggaggggtataatcatcatttagcagtgactaaaactttttttttctttttttagctttttcgatggaatatgagcaatgtcaacacaatggatgacgtcgtattaatctaaaaaggaaaacaaacataaataataaagttacccctaataatggtattaataaactactaatttatgcttgataacaaatactagtttagattatttttactggtagtataattcactagcaaatagcaccggagcatcgatcatgaatgaaacacatgaaaaaggagcagatgaagataaattgtgcaactagggtacctcatagatatcggtgaccagcaaatgatggcactgaaaaatgctcaagctgccctataagagtaagaataatgctcatatttgctggtagagaggaattcaagccctgatccaatacgtattcagtagtcaattcaactgtttcgtgattccttctcaactcatcacgatgtgctctgtttcaggtctgaaataaacctgacgaattgactgttgttttacacatgatgcagttcgagggtggcgcagtgttgggtggcagaggaccaagcatctgggacaccttcacacatcagtctccaggcatgttaactgtaaatggcaagaaaggaaaggcaatgagacattattttgaattgaaaatccgccaatttggcagacaaaatcactgacagaagcaatggcgatgtggcttgcgacagctaccatctctacaaggtattagcaattactcatagcatttttcaagttgctgtcatggccatttctaattgatcttttgtaaaggttttagtcaaatatacacaacatgtttgccagtctgcctctgccacgatctcttcaaactttaattctaagattctttaaaaggactaatttagtactcatcctgagggcctggccaccaaaaaatgcaggaagatgtgcgcagtatgaaggagatggggatggatgcatacagattctccatctcatggtcaagaattcttccaagtgcgtgaccatatcttttaggaaaaaaataatgatagatacaatgaactgtcatagacttaccaacagatagaggttatctaaatatgttttctcttttgttctcaagcacaatattttgcatttctttttcaatctccaaggtgatccaaccagggttaaaatctcactgacatggcagatggaagtctgagcggtggagtcaacagagaaggcatcagctactacaacaatttgatcaatgagctattatcgaaaggtatgcaagtctcgtcttcaccatttactttcaagttcagaatctagatgcagcttgtgacaaccattagctccattctttggtatgccagatttctttattcaagatgcaaaaataatcttatacatttgcaggggtgcaaccatttgttacccttttccactgggactcacctcaggcgttggaagataaatataaagggtttcttagccctaatatcatgtaagtcaacaattcttcagtacctttttttatcttttgaaaccgaattcttcggtaccttttgctgaccaggttaaataaacactaacttaaaaaaatatttggggcagtgttacctacttcagttataaatattgtcaacctcatcatgcacatcaattggattttttttagagtaccactgagtgaatgcgagccgtttattgtagtagatccaacagatcatatttgtttctactgcacctattagattgagtagtagtgtagtagaagggtattttagaaaaaaaaatacatggcattgatgtaaatacgtagttgttgaagggttccgtagttcatcgctattacccgaaatttcaatgtcaacagcttgtggagttctcttcccatttttgtcgcaaatactcactccttcctaaattgatcatcatacaatggaatctaaaatttctcaaattgatcaacatataaccgtatggacacggattttatcataatacaattaattcagtatgggagaatgtgtgcatgctagggtgtaattgacatgatgttttaatcaacacatgcattatggaagaacgtgtgcatagtgtcttgattgatgcaatttaaattatcattagtcttggtacataaacatatatgatgatcaatttgggatggagggagtattgtttactgcgatttgtggaaagggaagtcgggaggtgttttgctttgaacaggatttatcatttaaccgctgtttgcactgacaccagccctaatagtgctccattgtgatagtcttttcagctaaaacatctactgttacttgcaatcaaagaagtgctaaagttactgactgtgaagaactgttgcagaaatgactataaggaatacgctgaaacatgcttcaaagagtttggtgaccgggtgaaacattggatcaccttcaatgagccttggaccttctgctctatgggctatgcatctggcatcatggcaccaggccggtgttcatcctgggaggtgggaaaatgcagagttggagattcaggaagggagccttacactgcatgccatcaccaactacttgctcacgcagaaaccgttcggttgtacaaagagaaatatcagttcactgaaggaaatgtcaggcagttgcagttcatccgtgataataatttaaatcgaagatccgcaaagttaagtttcataatccaaaattatttattgcttggtattcaatttcagctggggcctggtggtggtagtagagtttatcagtagagacattagcggatcttacattgttatttttcattgtagtaaatttcacaaaaatacaagtacttcatacaaactatcataaaactatatatttaacatgttgtatcacaaagctataaatttagcaaagttatcacaaaactacatatttaaagccaagcattacaaaactacagctttaatattatcacaaaattacatattttagagtttaaatcccaagcactactattatgtttgagctataaaagttgtagttttacgattaaattggtgctaaacttgtaattttgtcataattttgttaccaaatctgtaaatatgtgatacttcatcttaataaatttagctctaaatatataattttgtttttttgaaatagttaaatatataattttgtgatacaccgtcttaaatatataattttgtgatagtttgatcaaaatatatgtagtgtgaaatttactcttcttattatgaactgtaatatggtaaaactcgatgaaacacacaccacaataccaaatagtcaatatggataagagaaatcctagaatcctaagaagaaaaataaaacatttggcccttaatcacaaggtcaggtatagaggtcaaaataggtaagagagatatttatttgtttattatgcaaggccctccagactcaaggggaaaacataatcctataaattctcacacaaaaacaaaacatcatgtcttaatctcgatgccctaatacagaggtctggatctattagttaggttggagatatatttatatactaaaaggggaacgctccggtgctttctacttgtaatattatactatgagtagaattaatcctgaccgtttattttaaagggtagattagtaatctcctagtacatattaggggtaattttggctggaggatgatttctctgtctcattcgcttaattgcatcaggcccgacgcaggaactgcatcttgcatgttacttatcgcgactcctcccggcaggtggcggcgcggcaaaaattgccggcagcgctttgtaatctctgtttggaccagacagcaatactatgcaatgtgcgactggttgctttccagcaggtactgaaacccatttcacgcaggcattcattagacaactgctagtctgctaccttgaaaactgaaaaattatgaactcgcgtaatagcagataaatctgtcgaaaagctgtttgcaagtaacgtgatggtgcatgcacataaataagtgttaaatcgatccattcaggaagatctaaacagccaaatttaacgtataagcagtagcactcacgatttctcttccatatccatactgtaattgctctgaagccatagacctgctagtagtcattccataagctgctggtcgggcgcgacgaccccagcccgtcccctgtccatgaccacagcgcgacagcgctgtcaccccgcttccgaattccgatagctactgagcgcgccgtcggggaggagggagccagctgcagcagtccgtgggcagatggattgataggggaacggatgcgtggtgaccgccgttatgtgcgaagttacaatattatccctccactccattttgcgatggactattatgtccttccacttttctactacccttaattgacgtggaagtataattagatcaggtacattagattaaaaattatcaacggcttagattaattctactaccagtagaaagcgccggagtctcgctcatactaaaaacaatgaaaggcctttagagtcgatatgaaaaaagaaaaaaaataaaagcaaaacattcaccattaatcttggcaaaagatcgccagttgagttattttcaaaattcaaacatatatcagtagccaacaacacagttatacgaggaagttgaaaccaacaaacatgtaaaatacaatttgcaaataagcattaatgtatatgatagctagctgcacaatttgtgcaggtaacttggctaaatggctagcaagttacttttttaactgcagcgctattttatatcatgcattatcatgaaacagattcctatcagatacatagacatgcgcatactctagcctaccgttatattcaaaacttctgcactttactacgcaataatatgttctaggccttataatttgaacatgaatgtagatatgcattagtagttagtattgtataagcgattgttgtggtgtatgatagtttgagtgctgaagctgagtctgtttgctagtagatcaaggctttagcttcagcactcgcaacatcacactccacacacctcacaatgaccaaatgcttatcaaatgcaggctttacaaaaggggaagattggaataattttaaatgcagactggtttgttccattgtcccaatccaaatccagcagtgatgctgcaagacgtgctctagacttcatgcttggatggtattctttgtctcacacataatttcattattatgagagtgaagattctaactatgaaatcccttctaggtttatggatcctctcattagaggagactacccactaagcatgagagaattggttggaaatcgcttgccagagttcagcaaagagcaatctggaatggtcaagggtgcattcgatttcattggactcaactactacacttcaagctatgctgataatgatcctccatcgcatggccataacaacagctataatactgatgcacatgctaagattactggtgagcaacattatctcatcatgaatatgtgataaatattggtttggatacatgtattgtgtagcttgtttttgctactatgtgctaaccttgtccaattatgctaggtagtcgaaacgggattcccatagggcctcaggtgacctactactttgttatccacagaacaaattcctagtaaatcaattgatcaaaggacatgattgaaaactcaacaaacaacatgtgtgtaggctgcttcgttttggtttcacatctaccctgaagggatctgtgaaatgttgctttatgttaaggagaactatggcaatcctaccatctacatcactgaaaatggtaagttccaacaaacatataggtcatacagtttctcagcatgtgtgcaaaccaatactactgtataacaccttctgattgttggttttttttcaatctagacaatagtgcacataggacttaatagtcttctcctagctatgtaaaaaaagggcattatcctcttctagaagtgaattaacattattgattctttctaaatacatcccaaggtgttgatgaagtcaataataagaccatgccgctcgaggaagccctgaaggatgataccaggatcgaatactatcacaagcaccttctcgccctgctaagtgctatgaggtcagaacatcaattcagacactcagctatcagtagacaacttaaagatggtactaacactgcattattccatatgcctccacagggatggagcaaacgtgaaggggtactttgcatggtctctgcttgacaactttgagtgggcagagggctacacagttcggtttgggataaactttgtggattacgatgacggaatgaagagataccccaagaactcggcccgttggttcaagaagttcctccagaaatcaaacagagatggaaacaaaaggttgaaaagagttgcatacaatgccttttctaattgaacatcgaaatagtatataagttttatgagttaagtacaatagatgaaattggttcgactaaattaataaatctcactctcctcttcttgcatgtttgcatctctctcttgcatgttacacaccttctatcaacatatttctcaaaagtcgaaactataactttatacttttattgattgatttttctttttagaatggtgtgtccataaccttagaatgccattactttgccccaaagcgatgttgttttttttttgtcttgctgagaggatgtgggattactgtatgttgaactcctcatcttatgatctcatccatgcgtggatttagcccaacaaagcccaaaagttctatctgcccacacgccaggttaagctagtttttgacgtgcgattgctgctgtaggggtggaaaaaaaaaagattaggagcttggttggcttggctcggctcgtaagccaaacaagtcaagcccaagcctcctatttagctcgttgttgaaatgagccaagcccgagctggctcacgagccgtttgttttggctcgcaagcctaggccatcatgtatttatatcgattattttatttttcatagagttattatttgttaattaaaaatttatcattaagatttttaaagaattgaatatataaacttatttaaattttatatgttgatgatttgatttttttaataattataaaatataaatgaataggtgttttaacaggaaggcttgcaagctagctcgagccaaaaaacgagccgagccgagcttaagttttagcttgtttctataactaagccgagctcaagtttttgaataagatgaacggccaaatatgtttaaaaaaatcaacggcgttaaatatttagtgacgatggagtattaggaatgtgattctctcttaaaaaaaattaggaatgcgacaggtttatgctcgcgcgtttcgggcggtaggagctttgatatctcttttgagataggtatggccgtgtgatttgtgccaagcaagattgcaataactccataattaatagtgctatcaggttggtagcaagtcacagatgccacgaattagaagcagtgaaaaagatacaggtacctaacttgatggtgttccatgcatcttgacttcttgagaagctagccatacggcctgaacctgaagaagttgctagcggcaagagcagaaccacgaatgtgcttcgtgcacgttatcagttatcacgagcatctaaagttgaatcgaccgctgtatcgagccaaagcaaaagttaaaatttaaatttttgaacttgattttaagatattttaacataatttctttttagcgttggtttttaagtcgttacgaacaaatatataaaagttttacctataaattattttttatttcctaacaagtcatattagtgaatatgggcaaccgatgaggctctaggactctctccgtttcaaaataggtccatttttcacccaaactactcataccaatacaaacaaaagaaactagaatacccctattttatctaatcttaatacaattatttcctactttattactcctaatgcaattatttcctcctttcacaaactctgttacaataattactcaaaatgaatttattttgagataaatgagagaaatcaaaaataaacttattatgggatggaaacagtgtactcccactgactactgatgggtgtgttgatagtgttttgtcagggtggtcaccactctgaaaaaccattatccccaccttgtccacaagtccaaacacatatcctgatatggtattaagcaagtccctatgtacgagaggctatatgttgggcaccgtttgtgttcatcagcccatcactcttttctgtctatgtaggtcatggcggttgcaggtgcaatggtgatgtcaggtggcgtgctccttctcctcttggctttcacctgcgccgcctacaatgacgccggcgagctgccgccgatcagccggagaagcttccccaaggggttcatctttgggacgtcctcgtcgtcatatcaggtcaggcatccaacctcatccttcctacaagaaatcgagaagaatttcataaaactgccaccgaaagtaaattctgcaaggacaacagtcggaacagactgttcttttcgaaggggaaacaaaagtacgaacagaatgtacaaatgaaacacatgaaaaaggaacaggttaagataaattgtgcaactagagtacctcattgatgtaggtaaccagaaaatgatggcactgaaaaatgctgaaatttctctaaagaataagaataatgctcatatttgcatgtagagagaaattccatgatccaatactgtattcagtagtcaatttaactgtttcctgattccttctcatctcatcacgatgtgctctgtttcagatctgaaacctgacaaattgactgctgtttcacacatgatgcagtttgagggtgccgcggcgaagggtggcagaggaccaagcatctgggacaccttcacacatcagtatccaggcatgctgactataaatggccagaaataaaaggtcattacattattttggattgacaattctctaatttggcagacaaaatcaccgacaagagcaacggggatggtgcttgcaatagctaccatctctacaaggtattggcaactagcattgactttagtactccctccattcctaaatgatcttcatatttcacctaagcagcaagaccaaggagcagttactatcccatctatccgtgcatgtcgcttcatcaattttgcatgccgcatgcaccagccaatcagctataatgcattaattccacgcatgcagcagctcccaacttaactctcacagagccaatgcatgcatgtagtgctgcttaatacgaagcaccattatcgtctacccatgatttctgctgcttcctaatgaaatacgaaggtcaaattgaaactttttacttttggtaatgcgaagatcatttaggaatggagggagtaagggttttaattaaatatacactccatgtttgccagtcttcctctgccacaatctcttaaaactttaattctcttctttaaaatgactaatttagtactcatcctgaggcctgagggcctgatcaccaaaaaaaattgcaggaagatgtgcgcattatgaaggagatgggaatggatgcatacaggttttccatctcgtggtcaagaattcttccaagtacatgactatatcttttagaaataaaatgataatacatccgtcccaaaatataagggattttgcccatataaatcccaaatattttgggatggaggtagtagatacaatgcactgtcatagatttactaacagacagcttatttaaagacattttctcttttgttctcaagcacaatattctgcatttctttttcaatctccaaggtgatcccaccagggttaaaatctccctgtcatggcagatggaagtctcagcggtggagtcaacagagaaggcatcaactactacaacaatttgatcaatgaactattatcaaaaggtatgcatgtctagtcttcactatttagtttcaagttcagtcactagatgcaacttgtgacaaccagatttctttattcaagatgcaaaataatcttatacatttgcagaggtccaaccatttgctaccctattccattttgatacacctcaggcactggaagataaatataaaggatttcttagccctaatatcatgtaagtcaacaattcttcagtaccttttgctgaccatgttaaataaacactaacttcaaaatactagggaccgtgctacctacttcagttaaaaatattgtcaacgtcatcatgcatatcaattagaatacccgaaatttcaatgccaacagcttttggagttctctttccgatttttgtcgcgaatattgtttactgctatttttggaaagggagtcaggacgggttttgctttggacaggatttaacccctgtttccactgacaccagcctcaatagtgctcccttgtgatagtcttttcagctactgttacttgcaatgaaaaaagtgctaacgttattgactgtaaagaactgttgcagaaatgactataaggactatgctgaaatatgcttcaaagagtttggtgaccgggtgaaacattggatcaccttcaatgagccttggaacttctgctctatgggctatgcatctggcaccatggcaccaggccggtgttcatcctgggagaagggaaaatgcagagttggagattcaggaagggagccttacactgcatgccatcaccaactacttgctcatgcagaaactgttcggctttataaagagaaatatcagttcactgaagaagctatcaggcagtcgccgttcatccgtgataataatttaaatcgaagatctgcaaagttaagttccataatccaaaattatttattgcttggcattcaatttcagctggggcctggtggtggtggtagagttttttcagtacagacattagcggatcttccattgttatttcttataattatctataatatagtaaaactcggaaaacgaaccccatagtcaatacggataaaagaggaatcctagaattctaacaagaaaagaaaaacatttggccattaatcactatgttaagtacagaggtcaaaataggtaagagagatatttatctgtttattatgcaagaccctctagcctcaagaaaaaaacagaaatcctatagactctcacatgaaaacagaaaatcatgtcttaatctcgatgcaccctgatacaaaggtctggatctgttgattaggtcaaagatatcagatatgttattttattatgtatatactaaaatacaatcaaaggcctttagagttgatatggaaaaaaaaaaagaaaacaatattaaaaagcaaaagcattcaccgcttatctcggcaaaacatcatcaattaagttaatttcacatcaccagttaagttattttcaaatacaaacacatatcaatatccaacaaaacagttgtacgaggaagttggatccaacaaacatgtaaaatttgcaggtaagcattaaagtttatgatagctagctgcaaaatttgtgctggtaacttggatgaaaggctagctagttactttgttaactgcaggactattttatatcctacatatcatgaaacagattcctatcatatacacagaaatgtgcatagagttatattcaaaacttctgcaattttctacacaacaatatgttctaggccttataatttaaacatggatgtaacagatatgcattagtagtcggtatcgttttaaggaacaacgaaaaccctaaccatgcatgcatattgagtgcttattttgtttacaaatcaatggacttggtttcagcttcagcactcacaccacacaatgaataacaagatgcatatcaaatgcaggctttacaaaaggggaggattggaataattttgaactcagagtggtttgttcctttctcccaatccaaatccagcaatgatgctgcaagacgtgttctagacttcatgcttggatggtattctttgtctcacacataatttcatcattatgagagtgaatattctaactatgaaatcccttctaggtttatggatcctctcattagaggagactacccactaagcatgagagaattggttggaaatcgcttgccagagttcagcaaagagcaatctgaaatggtcaagggtgcattcgattttattggactcaactactacgcttcaagctatgctgataatgatcctccatcatatggccataacaacagctataatactgattcccatgctaagattactggtgagcaacattatcatggagtggtgtacctgttttgtgcatatgaaccatggaattccaacatatggcaactgctcgacacaacatattaaaaaaacaaatagaatttggtcagctcacatcatagcctttgaggcattgtcaattgcacactttattttccctcgaaaaacatgccgactttatttgaaaatggcatgttacatgagcatcccagctttcctttcatgcatgaaatgaatgtggagtgcttcaatacagtataatggctatgattagtctggtaatgatatctgtttaatgtgtgtgaagacaaaataaaaaaaaacactatacattttcaaacatgggggtggcaccccggggtgctcaacattatctcatcatgaatatttgataattggtttggatgtgtagcttgtttttgccactgtgctaacatttcgcaactatgctaggtagtcgaaacgggattcccatagggcctcaggtgacctactactttgttatccacagaacaaattactagtaaatcaattgatcaggtgacatgattgaactctataaacaacatgtgtttaggctgcttcgttttggttttacatctaccctgaagggttgcgtgaattgttgcttcatattaaggaaaactatggcaatcctaccatctacatcactgaaaatggtaagttccaactaacatatggatcatacaatttctcactttctcagcatgtgtgcaaaccaatactactataacaccttctgatttgatttttttttcaatctagacaatagtgcacataggagttaggacttaatattcttctcctagctatgtaaaaaaaagggtattatcctcttttagaagtgatttaacattactgattctttctgcatacatctcaaggtgttgatgaaatcaataataagaccatgcgactcaaggaggccctgaaggatgatatcaggattgaatactatcacaagcaccttctcgccctgctaagtgctatgaggtcagaacatcaattcagacactcagctatcagtaaacaacttaagatgctactcggtaacagtgcgttattccatatgccttcacagggatggagcaaatgtgaaggggtacttcgcatggtctctgcttgacaactttgagtggtcagagggctacacagttcggtttgggataaactttgtggattacgataacggaatgaagagataccccaagaactcagcccgttggttcaagaagttcctccggaaatgaaacagagatggaaacaaaaggttgaaaatagttgcgcacactccctttttctcattgaacatcaaaatagtatataagctttatgagttaagtgccataaatgaaattagttcgtaaataaatctcactctcctcttcttgcatgtttgcatctactatctcttaactatatgtacatagctaagcaaaggataaataccgtatgggcatgtatgtttgtatccaagagggatgctctaatgaaagatggacatgagaagtagttcttcgcacttaaggattattacacaacgtatatgaaaaaaaaaatgtactccttgtggtaaaaggagaaatgtgcgttccataatgcctacaacgcactcggaattggctttttatacggcattaatcaagcagtggtatactggtagttcagatctatctgcaagtttgagcgatcagaaagaaatcggcacatgcagacggggtacttaccggatgctcaccctggggggatcgggaggctgccgctatggctgatgaggcgagccggtagcaaggtcgtcgctgctacctagcttgcagtgttgccgccttctccggtggggggaagggcaagagcgcggagggcggctggagtgcggggggcggagtgtgcggtggtagccatccatggattcggagcgtgggggcggaggcggagaggagggtgccggccgacggggcgctagcaatggcgccgccgcgggagcagagatcggcgagccggcgaccaccagatcacggctatgaagccatccagaatcgaacacgtatcgccgtataggtggtttttgatgttttttttttgttggggggggggggtgttaaaagaaaataatgctacaaataaggtgattaaaaataatatgaatcagtttactcaagtttgaaaattttcaataaaatttgttaaaatatgtactctgtataaaaatttatataatctcaatccttatttaggacaaaagttctaactcaacaaagtatgaagtttctgtgatcacacgatgaatgtgttgtcttttatgtgtgctcacttggctgttgtttttttttttttttgcttgaatggaatgaagacgaccatgataattttttttcttgatgatgataggcctgatgttatttgtgcacatcaaaacggatgtgttcatgtgaaaatgggttctagtctgcctaggcacacttagcaccctgtgagtaccccatagcaacaaccagagacatgccgttgcaggggaacatacgtttccaaataatcattagggtaagaccctattaaagtgaaggcatgctgatttatcttagacttggtaggtcagttagaatgttctctgatgtcatagagattagaatttagagatgataagcaattaggagattcgagagtgaatagatgtggaatacatgaagaaaggagtaagatgtagaagaaataggtaagggaagtaaattaaatttgagaagttgtttcaattagcctttgacccccaacatctataaaagaggtggttttgcatctgtttgccattttctatgtcctattagactcacagatcaactagagcataagaaatcccagcctcaagcaagaaaacacgagaaatatctaaaattggacttgggttcgcgaccgaaggtctgacaggccaaacactagcggtccaaccgctcaaaaattagtggtcatatcagcctcaatgtgaaggctctaatcttttctaaacttcacctaaatttgatatagtgttaaatttggctatcaatggttgcaataaactctatatcatggctaattagctggcaagtctgtattgaacaataccacaataaactactattttctacttaaatatatggtgttgttgacttttggtcatggtgttcgatcattcatctcattcaaattaaattttaatataaatatttaataatatagttcatgcttaaattacttactatgataaacaagttaaaaacaaatgatatttacatgtattttttacattagctacctctacacgcagaaacaaaagggttacactagcatgtacacttggacaatcccggctttgagaaagctaccattagaaacaaagagagatcagataaggcctttgtttagttggcaaaaaattttggatttggttatcacatcggatatatgggcacacatttgaagtattaaacgtagtctaataacaacaaattatagattccgcttgaaaactgcgagacgaatttattaagcctaattaatctgtcactagcaaatgtttactgtagcaccacattatcaaatcatggcacaattaggcttaaaagatctgtctcgcaattcacacgtaaaccgtgtaattgattattttttttctatatttaatactccatacatctctactacttaaaaaatccgtagtggtggtcttgattcctgacacagcagacgcatctgacagacacgcgcaatctcaaccatccgattgccatatcgaacggcgtcgatctcctccccatcacgcgatcgctcctctcctccttcccccaagccgcgtcgttcgccctcctctctgcgccgcctcctcgccccgcccccgcgtcgccttctccacgcccgccggccgcctctccagacgctccctcgccgccgccctcgcaaatctcctccgcgcgctctcatccctcccttaaccatcaccggccgctctcatctctcaccaggtcgtccaccagtccgcgacgatctctcccgccggcgtcactagcgacgccttcctcgccgatctcctccgcgccctcgccgcccccgatctccgcctgatcgcccgcctccacgcctcccccaatccgcgccgtcatatcaccgttgcccggagtctcatctagccgtcctcaatgggcaagcacgatggatcagcgtttggttctttttatggggtgtcatcctgcatgtgcagaaaagtaaaggtgaaacacatcaatcctaactgcattttcagtgtttagctctccttcgtggatttagtgttctgatagatggaagtgttgtttcagtttttagctctgtatttcgtgggtttagggttctaatgagtggaattcctcccgttgccacagagcaagcgggcctagatgatggagaaggagaaccggtttggacaggatcaatccaattacaaatgggcatgcaactactactgtgacatcacagggaagtgtatgcatctgtttaggttttctgattacaattttgattttacaaatgtttcagtactttgactcaatgtcctgcaaccaatcttgtattcaatccaatttaataatttacccaattgagtctaggatagtttaacaaatcaatcgggagttcaactatgaattgtttcgctgtttcaggtcttcagacttaactgaagtttcaatgtcgccgccagatcaccattgttttcggtgtttcggatctgactaataatttcttttgctgatcagacatggattgatggcctccacataaaaatgcatacaagtctaggctttatgtggagggctccatggatactaataactccaatgctaacatatcttctgaagaatgaggatgatgattttttgaaaggtaaggtatatttctgtctccttggctttccgagatatgctgtatggcacaatgaaaaacatctgattctttccgtcaatatttaattgacaaatatatgaatttcccctatttgttggactaatatgtgtggtacaatatttacaactgttagataaattcccaggtaacatatgagtgtagctttcataaagctcacttcagattgtttattttcaagatagctgaacgtctgaaccttcaactagactcaagtatgagtctgtagtaggtttcaaatgtgaaggttttactagactaggaagatctaattcctattttccagtattctgctttgattgctatctgtcttccaatgcaacagaaaagtgcctcaagccacaatgtgttttgtatatatatagctacaactttgatttgagacatcggagagtcatcatagtttgctcatttaccacactttataaatgtaaaatgtaaaagagtaaagtgcacatgcggttcttaaacttgtaggggtgttttatctaagtccctaaactctaaaaatgcagatccaaatcccagaatttgtcaaagtgtcgcctaggtctcattttgtcatagcccctctaagatcctatgtggtgttgacgtggtatgccacaagcacagacgtgacatggcatcatcttaactgacaaatgggaccgacttaaaattcattttccttttttcttcttttcttctcatttttctctctcttttttctttttttctcctttctctgtgacccgagcaccctgtgcagcggtggcctacaattgtagatagagaaaggagtataaagggaaaaaaagagaagaatgagaatgagaagaaggaaaagaaaaagaaaaaggaaaaggaaaatttttaagtgagtcccatttatcatttaatattatgtcacgtcacgtccgcgtggcatatgccacatcagcactatcttcaagtaagaaatggacaatattctttttttttgtctaaatacaaataataactagagtgacaatatacattttggttgttttgcagccttgtccagataatcaggaccacatgaagcgaaatggatggtttaagtcgagctaactttagatatttattattttgtgtatttgataggagtaacacatgtactttatagcaaagcttgttcctatatgatgttgtggatacatgttgattgatatttttctaatagctctttatcgttttttttagcttagctatatgttttatgtaccattgtcaaagcatctttgtatcactgttatttggttgtttcatttacaatattaattgtcaccgtagcgttagcacggacacactactagtatatccaaacattcgatttaatgggtgaaaattgtataacatgccggagttccgtgcatcttgtgaggattcagaacttcaagctagctcaagttcaaaatacaaacagagagagaatttcacgctagctttgcggctgtaccagaacctgaacaagttgcctgtggataaactcggcctttttttttctctctgcatgcaagagcaatattgcagtgggcatgtacaggtagtgccgttactctctccgtcctaaaaagacaatctaaaaattggatgagacgttttctagtacaataatatacagattcgttgcactagaaaatatcccatccaatactagattgattttttatgggagggagggacttaggaatatgtaggagtatgtgaaagggattgctaactactccctccgtcaaaaaaaaaaaggcaaaccctagtttccgtatccaacgtttgaccgttcgtcttatttaaaaaaattataaaaaaaattaaaaagataagtcacgcataaagcataaaatattaatcatgttttattatctaataacaatgaaaatactaattataaaaaaatttcatataatacggacagtcaaacgttggcacgttggcacagtaatctagggtttgcctttatttagaactgagggagtacacgcaacctgccagataacgcagcaaaaatgatatttttcgtgcccgtttaacacgagcatctactaacagaagtacaagatcatccatcgctatcatcaattctgcatactacctactccctcggttcaaaaaaaaccaaagcgtttgccatgaatctagaaaaaactatatccagaattatagcctatatggaaggtgtatacccttaagcaaaaattaaattaaccaattttctaaaaaaaatcagagggaattgtgacattcaatataccattgaatataatagcagtcacattatgatagaatcctcacacatctagtctcaccactctgcagtgacataattgctcccgtccacgcaagtccaaaaatgatgggtttctactttctactccttccgtcccataatataagggattttgagtttttcttgcactgtttgaccactcgtcttatttaaaaaatttatgcaaatataaaaaaacgaaaatttatgcttaaagtactttggataataaagcaagtcaaaaaaaataaataataattccaaagtttgttgaataagacgagtgataaagagtgcaaataaaaactcaaaatcatttattttatgggacggagggagcagtagataacgcaagttcctaacttcttatacatggtgacgctatatgctgtcgcttgtgctcagcaatccatcactctttcttttgcagaattgcaggtcaagcttcgttcagatggcggttgccggggcagtggcgatgtccggcggtattctcctcctcctcctcctcctcctc

SEQ ID NO: 78103 - DNA, 628 bp, Oryza sativa
acaggctcccatttacttcttccaatgatttctattcacaacaagcaactagtgaaaattttgtctctcaggtggtgatcttcaatgctgtttaattaattcaaatagctttaagcagcatattttctcttaacactgtttacatgttttgcaggctcttcttggcaatactcgagcatctgaaattataaagctggctccctttttagcaccttttaccagcagagttaaaatattcactgtatgttgctactggtttgttgtttacaaatagtggtaagattggtacatcttttgggataatgtcttacatgtaactctttatatgtgcagtcacaattggcaaattctagacaatcgacaacatcccattctgctttgacaagacaccggttcaaaataagaagaaatcgacttctggaagacgcttttgatcagctaagcatgctttctgaagaagaccttaaaggaccagtatgcttattgtttctttcttcactattctttgttgatccagctcatgtaggaacattctttcaagtgtttcaacaaaacatttttcgttcttatagattcgagtggtgtttgttaatgagcatggtgttgaagaggctgggattgacggagg

SEQ ID NO: 78104 - DNA, 1389 bp, Oryza sativa
ttgttgctttatgtcaacagtctgcatgcacgatcaattcttttttcatcttaaaattatttatgatgcatgcagttctttgattggccatacatgtatgaacatggaactaatattattttatttttctcgcaaaataattttatactatttattttttataactttttttaatataatgtatattatgattaaaattcatatgcaatcttcttgaatatgccaagagccatccctttcccacttcgttctggatgttcatttgtggatacttgaattcttaaaatgcacattaaattattttgattatgaatatcttacatatattttatttccaaaccaggcggctgacatcattgcagtctgtacatcactgctggacgcgttgccaaccattacatcacctaccggaagtaagtatcatgccagtaaaaatattccccattatttgataatatgacttgctaatatcatgcagtagcattttctattgccatttgtttctatcagagattcttgtgatactgagtaacacttgcaacatatcttctgaagtctaagtaatacacctgcagaagtttgttggaggcatgcttatgtggctcaatatttgcccctaataagctttttagtacctttttgataatgtactctaatagtctaatgtaagttgtatccttttaaatatatgcaggggcagatgacgacgatgacacacccatggatgatgtcattaatggtcttgatgctgatttggaaaaacaaattactgcagcaattgattcaaggttgcttcaacatttggtatgcagtcccttttctggtcaagatttaatggactccatactattgttgctattatctgacagctgcttggatcattaggtgaatgctctgttcagaggcacaattagtacagactattcttatccaactggaccgtcagatattgaggtggaagctgtaggatctatatgtgcttttcttcatgtcacattcaacacattgcctgcagagcggattatgactggcctggcctaccggactgaaatagttcctgcactatggaacttcataaagcgatgtaatgagaaccaaagctggccacaattttccaagtttgtctcttctccgcctgcagatgccgtgggttggctcctacctgtatctgtattctgtcccatatacaagtaaggcatattatttcatatcactacaaattttctggttatgtctatatatttattttatttgatttattgcttgagcctttttctctcaagcaactatagtgtgggaaattgaatcttttctctcaggttgtatcttatatatggtttgttactttaccatttatcaggcacatgttgaagataattgataacgggg

SEQ ID NO: 78105 - DNA, 13099 bp, Oryza sativa
tcatcttcatccggatccaatacaatagttgatcccatcggtgtagaaattgacttgcaatccgccatcttgaagcgccttaaaagatccttggtgtacttcatttgatgcacaaacgtaccttgctttatttgcttgatttgaagtcccaaaaagtaagtcaactctcccatcatactcatttaaaattccctgcgcatagtctcagcaaactccacaaccaaagggtgagatgaacaaccaaagatgatatcatccacataaatctgaacaaaaagttgatcatcaccatgcttaagaacaaagagagttttatctacttttcccattgtaaaacctttatcaagcaaaaaatttttcaatctatcataccatgcccttggagcttgtttcaaaccatacaaagcttttgacaaacgaaaaacattgttgggaaaatcagaattttcaaaaccgggtgattgttttacataaacttcctcctgcatataaccattaagaaaatcacttttcacatccatttgaaacaatttaaaaccttttggagcagaaaaagccaacaaaagtctaattgcttcaattctagaaacatgagcaaaggtttcatcataatccaacccctccatttgagtaaaaccctgagcaacaagcctagccttatttctcacaatcaaaccatcctcattttgtttgtttttgaaaacccatttagttccaatgatattatgaccaataggaggttcaactaaagaccaaactttgtttctttcaaaattctctagttcttcatgcatggcatttgtcacgcccataaattctcgaaccaaaatttctaagctgaatgtgcattaaatccctgtccaggaccagccagggtacataaacgacaattgttgacatacagacccacgtcttacaaaaatataaaagattacaaatgcagcgggaaagataaaagcgagctaaaccgagaagcttgacttcaacagtgggcgactccactccacaggcaatccttgacggcagcgacaaaaccaacctctctgagacggctccaactgagaagaacttcaactctggtgtgggggaaaagagagcaagactgagtactgcccactgtactcagcaagtcataccgaaagaggaggtatgatgcaggatataaccaaagaaagctaggggtttttttgcataaagcaggcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagaccaagcagttacccactcccgcttgtggtaagcacggtaagtctcccagggtttctcgtgaaccggtccttaactgctatgggtgcgatcagcaaaaccatgcacccacagcccaccattcagtgtattttaattaactaacaccattgcggtggcaccaatctaaagctatgccaatagacaaagtctatgtaataatgtgatccccatttgtgtactagttgaactaagcatggctaagcatttcctaagccaacatctagtcattttgatacccaagttatcaatggcataaggtaaccaatatgtggctgaggaataggacccatcccacattacattgtaaaagaatgcaacatttaatagaaatgcgggatattggtaaattgggtacaatatgatcaaacgtattgcatgacttgccttgctctcgaactgatgagacctcagcaacgtcttcgagaaaccgcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgtattttagaagataaactgtgtttttactaataaagaaaaagtccttaattaattattgcgtgataatacccagggctgacgtcatctaaggggggcggcgccgacaggcggggcccacgggtcagcagctcaaggtggccggtctaccgtggaccgggaccacgcgggtggtccaccgccggtccacgggaccgacggtccggatcggccgggaggccgatcggacggcacggcggcggctaggcacggctcgactcggcttcaaaaccggccggtcggccatggcaactggcggcgacgcgcacggtcaccggcgacggcaatcggcggcgcgggaagcgatggcggacggggtaaaggacggcggcgtcgaccgaaggcgacggcgagcgcgtggagagaggcggcgcaaacgagagagaggggaagagggaggagggggggatcctcaccggcgagtatggcggccggagcggaggatgaaggtggcggcgacgacctggcgatgaggaggggcggacgggcggcggcagcacctacggagggagttgagaaggattaggagtagagggagtgaccacggcggccaccattgttggccggagacgaagtagaatggatagctcaccggtgtgtgaggagaaccgggctccggtggggtttagcggaaaccgagcggcggccgaggtggctcacgcggcggcaatgctattggcggcggcggcttggcgcggcggcggctctagcggctgcggcgcgcgaccggaggtggcggcaagcggcggcgctagtggcgagcggcgcgcgacccgtaggaggcacgggagagcgcggcgaaaaggggaaaagggagacggagatgcggggaagctttatagcggctcgagaggggcggacatggccgggaaaccccccgatttggccagcgacatggggggagagagagagagatagtgggggggggattcaaatcgaatcccgcccatttgcgggcgcgcttgcgggcgggaatggcggggagggcggcgacgtggggacgcggagtgggggcgcggcgtggagcggagaagacggcggcgcggacggtttcggcggcggttgccatcgtggggcgggtggctggaggaaggggacgacctgacaggtgggccccacctgtcagcgtcccggagagaggggaaaggggaacgggccggcccaaaggaaggaggccgagcgcgggagggagtgggccgacggcccaatagagaaaaaagaaggaaaagaaaaagaaaaagaagaaaggatttttcctgggatttaaaattgcactttggtgatttttaattggttaaaattatttccaaggctttgaaaattccactaaaaatcttgttaatgcattggagcatggggaactcaagaaaaattccaccacgctatttccgattattaattgcatttattaactggggattcagctctaggttaattaagataatttcttcgggcaatttatttaaccaattttttttaaagcaagaaaagggggggggaaacttcagggtgtgacagcattgatccacgattcatttgctaaggcatcagtaacatctttgggttcaaaagtagcaacaaatgcagaatttacatgagtatcacgagttgttaccttagaccttgtggtacattctccaatattacctattatctgttctggaggatgtcgtcgttgaatatgaagtggagcaataacatctgatgaaatttcgtgttctgcatcatgatttgacgaactagaaacttctggaggtcctctattatcagcacccaacgaactcggagatgagcgccctggccggtctgaccgctcctctgcctgcggtctgaccggcggtgggtcgacggtctgaccggccatggccccggtctgaccggtcgtcggttcatcgtcttcctcgtcgtcactttcctctacgaaaatatcctccccctgaacctgtgataatgtacctgaaatttcgggtctagctccaggactagcctcatccaaagtgactttgcaagtctcaacaattttgttagtgtctaaaacaagtacacggtaacctcgagaatgtgcagagtaaccaagcataagcccatcggtggaatggggctcaaattgtccaaattttctgatttaacacaaagcacttgcccccaaaaatacgcacatgtgaaatcttaagtgtatgaccaaagcgaagctcataaaaagttttttcaagttttgatgtcaagaaaacacgattggaaatataacaagcagtgttaacagcttcagcctaaaatctcctaggagtatgatactcatcaagcatagtcctagccatttcaaccaaagaacgattctttctttcaacaacaccattttattgaggaacacatggagacgaaaattgatgttcaagtcctttttctttgcaaaaactctcaaaagaagcatttttgaactcaccaccattatcactttaaatagttcttaaagatccagaaaattcaagagccaaatgaagatacaaacttttaaagtgttcaaaaacctcatccttagtagccataaagtaaacccaagaatatcgagagaaatcgtcaacaataaccaacacataccactttcctccaacagattgcactctagctggaccaacagtgtccatatgtaatagctgtctcggtgcatccgtcatcacagaaataataggagtatgtgaagaagcaaccatcttagcatgacgacatggcgaacaaaccaaatcaagatctttcttaagtttaggcaaaccatgaacaagatcagaaccactaagtctagtgagatgatcaaaacctacatgtccaagtctacaatgccaaaacatcacatctttagaaaattttgcaacaagacatgcaatctctgaagaaacacttctttcaaaatcagccttaaaaactgtaccatatcgagaaactgttgatgcgaaaagcacacaccgacctggaagatctgcttaactcctgtgcaggtccaaaatcttgcttttaggttcgtgagcgtgctagttgatttgatcctgcaatcaacaagaaagaaagacaagaaaaccgcgtttaaatccataaacgatagccgatcggctagttgccaatgacatatcatttatcttcgagccgatgtcatattgggatcgattggcagtcatgaatcaataagataagctaaatctactcgatcagctgtagatattaacgacatataatccttccttcgacgtatatttaaactaagtgattaggatagatcggtcgtcatgccgagatagtataaatcacttcagtcgaaagatacactaaagcaatgattatatagacatttatagcatagccgatcagataggtctagcatgtatcggctaatactccgataccactttatactaagatattaaaacaagcaaaatatattaaacaagaagcctgatataccttaatgcgataagatcttaatataaagggcagatctagcatatcaatcaagcatataagacataaagtagctaaatcaggtaagatcggctgaaactccgatactatctctctcaacaatcataaaacaagctagatattataattatggatattactcaatagatcgaacccaaccgatgcagcattaaacataaagataagtataagatctagacaagatgatgaaaatctctaagagatggtagacacacgatataatctagattaataatgaaacataactctatcgactactttctaatagtaagaaccagccgatgacaagttatatagcgcaactaacagagattacaaagcgtatgtgataactcgacgaattacataaacaagattagagtattataaagatggaagcactaatcccaagaacgcaagccgtcatgacaagtttacctctagttgaatatcggaatcgatgcagctcaacccgaaagcaagaactcgtcgaaatagaacgaaagtgaaaagggtggcgatacgccgaaagtgttattgaactgttgttgtaaattacatgggttcgggtgatatttatatgcgagatacatgatatgtccttgccggacacgactcttatctctaacaaactctaagatacacataagtctttgctgcagactcttgcccaaacatatctccaaggaaactattcaaaatatcctaattaatcgatacaattgcctatatgagagcttatctccatcatggcaatccttgtgtagcacgtcgaagcagtttcataactgaccccggcaaaatcgtccttatcgggtgtatcggccatatcgactatcctctatccgatcgatctcagccgatgaaatacccagccgatgccttcgcagccgatgcacactctgttctttgaatctaactctttgccaaatccactatgattccaatgccgaacctggttcatatcttaccaaatttggtcgtcaacacatgccccccaagtccactatattggtaatgttgcggattttctcaatcacctgctctgactataactagggtttcccactccgattctgttttggccgttaccgcgctttcttttaaatagtaaccaccggcgtcagcttccgttttaaccgccctagcaaaaaaactttccccaatctcttcctcgagctcttcagcgacctaaaggcgattccctgcagcgccccctccgttgccaacaatgtcgagctccgccgatccctcgagcgcgccaaccgctgagtatgttgaggtaagtaccatcggctatatcccccttttttccgtactgaatcggttcttccttcgctcaatcttcgattttcctcttctatagcatctctctcatcaagttgcagttcccaacataaccgatgagcattagtttttccttggcccaatcggcaatctagaccccactgagttcataaatggtgaaaccaatcggacaccctttagatttgccaaccccgacttaaccctttggaagaacacctttaaatcttggccatcagctgaaaaaagttgggcagcctggtatataagagtatcggctagcaagctaacccacggggacaaaatcagcatatcccaagctttggccttgactatggcagatatggctaaggatgaacttatgataacagccacaacctacttctggtcttctactatgaacaccttccttttctcccaaggaccaatgacccccactctcttagatgttacaatgataaccagtttggatattacctcatcggctaacccaattagtttgaacacaacatacactaatgagttcaaaatccggagcataggtggttggtcaggttttttcgccaaaaacatgggcactggatcagtaggtccaagggaacatgcaaccctcctcatgatgtggcttgagaaattcttattctgcggctcaagttgtggtcctactgctaactgacaacacatagctgagaatttggtggagaaaaagcaattccctcttggaaaatacctcctgggctatttatatcagactctgaacactgcaataactaaaatagcctcaggacttccaatcggcacaggaggtccctggtggctcctttagatttggctcaacttacataccatgaaggttgctaattggctgcctttacaagatgctaaattcccaaggttcgagccaactattgatgatgatggagaagagatcaccacacgccggtgtatgtcctttagagaagcaacatatatcagcaccgcatccaagctgtcggctgaacctttcagagaatggttccataacttctatgatagatttccaaggaatgccagaatctggtttgcatatgaaggatttggcacctttgaatggccaaatgattttcgctttgatgagatcaactctgaagaatatgagaaatctagagaggtattctcaacagccatcagcacttgcataattcctgtcagcattcatcgaggcaaaaatatccagatatcatatgaattctaccatccgacaagtgccgcaaggcaactaggcatgggccaactgcagattagtttgttctttgccgataagatctagagtaggggagaaataacatcggcactcatgacggatcggctgctgaacattccatgaccacctttaggcaggatgttgaccgatggtggatagagtggaagaaatatttattacatcaatcaccttcaatgtacctgacagatctgtttcctgaagctgtccctcaagtaagaatttttcccctttgtcaattctgtcaattaagccaatgcatcaatcttaacttttaaatctctttctttacagacaacagaatcttctccccccatcgcagtgaaagtggcatagatatccaatatgctccaggactccttcctaataggggtggtctaactcctccagtcatcagctatcatgccccaagacctcaacgttgctacacggtctgccttgtgtgccgatagcccctattgctggcaagaagaaaaggacaaaatcggctgcaagaaagaaacctaataaacaaaaagttgctgcggatgaccagcggcccatagatccagatgtagaggaattcctggaagatgaagtagcagaagtcgtggactatgctgccgacatcgttagcgaaataagggaacaaacacctccaaccgatcctccagctcctcaaagaacaccatcacctccagtacgccctacttacaaaccaagggtatgcatttgttgtcacgcccgaaaattcacttgtatttccgaacttatttgtgcataaaattctcgtccaggaatcagccgaggtacacaaactgacaatttaatatacaaatccatcgtaataataacgttacatacttacaatagaaaagaaaaacagcagcggaattaacggtctagcgatggcttcagctccactcccaaaggcagctcaactagggtataagccaaacgtcttctccttctggatcctttttcttcaactgaggttgattgattattgcaagaatgagcatatgaaatactcaagccacacagcaaatatgcaagtgcacaaggataccaaaggatggcataatataggctcatttgcaaaatcagcatttagcaaatatttaagaatagtaaaacaatagagtaatcatcaattttaatcaacactgaactgcacacccatgctgctcaggcccaaccatcctgaacaaccatccccggctgtacagatctaactccaaaccaggagctaagcaaattattgtgagaggtatgagactaatcacgaaaagcattgctcaactcgcccatgaccgcgggcacggctatttgaatagttttactctggctagaggtataccactatacccacaagacacagcctcaacatcatgtctaccatgcgttgcgatactagaaagtacccgaatagaggctgtgacaataccctctgcacaacacgactcaccacagtgcaccgttcttagatcataatcaccccctcaataaccagaggcatggactccccagcgactcccacggacttctcgccgcttctcagtctgtcaccccgtaatgaaccatgctatacaaaaggtatagccgttgcccacgctggcttgtggttggtacggttaatgtctcacaacagtagctcgcgaaccggtccttaattgtcatgagcacgacctttaaaaccatgtgctcacaacccaccattgtcaagttttagttatcaattaattatcataacacgattaaccatcgtgagctaccattaaatataaccataagtaataatgtagtatgattcatcccattaatgagctaatgtctctaagcatggctaaggaattatatatatatatctatatagcttttagctgaaccaaaccaatatataaggttcaagctaatcaatttattacctaaggtatcaaggaatagggtattcaatgcaaattggccataacaaaggaataggttcacaccacccaatgacatttgaaaataaatgcacagttgaaataaatagagaatttaaacataggatcaacatgctcaaaggaattgtgtttgggatctgtgtgacttgccttgcaataatcggtcttcaattagtcttctgaatctcttccgacgcactcacgagccttcgcatcgacggaaacgacaagctaacacgcaaaacggagaaaaaaaactaataaaaaccaaataaacagtatatataatcatgattttagatgaatttagcaacttgaacggcctcattctgacttcatataaattagttatgaattttacaagattaaactgattttaagatttatttttagaagggaaaagggctttatgacatcatcgatgacgtcatcacctgtgagaggctcgggacatcacggtcaccggcgatctaggtcacggcggtgagaatggagggcaccaacgcgacgagcatgacgcggggaactcactgaggggcggcacgacgacgaacaacgacaggagacggccgacaacgagattgaagcggcgacgggctcggcttgacggcgtcggtggcgcttcggcgacgagcggcaacaacggaggggtggacgggcttctcctcggtgctgcgatgccgagggaggtggcggcacaggtcggggacgaccgaggcgacggcacggcgcggatggaaactcggcggcgacgacgacgctagggtggaggcggctagggcgctacgggcgacggcgagctcaggcgagggtggcaaacgaaagaggagagggaggggactctatttatagccacgggagagagagatcgggcttggaacgcaagtaatcacgccgggaaaacctagggtttagtttggagggataaacacgaatcgagctcgattccgcgttgatttcttcgggataaagtctgattcttgggggaaaggatacgggaggataagaggaatatttcccctcaactaattttgcaaacggatcacgggatgcgaaggattcaacggaggaagcggcagcacagagcacggcacgggcggctggagcttgaagaagaacagtagcacgggggacgcaaactagacttttctgtgtggtttcctttactaggcccaattgaaggagggacaacaaatggacttcggaagagggataaggccagccgaaaggaagggagaatgggccgaggactgaagctgaacttttcctatttcggcccgaaaaggaaagggggattttaattacttttccaattaaattaatcacggaaatgatttttgaattgttaaaaatacttccaatgctcaaataatttcaaggaaaatcctgaaactgattggacactcaaagtacttaaaaagattataatcagaccatttaatgactaatttaatatgggaataattactgaaatgttctttgtattattaaaattaggaattgagctccgaaaaatccgagaaaattttagagagtataattaactacggagaatttaataaaaattaaatccagccatgctttatatttaggaaattttatttcccacatttaacttcacttgtaaattaatgaacatttaatataaattctaataataatttattaaataatttataaatcctaaaatgaagttggcttctaaaaaaccacaagtgacgactccaccagttaaatctctaagtcccatcaaactttcttttcaacttttcaataaccgatgctaacttaaacttgtctcttttcaggctcgtcattctccaactcctatttccgaagcaagtgagcacacccaattggccgcaggaagtcatcacatggaggaagaagaagaagtaatggcaccagctcctgctatccccgtgagtttatgttctcaacttttaaatcatatcggctgccatgtgattctaactaatcaaatatacccgtactctctttcaggtcttagccgatatgttttcctttgacatccggcaattcatggacaaagaagaagcaaccacgagcacagccttggtacctctagctgacgatgtgaaagcaaccctgctagacatttcaaaacgactagaaggctctttggaaactctggtaaccagctgtgggtctattagagatagattccacgaattccatgataaaatcccagacaagttagacgatgccattaccccagcgacataccttgagcaacatcggcttaaactcgaaaaagccaaatagaggattgctgatcgtcatgagagaagggaccttgaagcaaccatccaagttagcagggcttctatgtcacgtccggaatttctatccaaaattccaaacgcttacatgtatgtgaaccctcgtccaggaatcagccgaggcacacaataacaaattgataatagagtacagttattactctaattaataagcgaataaaatatcattacagaggtagatagttcctctcaatcaataaagatctaagcagcggaacataaaataaacggcgcagacggctccactccacaggcagcttgaccaaggctacacctaatccttcacaccatcagcatcactgtagaactcttcctctgatgaatgattgcaaggtgagtatataacatactcagcaagccacgcagcaaatatgcaagtgcacaagataacaaaggatggcaaaataggggtccattttgcaaaagcag

SEQ ID NO: 78106 - DNA, 10300 bp, Oryza sativa
tgtaccccaaaacacaaccccacatcatgtcaccatgtgcctcaataccaccacggtacctcggaaaggagttgtgacaataccccttgcataacacaatccaccgcagcgcaccttcctggatcataatcacccccttataaaaaaggcatggactccccagcgacccccgtgggcttatctccgccacttctcagtctggtgccccgcaatgaaccatgctatacaaaagataaagccgttgcccacgctggcttgtggttggcacggttaatgcttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatagtgagtcataagttatcccaatagtgagctaatgtttctaagcagggctaagcaattatatctaatatctagttgaaccaatataaataaagctcaactagtcaaattataataacccaaggtatcaaggaataaggtaatcaagaacaaaagggctataacaagcaattggttaattccacccaatgacattcgaaaataaatgcaatatttgaatagaaacaatagctttaaataggatcaacatgctcaaagggttgtttgggatctgtgtgacttgctttgctggccttggaactcttcaaactattctccggtgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaaattggattaaaacacttaaattgattttaattgaattatgacgcaataatgaattatttttgaaaaggaaaagaggatttattgtgtcagcgggctagggtttcggtggaccgggcgcacggtggcggttcacgcgaacggacggccgagatcgacttgatccaaaacggacggccgagatcgatcggtccacgaccggctcacggcggacggtcccgatgacgtcagcggtgacgtcatcaccggcggcggcggctcggcggctcggacgcgcatgctcgccagcgaacggcggcgcttcggcacgaacggagggcaccaagacatagagcacgacgcggcgaactcaccgacgaccaaagcgacggcggaagaccaacggacggcaccggcggtgaggaagaagcggcggcgctcttcgggtcgacggcggcgagggtgttccgacggtcttcggcggcggcgaaggagcggacgaggacggcgacgacttggcgatcacgacggtgaccttcccgagcgacgacgacgaccgagacggcggcggagcacggctggagcgacggcggcgacggcggcgctaggttgcacggcgctagggcgctacgggcgacgagaggcgaaggcgagggtggcggcgggtagaggagacaccggggagccttttaaaggggctaggaggcggcggcgaaggcccacggcggcggcaacggcgaaggaaacttcggagttcggaggaaagagaccgatccgattcgacctcgaatccacgaacttccaaagcgattcaaccgatgattccaaaagagaaaaggtagaggagatcgagaagatcatttcccctctatcaattcggccggaaacagaaaggaacggccggatttggaaaggaacggcggcggcgcggcgctagggtttcgggcggcggcggcgtctcggggaagacgaacctgacaggtgggacccacctgtcagcgacagcgagggcgcgcgcggctgcggcggactgggccggactgggccgaggagagagagaagggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagcatttaataaaattttatctggccccattttatattggaatttattaattaaaattagatcttctcttctaggattttaaaataaattctgaaaattccatttaaacaacaatttatatattttgaattttcagggtgtgacattctatcaatgaagagaaggctaaacttgatgaattagaagctagcccaagttcaactcaagctagcattaatcggctgaacgcccggaggatagcaattttggctgaggtggaacaatgcagtgcacagatcgcccttgaggaacaaaagcttgctgacttgccaaaagccattgaggatcaaaagtcaaaattgaaggcatccgtcaagcatctaaccgatctgaccaaatctttgaagatgatcccaagaactgatgcagccgatgcccaaataatagatgaagtagatcagattaggcaaagggcaatatcggccatcccaaaatatgtgtctagatgagctaaattttgtaacttcaactttaaatttgcaaacttttgggctgtaatgaactccaagttaaacttttgcctttaaatcttgttttttgaaatccatgtttcatatatatttgcccccctaattttgcaatgttgaagacattgataaaattataactgagcctaaaggcgatataatccatatcagccattatacatcggcaaaccataactaattatgataataaaaaaccactaagggcgatataatccatattgtccatcatacatcggcaaaccataaccaattatgagaagaaaaaaaccactaagggcgatataatctatatcggccgtctgaaggcgatgtcaccacatcggctagcatgtatcggcaaacatcagccgatcatgaattaatccatacacttgggtagtatttcttcaagtacttgccattaagcgctcgtccataaacttcaccatcaagtccttgcaacttataagctcctttggatacaactttataaatctgaaacggtccttcccaattcggtgaccacttgccgaatttattgtcacgagttcctatcggcaagatcaatttccaaatcaactccccttctgaaaaggacttagacaccacttttttgttataatggcgagtaattcgttacctttgcaagggctctcaatctagactgaactagatcttctatttcatctgccataagattataatactcataggctgtcaactcatcctacaaatctatcctttttgagccgattgtagattcccatggcataactgcttcatgtccataaacaagcttataagtagaaacttgaatcgatccataatgcctcagctaatcttgtatgccactgccaaagaaaatctgaaatctttctcttaatcagggggatcaaacttttattagatgcctcggcttgcccattagcttgtgcataatacggcgaaaaattcaacaacttaatgcccatgatattggcaaactaaacaaagtcgtcagatacaaagatcgatccttgatcggttgttatggtttgagggataccaaatcggtagatgatatgttccttgacaaaccgtatagcatcccctgaatcaaccttcttcaaaggaatcccttctacccacttggtgaaataatcggttgccaccaatatgaacttatgtcccttgcttaaaggtggattgatttgaccgatcatatccataccccatcctctaaatgaccatggcttgatgatatgattcatagctgatgctggcgctctctgaattgctccaaacttctgacaatcttgacaccctttgtaatatcggaagcaatcttctaacattgtcggccaaaaataccctgcgcgccgaagcaaccacttcatcttatgagccgattgatgagtaccacatataccttcatgtacttctcccatcacaactttagcttgatcagcacttaaacatttaagcaatatcccatcaatcgtccgacaatataactcatcatgcaacaaggtatactttaaagccttatagcgtaatttccgtgaagccgattgagatggattctgcaaatattgatacacatcatacctccaatcatcgactgcaattgtagcaacttccacctcaatccccttcgccatcggcttatatcctgatgccccctaagccaaatcattagcttcaacattatgctcccgagaaacatgcttcaaagttacctgccaaaaactatccattaattctcggcacttctcattgtagaccatcaacacatcgttcttgcattcatattctcctgccaattgactgaccaccaacaagaaatcccccatgatttcaatagcatcggcttctacttcccttagtaactacaaccccttgagaactgcctcaaactcagcttggttgttagttgcataaggtttgatggtataggcaaactcaaaacttgccccacgaggggaaattataaccaagctgatagcacagccatgagtgcaaaccgatccatcgaagaataaagtccaaggcacaatatcaacagagccgattgaatcatcacgatgctccacaacaaaatcggctatagcttgtcccttcaccgccttaggtgattcgtactgaagatcaaactccgtcaaagcatatatccactttccaattcttccttttaaaatcggagtcgataacatatatttgatcacatcggctttgcatattatagttcattcattggatagcaagtaatgccttaactgtgcaggagaaatataaacacaaacataacttctccaccagagaataccttgtctctgcatccaagagcctgcgacttaaatagaaaatagctctttccttgccttcgatctcctgaataaaaactgagccgattgacttctctctggctgataaatacaatctgaaaggtactcccttctgtggaggaactaaaactaggggggaactaagatactccttaatattatccaaagctttctattgctctgcccctaagtgaattcttgatcggctttcaatctcagcaaaggtgtaaaaagttccaatctccctgataaattagaaataaacctcctaacaaaattcaccttgtcgatcaacttctgtagctgcttcttgtcttctaggggtttaatcttctgaattgcattaacgctcctctgagttacttcaattcccctctcatgaacaagaaagcccaaaaactgcctagccgatacaccaaaagcacacttcgtgggattcttcttcacgccatattttcttgttatctcaaaaaccttcctcaaatcggctatgtggtcatctacctcttttgatttaacaagtatgtcatcaatgtaaacttcaaccaacaagccgatcagatcatggaatatataattcatggccctctgatacgtagctccagcacttttcaagccgaaagtcatcaccacccactcatataagccgattgcacaggacatctgaaagcagtcttgtgaatatcttcttctgccataaaaatctgattgtaacctgcgttgccatccataaaacttataatcttatgtcctgaggcagcatcaaccaattgatcagcaatcggcattgggtactcatccttaggggtagccttatttaaattccgaaaataaatgcacaccctaagcttgccgttttacttgatgaccgggactatgttggaaacccactcagcatatcggcacggcctaataaaaccagcataatataaatgagtaatttcagccttgatagcatcatacatatcggctttacatctccttgggggttgctgatatggtttgtatcctggtttaataggaagccaatgttcaacaatcgatcaggtgagtcctggcatctcataatactcccaagcaaagcaatctctatattctttcaaattctctatcaacttggttctgaattctgcagataaattcttaccgataaatgtcggccttggcctatcgcccctggacctatatcaacttcttccagattgtcagccaacatgaaaccctgtcctagcttgccatcgagatcatccaccgtgtccttggtgtagaaatttgaaccctccacgacgtcctcaaagtaataatttgggctctccatcttcaattggctgtatatcacaatcggacacttttagataatctccttcccaaacttttccagacaggcaatcaatcccatccatcgcccaaagagctaaattggcactagcaacattaactgacctgtcggctggcatgatctcaatcttgtcaccttgccattgaatcaagcactggtgcatggtcgaaggaatacaacaatttgcatgaatccaatcccttccaagcaacaggctataggaacccttcccatcgatgacaaaaatgttgtaggaacagttttgctgcctactgtcaactccacatttagaactcccttggtttccgaaggattgccaccaaaatctttgagaatcatgtttgtcttgatgagatcatttgtatttctacccagcttcctgaatgtagcatatggcatcaaatttatagccgctccaccatcaaccatcatcttggacatcggcttcccgttgacgaatctgttaacatacaacggcttgagatgccgattttctgtcccctctggcttctcacagattgcttgctctggtgacaaaatcaatctagtagaggtttcctccacatcaacatcggcttgtttagcctcatattccacaggcaacataaaaaccatattcaccgatgaagatgcaacagctttgcccttgagcaaccactctgctttgttggcttcaacctcatcggttgctataactttgctcttaatgcgccattcttgttttgtctttttcagccgatggttgatttcttgttgcacttcttgaaaacgctccatgttcctcatcctctggacacttctcttctgattcttagtaaaaataccagaagggcaccatgtgatttcccgtcttcatcctcatcttgaaaacgatcctggtgtactggacccaacctctgatgaacaggcactattttttgattcagccgatttcctctattgtaagatcggcttggacccctgcattgtcactgcacctggggcaatcttctatcgatggcagtctcatcccttcgttccagcaaaacctaaaaatctcacaatcccaatgtgggtcaaagccaccatcatcttgctcaaaatacctttcctgctacttatcatgccttctttaatatttattgataatcctagctgaatttagctgagaactccgatttttcccccatcgactactctcccagacatatgcatcatgttgacaggaaaaggatggccatctaccttcatcggcttctttgaatcatcgaatttaatctttcctccctcaatagccaactggatttgttgccggaaaactttgcaatcattggtagcatgagacccagaattatgccatttgcaatatttccttttccctagctcccctagctcctcagctaatggaattatataaccagcaggaagttgaatttgtttctcccgaagtagcaaatcaaaaatcttgtcagccttggtgatatcaaaatcatatttttcctcttttccaagactcttaacccactgacatgtcacaaccttttagctcctcgcccactcggctgctgctacctcagagtcatattcttcttcatattcatacatataaggataaaaatggttgacctttttaaagtttttcttagcctctgcaaacctttgctcatgtagggctaccttctgtgcaagatgagacaagctttcaaaatcttgagacgaaaacttctccttgatcggagttatcaaaccctggaatgcaagatcggccaactaggaatcggtcaaaaccaaactatagcatctattcctcatatctctgaacctctggatgtaatcttgcatagtttcatcatgcctctgtctaactgctgtcaaatcggaaagctcatctcatggttcccactgtagaagtaactatgaaactgtttctccaaattggcccagccatgaacagaattataaggcaacgaagaaaaccacgtgaatgtcgacccagacaaagacaaaggaaacaatatgaccctcaaagcatcaacagccgatgcctcaccacattgggccaagaatcggctgacatgctcataagttgacacattgtcttgccttgaaaatttcaaaaagtctgggaccttgtatcgtcttggcaatggaactctctcaaaccactcagggtaagggtgccgatataggtttccagtatcctttggcttaagcccgaactgttccttcatcacatctgcaatcatatcagcccaaggcttctgctgaggcactccttgcatctgctattggattcgatcaaattgattgaactgaggctgaagctgaggttgaggtgatcctcccagttgatactgaacttgaggtgaatgaggctgatattgaaaattcaaattaccaccaagatagttctgaggaggctgttgcacattatgtatctgctgtttaggaacaaactgagctccaacaggctgattttgctgaataataggtgttctctgtcctgccggtatttgtggaaccatctgctgcctaatcggctgaaccacttgctgcctaattggtgtcgattgaatcggctcgacaaccggttgagatggcccaaatatagctgcaatctgttcctgagtcagccgattgacgtttttcccagcatgccgaggttgttccctagtcagtacatgaggattgaccactggtctctacgtagaagatgatgctcctggtctcaaagctgaagctgacgccatcggctgccctggaggtacattggagacaggctgttgattacatgtcaccaagcttctatatgtatggaacccaccttctggcagaaagactggcccgttatcctaatgctcagcaattgtgatatcaaccacagtcttgatgatatttgtcaaagtattgaccagcacccgatagattaatcaaagcttgatgaacagcataatcaacttgatcctggaaattattgaacttcaaggcctcttgctcctcaatctcctcttcttcaatctcctcaatctcaccatccttaggctccccacttttgtcacctgaatcaactgtgctacctttagttcccttagctttaccatgcttagatgatgtcacatcctgattttcgtcttaggatttataaattatttaataaattattattagaatttatattaaatgttcattaatttacaagtgaagttaaatgtgagaaataaaatttcctaaatataaagcatggctggatttaagttttattaaattctccatggttaattatactctctgaaattttctcggatttttcggagctcaactcttaatttcaataatacaaagagcagttcagcaattatttaaatattaaattaatcattaaatgatctgattttaattttgttaaatacgttgagtgtccaagtattttcaggatttttcttgaaatcatttgagcattggaagtatttttaacaattcaaagatcatttcagtgattattttaattggaaaaagtttttaaatcctctctgtaacatcctgaaaattcaagacaatgaaaatcacgaaaatttcaaactttttaaaacttttgcatcatgctggttgttatgattgctattgcttgccaaaccgtaaatgatcaccaagaaagtaaagaaaagaactacatttaagcaataaatatgatttgcgggaacatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctctgtatatataatagaattacgggagtatttaattcgatatgtagatcgatattgcaccaagttcctaattgcatttagtagttgcaagatgtgaaacacgatcaaaatcagaacgagaaatcccactaagaagaatatttcgtgctttaca

SEQ ID NO: 78107 - DNA, 15147 bp, Oryza sativa
aaaatcaactccattgtaaatatgaggtttgcttgaaaacttttcagccatggcaacaaatctaaagaccagtaaagatcaaatagaagaacgtggctctgataccacttgtaagatcacacaagaccaaacaaacctaccagaggggaggtgaatggcagggaaaaccaaaaacccgaaaatctttgcgcaattaaagattaccctcgaacgaagacgatgatgaagtcctattgccgccgatcgaaccgccctcctgccgccggtcagaccgccaacgcctcgctggtcaaaccgcccggacacctgcggtcagaccgcagctatcccaccagtcagactgcgcgtacacctatggttagaccatcgggacccagaaacaccggtagatgacaaactcgaagatgtagattgaaactttttgactttattgcatcaactagtgtttacaaagtgcaccaacaacactcctcaccaaaatctcgaactaaactcaaaaccctaacttgctctcaattctagtctctctacaatcgataccgggaggcctcaccctccctctctatttatacatgaggtaggctgtgcaaagcccacgaatctaacataacttaggactcctaacccacgtaggaaaccttcttttgcaagtaaacaacttatctctttccttatctcaatcaaacttcccgaattcggactcccttccaaattcgactcctctttccatacgtacacaattcctcttgtataccatatggatttcttcatcaccacgtgcattgtcctctagcctttagtatccggcatgtttttttgatccctgaacatcaacttctcccaagtggacgacgatctatcaccggcaacactctcccaaggccttaagcaacacctgcacatgcaacaaccaagaaaccatattccgagcccaagttcgtcccaacttgactcacattagtataacaacagtatccatacgtatagaaactgtctagaagccaaatacccgaggaaatatccaaatccaacaaaacaacccgaaaccgaacatgattaggatcctgccggttagaccattgggccggccggtctgactgccagggtcaaccgaaactgcacacttcacaaaatcaaccatctcataaaatctccaaattaacattagcaaaccaccaatattttcatcacaaaatctaaatcaactccttgattctacatgcaagtttgttaggcaagatgtgatgtcttttatatattatctattttacatttcaggtcgagattcttaagctagtagcttctggtgatcatgcagctgctctcaaggtaacagccgctcatcaggggcctcctgctgccagtaacctggcttcactgtacctttgaaggaaactttggtaacactgattcaacccagtgaagatgtatgtactcttggaggcggtatcactgcctattcttgcaaattctcgccagctatgactaatgcttgtattttgttaggtaccaagtctaatttgtttgtttcatttattgttgatactgatggtattagactacaacttgcatattatttgtggaagtgcatgaaacaagcataatacattcccgtggatagtaaaggcaaagcagaggaaataacgcctgaatcatgtgatattttatctgtgctaatattagtgtaactttcttagttaggatttacctctcttacgttgttcctcccatccatatggaagtgttccatccattatctggattacttcacattctgttactctttattttgggcctggttactggcttagaacttctaggtcttttacttgttttaagtagttctatttcgtccatgtttttctaactaatcaaggttgttgatgtgaaatattacttggttactacatatgtgcttctgatagtatttggttcagtggctctctgggtgctgactaattcccccttttacgtcatgtaaaattgatgggttcatttccttgatagtgctgacccagttaccaaccattcattattcctttagttttcttaaagtaaaaggttccaaccttgtctatcatccagaactccagatgatcttttgattgcatatattatgctaatttgatactgtaggacaatgtttacgttgcaatttgcaatacaagtgccagttactgtgcacaaaatggatagccaattaggtaggaattcagccaccaactagtagggtgaaattgaatgatattgtagacttatgtatgttctcttttgcagattgcaggttagcaggaggcggtattgaagaaccccagtgaatgaagatagtaagaacatcacttcgtacacaaagtgaatagtttaggcttcagatagcggacgctacaacgttcatgggtattcagctgaatacccattttttttacaaagtagctataccccatatcatcaagtatatcctgcccaaatggttggtgggtcaacaggtgctaggttcgattcctagcttccttctcgttttttctcgattattcaatcctgtttttggatttttcttccataagctcacaatattttttaagcatacatcgattatatttcaaaatcatgttaacccaacaagataaatgttttcattcaatatttttctatagtttataacttttctaattaagaaatagtatttgcattgatgatattaaccatattttttaaaaaacaaattcgccatgtaaatttttgaatacccaccttcgaaatcctgcgtccgccactggatgtacaaggacctttttgaagaatgattctctaaaaaagattgatccatgcatctgtaggtagtcacaatatatccaaggttcttacaggtcaatgtgctaatggatcatctcaaatcacaacatagctttgcatttgatggcatttcagtacatttattttgtgatcgacggcacaagaagataacactcgcatacactttgcatgtgtattcgtgggaggtgtaatagcagtgataacagcaatatgatgtttgcagtgggatagaacatgtgtatacactccgatgttctgtttctctttgtacgtttagaattttcttccctcagtatttatgtcataactagctaaccctaccagataaaatgttaaatttcatatgaggctgtggaccttatcttgtgagaacctgagagatgataccgatcttaaatcaaatagttgaactgatgccaacatgtgtaattggttggttgctaccctgtcaacagttaacaatgtggaaaattgtaaatatgttaggtaaaagtgaaaacaaatagttcgaacataaggagagaatattttgatttgcttaacactgggcctaggctaatggcaaaatacattttagttttttcttagaaaaattaaagatatacttaagcgaggtgagatgagagggcgattaaataaaatgaaaagaaaaaaaaagaaaggaagtaagagcaagaaagcaaatgttgataataaagggcacagtaattcttattttccccatacctacacacagtaaggcaagtatcaacttgggaagaatgcatgatcagttgatcactgtaaaaaggaggccgttatcacacacaccagtgacaaacgtgtggtaaatgtaccgtaacagtaacctttttatcaccggacaccgggggcgggggaacaagtactgagcagagcagagtagagcataacacacatccatcttcttgacaacgaagaaagaaatcgaatattgtgacaggcagtaggaggccaggtggacgctccagattgtttctccaacgatcggaaggcccatcggggtttcgtcacggccacggcgataattcaaagtttaaactgcacaagaggttataaagtgcttttccttttggcaaggaaatgagaatcgaatcgtatggcaggcagtacgtggcaagagatggacgttctagatcgtctcctccagtgatcggaaggcccatggaggtttcgtcgcggtcacgtcgataagctgcagactgcacagctaaagtgcttttccagagtctgcattacagtaaatgagaaggagagggcgggagaaatatccagcttcccgccctcgacccagcctataaactggctactcatccctacctctcttcttgctccaattcgtaaaagccaccatagtgtagtgctcatcctccatccacccaagtccatcgttccgcccacagctccacaccatcaaccatggtccaaccccccgccgccgttgtccaagcccagccggtttcggaggtcgaggcgggagatcccgtcctggtccgggatttcttcaggcttctttctctggggtcggaggcatccgttccgcgagacggtgtcgtctgctgttacatggacgtatccgctctgttcctgtactacaggaacatgagcggcgttctggtgctggtgccgcatgtccgtccgatgtgcgacgccccgctgatggtgcagcagctccagaagatggagatgcggtcggattgggaaatcccaaatctggccgccctcaaggacgtcgcgaccgcctcagatgctcttgggcgcatgggcaagatgatgctgcaggcgcgccgcgtcctcaagactctgaagaattacccggatggcgaggagggattggagatactcttctacaacactcttctgggggaggcgctcaccagggcgcgcgaggccataccagccgtgataacctccgctgacctgctcgtgttcgacaacggggaggtgcggctgatggcgctctccctcgctcaccaagcgatgagcaccgtcgaggcttgcctcggtgctgtccacgagggaaagggcttgactgggcgtgagatgcaccgcctcgttaagaaggtccttcgcccgctgagctacctcaggaaggtgaaggtcatcgacctcccaaggttcaacccctttgacgtctgagttctgtcttggatttatctttatcctgcaatccagctagttttttttcttttgaggggaactaagaagtggaaacaagaaatgtttgagctagtatgtttgcctttcatgtctcgttctattttagttgtgatcctgagttattgttatcaagagtgcaagatcttctgatatttatcgacctatctcaatggaaactttattattatgtgcctgcattgtgatcctctttgttatactttgtttgaagtatgaatgctgaatgcattttaattatgccaatgtgctgaccctcttttctatgaaagagaaattgcatcaatgatcaatttatattagttccttgttaataactgttctgttatcccctattctaaaaaaaaaatcaactgttctgttatatcttgtggattggccaatgatgagatgttatttgcaagcactccgataatttgaagtgcaatagcgcaaaatgttgtgagtcctggaactagctattaatgctagtttcaaacttaaatgctacatttctctatgtttttcttggatagtgcaaagtttctggttacttatgattgttttctttggttcaaacagtgtaaaattccatcaatttcctaaaatttcgttcccttatatttgttttgatgtaagtgtaactggcacaccgacaaacaattgactaatgtgttgttctgttggtcacccaatttcatcaattctcttcactttacaaattttgagccattaacaagctaattatactagcagtaactattactgtttttattttgttcatatgtctatgttgtgagaaataccagtgtactaaaactagctactttatgttccctatcactataatcagaaaccacccacttttagagcctttttacttcatggggatgataaatattaagttctaattttatcatttcgacatactgaaatgcaaagatctgggcttattgaaatctgagctcttgccttttcatgaatttgatcatatattgttcaggaaaatgtctctggactaatggggatcacgaggtgactaggacagtatcaaagaagtctggggtctcataatttttatcaagttaaccatagcatttcagtttggggttcctccttttcttcagcataactgttatgtttgtgacttctccctgttgtttacacatgcttcttcttcaatttatcttcctagatgcagtggtatataataatattacttctccctgtttgcaactgtaatttcattggtgcatgaaaacttaatttaattttttttcctgagactttttatataccacagatttggagattaatgattgcactcttagatctgtttctatatagtggttaatagctaatttgggaaagatgacgtgccatttcgtgtgctcaattggttttgcactttaatttgtgcttcacaataaaattgttcaagttattctgaaattcaactttttttttcagtgtgaaatttacatgcttaatactattcgataccaaccagtgatcaactaaactccaccgatatagcataccatttttgtttcttgcatattttcctaagaataactttagacactcctttagataccaagtgatgtaaaaaggtttgaaactgaaccgtggatcatgcattcccatttgttacatttagtttcattttcagtgagccaatgatgatcctgaagtgttgctgctgttatatcccttaatatcatgcagatttgtactggcactttctgtttcatttcctttcatgtatttatagtattggagtacccatggaaagaaccatttttccagatggcaagtttggattcctcactgtacaggatgctaatcaatgcattatcaagaaaaatgacaagaaaacatgatactaagtttgcaaaagatttctcgatgttattcaaggcaaaaattttcctgtgcaggttatccttgtggagttctcatctgactcctgatttggtagctagaattttggtaatcgttctatgattttgatttacagtttctgaggaatttaaataaatttattaatgtgcttagtgatttgtgttgacgtcagcctattttctactgttctctgtgacaaaggatatgtcatgcaattttctttgtcaagattaccagggttctactttagcccacttcgttccatggctacggtactggcatcattttggaggcgacggtaactagggatgtaagtggacttgtccgtgaacccacttgttggcaaaatttctatgtaactcgcgggttacctattaatttgacctgtaaatgggtttatggatcgacccacttgcatatctagatgtagcaaaccggaccacaaaccgaaaacctatgaattatcatttatttgatctataagtgaactcgcaggtcggcccgcttgcatcctaacggtaactcgattttccgttctataatcgcctcaatcttctaaatgtcccaacattatgaatttggattttagagtatattgacttgcttctggtgtccaggatgacaacaaaatatgagtcaggatttgaaccaagcatgcatgtaaattcccctagtttccatggtgcttaaatatgccaaaattttcaaagttcaaggatttttcaacgctcacaggttctttgcaacagtacaagatctgaaacacaacctagtttgtgtttttttttatagatttagcttagaatggagccttgcaagaaattggtctgccttctgatatttgttggtgaacttgttttgcttgtaagatcaacccaaggatgacaattgtctgcacatgttgaaccataaataatgtaacccaatgaatgaatcatattgtttattcgtttatctacaacatttgcgaggcacaagaaaatcttttgcatttcactttagtcaggtttggaagtgtttcataaaggatcaacaattgctagttttgctttggtgggccccaagatctgcatactcatctcctacacctgaagttctatttgttgggagcctttcctatggttactgatgagaggagaatccgcacacctaaatgtattttcctgaaagacaagttgatacgaattccaaagcttgtactgaattcttttacttaagctccatatgaagtagtaatgaaatagtttgaaactgcgtatatatgcccacatgcagcactggtaggacagtgattcatttgttttattaggtttgatgaattccttgatagatgctacactacttatttcattttgctgctaaaagtcaggttcattcgaatatcctgttcaacctcattttctattcgctcagttgtttgtacgtactaactctgaaagaatatgcatggtgggatggtttaggtttgaacacttcctttcattcaggacttcatatatcgatcgcttatattttactaacctatgttgaaatggacatatggtgagtctctccgacgaccaagctgaaaggtcactactcatctactatcttatctcccttaatataagggattttgacattttatttgcactgtttgaccactcatcttattcatttttttttaaatataaaaaaagaaaaattgtgcttaaagtacattggataataagtcacaaataaaataaataataattcaaaatttattgaataagacgaatggtcaaacaacgtaaccaaaatatcaaaatccattatattaggggacagatgaagtattgcctattgactgcaatttcatagttgatcacactggaccttcttgtggttgatatttatggctaggtgtaatagtctagtttagattttattgctggttgtgttatgccactcttaattactgatttgatagctgtgccagtaaaattttataaaattaaaaacatgtcacagccgtcacgttttccatccatctcttttttttccgttttattccttctttctcccatcttcttcctgcaccgacgagcgtcaagtggtggagggactagtgaggaagtgttggttttctccccttttgagtcccctgaatccctcctcgaagatgatgccaatgcactcgtcaaggaagatgacaatcttgcagagttggtagagttacccaaaaccaatccaactttacggcctccagttgaactcaaaccacttccttcagttcttcgctatgcttttctacatggtgatacggagtcgcccatcatcataagttacaaattgattgatatgagacctctcgactcacggccgtgctagaaaagcatcgctttgttctaggctactctcttcaagatcttaaagggattagtccggctctttgcacacaccatatccctttagatccttcttatgcgtcccctcgggagccgtaatgaaggctaaacaatacaatgagagaggtcgtaaaaataaaaagaggtcttgaaactcctacacgccaggataatctatcctgtgtcatatagtgagtgggttagtacagttcaggtagtgcctaagaagggaggaacaacagttgttgaaaactcgaagaacaagttgatcccataacatatatcttgggatggaggatgtgtattgactatagaaatctcaataaggctacgaagaagaacaacttcacgctacccttcgctgataaaatgttagagcgactggcaaatcattccttcttatatttcctttatgggtattctgggtatattgatggtctttaagtaccaaatctgaccgtcaaatcctgcataaaagaaaatgaaagaatacaaaatagaatatcaaacttacgggtagtggttattactaactatttccacaagtcttggtaaatattcgtatgcaggtgaattatggatgaaaaccacccgccatgtgaagaaacacacctccgcccaatcagatgcgagtactcggattggagggcccacaaaccatagcaaaaccgacatatttgaggccaacccccatacaccgttatgagggcccacaggacagtgactcaagcgagaatgggggagaaaggcagtaaaattggttcgactgatcgcccccccatcttccacatgtcgcttcctcatgcctccccaatgacggttatggcggtttcctcagcagttacaaactttaaccgtagtcatttggagctataaaagggggagctcacttaactctcaacacacaataaagtggagtacaactcactttcatacttaggcattgctctagtagagtaggtagagagtgaggggaagctctaaaaggagtacctgttaacgaccaaatttggtaaatcataggttgaatttggagtcaaaaccgaagcgggtttggagggagttcgttattcccgaaaacagagtgtgcatcggctgcactctgcatcggctagtaccaaatcggataaggagaagccgatgcagctgatttcgacaaaggggcttagagtcattgtcggactcaatataaatgttgcaaaagtattgccaggcatggatcacgttagaagaaggcaaatgtctatattaattaggatattttaatagtttccttatatatatttttggtaagagttcgcctaagggacttgttcgtcttttagagttgtaatacaaatcgagtcgtgtccgatatggacatatcatgtattttgggtataaatatatgcccgagtctttgtaaacaattaacatcagttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacattcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggcagatgcatgattaatgcaagggagtacaaggggataataatataggggttaagttttgcagtaaacagcatttaaaagtcacttagttgcccaaagccattttacaaagacgatcctagagctacacagtattattaatcaaggccgtgagcccacacgaacctgccttaacccaaggcctacgatgattcagaccgaactggcaacccgaccctgggtcccagctcgtcccaagccaacctaggccaaccattccaccttttagttgttgagcaaattttaagaattaaaacactgacttgggtacattgctcggcttgcccataaccgatggcgcggctattcgaatagattatactctgatcagaggtgtacatctttacccacaagacacatcttcctcacgtgcaaccacgtgccacataccaccacggtatacagacagaagacgtgacatagtttccaacccatcctagccatagacaagagtaccgacccaatcccatctacggccggaacccccgggacaggcaggcaggactgaacccctagcagcaggacaccggccctgtgccatgacatctcgactaccgggccgcaactcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggccgaggtgctactatcaaaaccatgcgccccgagcccagcctaaaaccatttttggggattttgaatagtgggggcggtgtgaatccaattccacaatactccaacaattccacagtgtccaggtgatatgaatattcccaaagtctagagttgtaaaaccgcctaatgttacctaattaaaagcgaagcatctacctataatcatactagtggtaccatgagtagagtgtccactagttggggttttgtttaatctagggtgaacaaggaaataataataataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattaaaaaaaggatttattgcgtcagccgaggggaggggcgcgcggaccgggtccacgggagtggggcccacgcggcagccccacggtccggcgaggttaggggaggggtttccaaacgaatccgagggagagagggagggaaaaatggggggaaagggggaggggatcccggggaataattccccctattgattgcacgcggggcagatgtcacgcccggaaattcactaataatttccgaactaatttgtgcataaaatcctcgtccaggcatcagccgaggtacacaaactgacaatttaatatacaaatccatcttaataataacgttacatacttacaaagaaaagaaaacagcagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcttttgcaaaagcagcatttagcaaagatttaagagaagtaaaacagtggagtaatttatcagaaattttaatcaacactgaacatcacacccatgctgcataggcccaaccatcctgaacaaccatacccggctgtacagatctaatctccaaaccagggagctagcaaattattaccaggtataacatctataattattgtgagaggtgtgagactaaccacgaaaaacattgcttaactcgcccataaccgcgggcacggctattcgaatagttttactctggccagaggtgtaccattgtacccacaagacacgattccacacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcgcacgattaaccatcgtgagctaccatttaatgtaaccataattaataataatataacatagcttataattaacccctttagttagctaatgtttctaagcatagctaagcaaacttacatatagcatttagctgaaccaatccaatatataaggttcaagctaatcaatttattacccaaggtatcaaggaatagggcatccaatacaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccagcgcactcacgaaccttcgcaacgacggaaacgacaagctaacacgcaaaacaaagtaaaagactaataaaaaccaaataaacaatacatataaaataaacaaacatgtagaacatgattttagatgaattatgagacttgaacggccctattctgacttcaaatgaatttaatatgaattagacaagattaaatctaattaaagcccattaaaaagaattaaataaatttaattcaatttatggacaattttaatatgtagatctttattttagaaaaatttatcaacttgaaccacctgaaacgaagctacggttatttagttatgatttttcgaagatttaatctattagaaaaaaactggaaaagaggaatcatgacgtcatgctgacgtcatcatcggcggcatgacatgggcgactacctccccggccatagatagatcggcggggctatccaagggcatttacacttagaggacgacgtcacgaacgcaacggtactcaccaaagcgtccaacgacgaacgatgacggccggcgacgacgcaagaggcggcggcggctcggttgaacggcgggaacggcgctacgacggccggcgacggcggagaaggggtggccgagcttccccgctcccgtgcgcacctaacggcggcaacgagaggtggcaacgacggcggacgcggcggcgcagcgtggccggaggatggccggcgacggcggcggctaaagcgacgcggcggcgactctacggcgcactagagagctcgggaaaaggggcaaacgaaagaggaggactagtgtcacaccacgaagtttccctcccaagccaaaattgtaatttataaatgaccctaagaaaataccggtgcaaatcaggagaaaaccctaagaaagtaatgcaaataataatcggatttgacatgtgggactttttcttgagttctacaggtcgaaattcattaacatgatttttagtggaattttcagagctctagaaataattttaa

SEQ ID NO: 78108 - DNA, 2282 bp, Oryza sativa
aaaaacctccgcgtcgctctcgcacgggcggctcgggggcgaaaaccctagctgcccgcgccgccactccgcctcctccacctcgccgcccccggagctcgccggcgggaaagctgccagcgagcagggaaggcggcggcgaggcacatcaactcgacggcctccacctcggcgcgacgaggacaggggaacgacgaagctctccgccgcggtcagaggcggagacggtggggctgcttggagaggcggtggatccggcttctttgaggccggatttggccctccgacgcctggatctggccggagcagctgctccggcgtggcggcgcgaggcagctggccggcctgggcatgttggcggcgtgaggtggctcggcggcgtgcggcctgcctgggcgtgaatacggcgcgagctgcggcggcggctcggcagcggctcggcagttgggaacggcggcggcgtagcctgcccgggcgcggagacggtgcgagcggcggcggctcggcggctaggaacggcggcggcgtggccggcccggagctacgggctgggagcgggcggcagcatggcgctggtgcggctgcccgggcgcagcggcggcgtgccgcggctcggctgtgcggccgcgagcagccccatggcgcggccagtcctcggctgccggggtgccgccgcgatgccctgcggccgggtgggtggcgtggcgtggccaggtggggcgcggcggccgggcaacaggggcgccggagccggaggggtagtagcttcaccggcgtcggcgtaggcctagaaggcagtgcaaagggagctggcagtggtggatcgtcttcctcgttaccggtcggcaccctcgccctttctggagctcctccccttctttgcggggagtttctgggttggattgaggcggcagcttgtcagcgggggaagcttaggttgccgaaactatggcacccagtcccgggttctccttctgccagatctagcaaggaggctggcgggtggtggaacagaggggtcctgggccagctctcagggatggtggttcgttggcggaagccatgtgccaccgatgtttagatggtggattcggattgggcaacggaccacagcggtagggggtttccgagcgaaagcttagcccaattctttgggccaacagtgactacgtcttcgggcgtggtaaccctcctgagggcattgttgaggtatccctcctaaggagctctgggtgaaaacattgtccagttctttggacggatgatgacggcgtctttcggcgtcgtgaccctcgtgagggcttcgttttagagtcttcgtgtcgtcgtggtgttgttggtccagtggcgatcggtctcacatagcgatggccggttcggtgcttggcttccctcactgtagcgtgtgtttgggcggttggcacatggttcagggcgtgtactctggtgcacatccttcctcaacagccagccgtcgatgtaaaacttttcttgtaaccttttcttcttatcttaattatattgaatgacctccttcggtcattccagcaaaaaaaaatctaaacatccaataagcattcagtggtcaattaactgtttcgggtctgaaacctgaagaatcggccgttgcttcacacatgcagtgcgagggtggagcagcagaggggggcagaggaccaagcatctgggacaccttcacatatcagcatccaggcatgtttaactgtaaatgacaagaatgaaaaagcaataaggcattattttgaattgaccattatctaatatggcagataaaatcgctgacaaaagcaacggggatgtggctgacaacacctaccatctctacaaggtattagcaattaccatttttaagtagccgtcctgggcattttttaacaggcattttgtaaggactttcaataaatatgcactccatgtttctgttagtttctttgtttctatcagataaaagatataccacatgtcagtctgcctatggcgcgatcgcttcagagatcaattctaagtttcattggaaggactagttcagtactcacatcctgaaaaattgcaggaagatgtgcacatgatgaaggagatgggaatggatgcatacaggttttccatctcatggtcaagaattcttccaagtgcgtgatacacctaatatatactataatgcactgtcacgcataacaaatatatagcttatctgaagatgttctcatttttcttcgaagtacaatattttgcatatctttttcaatctcccaggtgatccc

SEQ ID NO: 78109 - DNA, 11357 bp, Oryza sativa
  unsure (1)..(11357): unsure at all n locations
ccattgttttttttatcacagatccgcgcccaaagcacacattttttgagaggctttcaacaactaatgccgaatgaatggattaacatgttcaatgaacatgaattccaggtactttcccttgcattatgnattacccagatagaaaaaaaatgctgtttttactccatatttttgcaaaataatatagtcctacagtggtcacaatgtctctatttctgtgtttacacccgatggctgtgggcttctggttaagtgaaaaatgtttgcatctacatgctaggttcagtagtagtttaagaattgcaccatttggttcatgacatgtagtagtagttttagaaaggtaaatgccaatcttactccctcaaaactgtctctggaaaacttagctgcacccaaaattatttttcatctcattttacttcttaatgacatttttgttttttgtttctcttcatgcaagtcatttcaagttgcgtttcgagagcaatagtgacgatataacctatattacaagtcattttcatttttttcatgacaagcacagttcttaaactcgacgtttaaatcagtcttaggtgcttccaacttatgcaaacaatgttcaaacattcgccctaaataaatctgtggacataagttgtgaaatgttatttatcatcctacaaaatttcaacttaaaacagagaaatgagaaaagagaaataccattagggagtaaagtgatcaattttcagtagtttatgggggtaaagtgagctgaaaaataatttagggagttatgtgctctgccaaaatagtttttctttagaaatgttcttcttagcactagcatagtatattattccttacttatttttgtggtgctctctggccatgttttgcccctgcaggttctcatatctggctctctagaaagcttggacatcgatgacttgcgctcgaacactaactattctggaggatatcatccggtatatgcgcttgaaataccatcctgccataattcaagaatactgaaatttcttattgaagtttgtgacaggctattctttcgttgctttgcaatgtagcctagaacactcttgaaatttgtgacattagaatcttcttactttcacaaaagctaatcaatagattcagttacgtggatcaccgttaatgttttcttagtgtttgtggcctgttattgattgccatggccaggatgtgctccccgtgaaccattaacttctttgaaacataactttatccttttcttttaatcgtgctattatgaactacaacttctgcgaactatttggcaattttgtgcatatttaacaatgtttgcagactgccggaaaagggaatattctataataatcaacttttgccacattctggatacccgggctttcaatcatgcatcaggatttacataatttaaatatcacaaatttacattttcaatagacataaaatttggaattttgaatattgaaattggttggtatagactggtttgtggggaacttgcatcatgtagcagtagagaactaccaaggtaattagtgtacttatgccattgatgaagacagaaactacaatatgccattgacgaggttcagttctaccatacagcaccggacaacccgttttcttcgttgtataccattcttgttactatcaagttagctagcctcagttaggtgctgccaatttttacataatgaccaaaataccatcacagacctcttatatcaatcctcttatgatgatattccctctacaatcaatatactcagccggtggtgcagacatcccatggcccactgtttccgcacagctgacagccgaaatcgtgctacctatccgcaggtcagctcgagctgcgctgaccctcggtgacgaggccattcagcaaggtgctttggcttcaggtgatttagaccctgcgctagcgaaactgaacccgagtgacctcaacacgtgaacgaggcacgcccaggcaacttggttgccatcccgtttctatgaagcgcgttgacccttgcggcatgtcgcaaattcctttttgttgtgctgccggcttcaaggaaacaagtcattttctaagttcgagaatggaatctttggtcaacttccctcagaaatcttgttgatttgcatatatatccagcagattaagcttgcgctattgctaggagttcactagggcaaactggtcttttcttggtgcctaatgaagattgcataacaaagtagtgacagggaatcagggtgccatatagggaagaaaatggttgtccaatggcatattatagaattaaactttgtcgacgtcatgttttggaactttgacctgttggtatattaatagattttctctttttttttccctgtcctcatttttgcgaggtctgaatgttcttgtatttttctggttaggtaaggattgacagtggtttttgtttcaggaccatgagcttattgatatattctgggaggtcctaaagagcttcagttcgcataatcagaaaaagtttctcaagtatgtgttcttttttgagtaatttgttccttgcctttttgagattcagtggttaatttgttcgtttttgtattacttgcctttttctgtgtgcatgtataatttctactctcaaacatggaaataaaaaagataagttgtaataatgtctgctgagtgtattgccttagtatctcttttagtttagtctctctatctacccctgctttccttgatgcacagatggcttatgcataaacatgatttatggctattttgaaataatgcttttctcctagtctcatcatgtggttgatacttgataaatgcacaggttcgtgaccggatgttctcgtggaccactccttggatttcagtacctcgaaccaaaattctgcattcagaggtttgatatacctctgttttaagttccattcattgaaattgttaattgcatcgtaaactctctctgcagggctggtgttcctggcatggaggaggaggacgaagaccgcttgcctacatcggccacttgcatgaacctcctgaagctccctccttatagaaagtaagtaattgtagtaactactgtaatgcatgttctgtcatccttatgggttgttcgctctatctgatcgtttcgattgacagcaacgggactaacggattcctttgttcttttgaacagcaagacacaattggaaagcaaattgttgtacgcgataaatgcagaagctggttttgatctaagttaaaatcggcttttggaccaaatattgtgcagtgtagatagtttctaggtaacagattaaaggcacccaagggccaaaacaccgacctctgggcccccttttgagccccccataaagtaaaaggaaggatcgattccaggaggaggtaagcgaaactgaagacacgaggagggaggcaacagccagctgctcaagtgctgattaggccggtgataaattattcaccttaaataagcagatgctgttgttgtaatcagccgtgaacttgtacatgtatttttaccaacgttgtggttggttgatgtcctctcgtggagttgtgggatgacatgttagttgggtttggaaaccggcatcagcgtcgctgtagctgtactttggtgttggtgttgctgtcatgtaaggtaaccctaacaccagctgcttggtgcccaggggctgggaatcatacataatcagtgaaaaaaaagggagagatttgtaagagaaatttggaatggttttgatgtcattggctgccttctgatgtttagatgtggcgcgtacaaggtgtttttagtccggcccaacccaaagtaaaatgcttttcttaacgcaaaatctaaattgagagccctcttgatttagtcataagagtactagtctattaagagtactagtctatcaagtaagttgaaaaaaaaatattcctaccacctatactttaaataaaattttcttttaaattactcatccgatttatgatccgattataccattgttcgtaacaattaagtctttacgataatatcccacgtgattatattttgataaaaaattataaattaattttataatatatctaaattatttttagattttactaaattacttcctagacatataaaagtaaataaattcaataaagcctaaaagtaatttacatatattatagaagtaacttaaacaaaaagaaagtagctttgtcatgatattagaagtaatatgtagtagggataaaaacatgactctatctagaaattaaattaatcagcacaaattataaattgactaaaaacaataataatagcaatcaactcatagaattatgaatgtataggaagtaatttaatcaaatctaaaagtaacttacgtatatatgataaacgtaacctacgtatataataaaagtaatttataaatattaatattttttatcataatataatcatgtaagatcttgcaatgaatacaatggtgtaatcggatcgtagatcagacaagtaatttacgagaaaaatttatttgaaatttagatgggtaatgactaataaggctgtgttcgttccagtgacattgggtgagaaagctcatcgttttccgcgcgcacgcttcccaaactactaaacggtgcgttttttgcaaaaaatttctataggaaagttgctttaaaaaaatcatattaatccatttttgcaatttaaaatagttaatactcaattaatcatatgctaatggcccacctcgttttgcgtatcttcccaatctccccaatccccttctcctcaaacacaccctaaggatgcaagtggaaagtgcgactacttttagtaaaaagagtaacgaggggatatacactgtactatttttggtacaaaggatggtcgttagttagcactaactagtgcatacgcttccattagtcgcgtactttccttaaatcttatttttgataaacaagtctgcacaggctagcctgtcgctttttttgcactctctaaataatacgttgtgtttatcgctattgttctaaaccatccaatttcaacattatcaaaaagaaaacccaattatatagcacctctcgattgtttttaattgtttatgccatgcacgtttgattatttatctcatttagaaaaataaataatttaagcatgacttatattttaatagttgcacatgaattttgaataaaatgagttatcaaacatatgttaaaaaaaatcaacaatttcatatattaaaaatcaaagatagtaataatgcatgaatatgaccagaaagcactgggagatgaaaacgaagcggattcggacgtatattgattatatcatatcctaaatcatatttttaagcggatagtgtgcagatgtggaacgaattgttttcagatgttgaaaatggtgtggaaaaatagatttaatttgacagatgttgcgcgtgtatgcaatcaacacaacatcgagttagtaatgcaagagacaaaaaaaacaataatcaatgaacgaccgatagtaataattatatgcttaattggtaaacaacatgactacatgatatctataaataaaaatgtagctatgcaagtgtgacatgagacggtaaaagcattatactaagaaatctaggttaattgatgaattagatcattggatgtgccatcttatgttatatgcaacatatagagtggttacatgggttgataatttaggattattcggcaaacgaactatcgaataatccgatagaaatattggataatccgtatttgttatattttagagataccatatccgcatccacaccgtatgtggtagatttctaaaagcccataccatatactttcagatggattcggagagggttggatcggaaattatccaatccgtattcacccctcaaggcactttcctttcaatctttcatgaggtaaaattattaccacaaacatatatatatcaaagcaataaaaataattttggaacgagactttcatgtataggttcttggtcgtcccaaagctgagagcactaaacgagcataatataatataataaagtagatctgtgcccaactatttacctaagctttttgtgagcacatttcttaaattattaaacgacgtatgttgtgtgaaaaacttcaaagtaaaagttttaaaaaccaggcaaatctatttttcaaatttatagtatttaacttaattaattgtgcactaattatccatcttgttttgttttggctaataagcttagctaaaaatctctactaaactcagccttatacataaaacattttatttcttttttaataatggaatatactttcggcctttgctcaacgagctacaaccaattattacaccaaatcgctcaaaaacgttcacaatctaatgagaccacaaaaaacacaccaatttaacataaagcaacacaaactaataagcaccaacacaagattaaaaatcaacaattattgaatcctattcgtgaaacctctatccaaagttggcgaaaatctgcatgactgttgacttaagtttacgacatgcataatttattagcttgatgacttcattacacctttatagttgagcccaacaccgaaaccagtacattgccctgaaaagtacttacatataagattctgaagatgctttatcaaaaaccatatcatttctactaagttatagagcctaacatattgtatatgcttctacaaggataagtttgttggtttttttatcaatacccacaagccaatccgtaaaaatatgagatatagtatgtggatggtataacccaaaagcaatatgtactgctctctaaagaaatctggaaaaatggcaatccaagaataaatgataaattgtctcatttttcataaaaaacaacatctcatattaccattctagccaagttatccttcggtaacactactcctttaagcagataccatataaagatcttaattttaagagacatattgagtttccatatgatccatttctttaagtataaccattattgattaaaactaagtacatagatcgaatcgagaattgaccattttgattaaggttctatcgaaaaacgtcattttcttctgtcaaataaatatgaacaattgaagcacacaagttgtgcctatatatttatcatattctggcctactaatgttcttctaaaagaaacattgagcgaaacacaactcataacatttgcaatcaaagaatttctcctacgaactatagaatacaaagacaggtacctatccttaaaggaagtattgtctatcaatttatccttccaattctgacttgttcaacattattaactatccaggatgccatatttaagaaactattcttaactttttatgagacccgacaaaaagggaatcaccttgttttctctcaacttgatttattgattgattaataaaacattttatttccaaagtacgtttttaatagtattttagtaaggttaaagattcgtcactatccccatctctttaatcttatatggcccatgtatatgtacggtgtgcacatgtcttccatgtaattacattgttttttttttttggctgtagggttttgaagtaatgaagtgaaaaaggaggagtaaattttactttgcgtcgcctttcattttggatgtttcaatttgaatactctttaatcaatatttttacttaaaaaaataaaacattggtaataaaaatgtgacctcaagtaaaatttaattaaaaaagagagagaaagaaatagtgaatataatcaactcctctctgttggatctcaagaaagagttgggcgcgagagcaccgacgacccaacaacacaagacgaagcgagcgacgagacgacctaaccccaaagcgaaaaaagttgctgcatccttagcgcgcaagcgaaagcgagagggagctcgcgcgcgcgcgagggatcgatggatcgaccccaggtgatgcccctcattcagcgctcaccctttctcctcgatccgagctcttgtgttgtttttctttttttctaggattttgatcgatctcccttaggagggagggagggagggagcttgtcccagatccagcggtttcttggattagggttcatgggggttctctccgctcggatccaggttaggaggtggttcgttttggattgggttctagaatgacccttggtttggttgatggtggcgggaggggattcttgatcacgcgcggcgggatctgagctgacagaaatcaagatttttcgttttcttttaggacaacttgtgccaattctgcttttcatttcagatctggttgtaatctgaagagacaataatctgacaccatatgaatgctgtttgtttgtttcaggtagttaccgagaactatgccaatcctgtgacgtgcctctttcatgtgctcttcaaggtgattgtaatttcgttgtatcgttggaactctgcttgtgctttctaggatttttgattgttctgtccgcgtctgatactcgttatcttgtctgtgcgaaggctggggcgctggtgttctacatcttgttttcgctcttcgtgaacagcttcgtcatcatattcgtcatcaccgtgttcctggcggcgctcgacttctgggtggtgaagaatgtgagtggcaggatattggtcgggatgcggtggtggaatgagatcgacgacgagggcaacagcgtgtggaagtttgagtgcctcgatggggaggtttgtgcttgcttcaaatgtgacattgctgtttaccgtcctaaacaatgacttttgcattgacttgatggaaataactccgtacaggctcttgctcggatgaacaaaaaggactcgtggctgttctggtggactctttacttgactgtaagtgatctattatctgttaaagagtgtttaatggaatatattatgtagctggatagatatattgcatgtaaagcaagtttgtagatttagcagaaccatttttgcattttagatataacaagaattcagaatgactaagctgccatttgcaatctattgcggcttgaaccaagcattttgaattactcccagggctagtaatgtgttctttttttctgtagggtcatattttactatgttaatcttatcggctttttaacgtttcacttttggttaagctttttcagtttttgatgttgaaggtctttgttatgttggctttcatcaaaatataggaatatatttgcttgtaggaggaaaaggaaacatgcgttcattgttagaacagggattaagaaccatttaatatccatcaaaagggctctatttgatgattaaatatatatataggtgttcctgtagcacttccatacaattccattcctttcagtattttgatgtgctggatgctattttattactgtgggccagtacataggacatgaataaaatattatttctagtttgtcgtactaactcaaaaatctcttttcacacacattactcacatttaatcaaagtgattctcatgtatagatcatttatctggctgtctgtctacttgtctgcttttcccaacacaaccactatactgtaataagcattaagttgacatagccggtgctgtgttctcttgagaaattggaaagtccataataaattgggatcactgtgaaacaagagtcttgtggtgacagtattttacagtaatccctaaaatgttttgctcacatctgtttgataccttttactatttacggaataaggtaataagtaagtcatgctagagcttaatagctttctgtagatttgtagagcataaaaaccaccatttcatgtttcaggctgctgcatggatcattcttgggatattttcacttatcagacttgaagctgactaccttcttgttgttggagtttgcttgactctaagccttgcaaacattgttgggttcaccagatgcaacaaaggtatttcctacttcagattctagtcaatatttctcagcacagggaagataacctctcacattctcataaactgattgttgattgtgatgaacaatgctatctgttaaaaagtttgcatgatatttgaaaaactcagtgtgtcaagctgtcataattccactacatctgggatgatggtttattggaaaactgtacttgatggttcagcttcacaaattccagttaggcacatgttcatcaacagacaccatgacctattattattgtcttaaactttgtcttctgaaacactcatttatgcctatcaattccattctctttgttttcaagatttagattcaagagttatgctttgatacatcatgttatatcgtgctacttattttgcaaatataacttatgaaaccttatattgaagctttctatgatttcattccagattaatctttttttaagccaaatctgactattttacatatgtaattgtgtattacagatgccaagaagaatatccggggttactttgaaggtcatgctcaaaatgcgatcacatcccgcatcacatccaccctgcaatcagcatttggagtaatctaaaatccgagctccaaacagcaaggcccttttcgaatacaaccatgtaaaatctgtcaaaaggattagcgtgcattatcccatttccatacatttttgttgacccaatacacccagtaggttgattttgattggaaagacagagaacaccttgttagtactactgccttccaaaggagtaaaaaagaagtttttagccgagaatatgtcttgagtctgagtgtaccctttagggattttgaccctggaacctgtcttccaatgcagcttcttgttaattccatatattattaatcatttgctgtgctgtatcttaacgacaattttctgtaattttatgcattctcgcaaaatgcccgtacatggttacgtgattgagaaaatcgcatcggcacattgaaacaagaaatctattttgaatttagagcttaacttcagaattaaatagatgttttttatttatagctactagtataaaaatttcaagcggactcgaattgacttctcattactgtataactcccttaaaagagttacatcatcaacggttcataaattcgaccgttatatttggttttgagaatgatggtcccacatgtcatagtttttagaattttcagactcaccaccgtcactactctctcctttaattcttttaaaggagtatagagaaggccagaaggccaattcagaacggcagtattgtgcaaaagaacatatataaacgtcgcttcaggaaagggaaactaaaaacagaatgattatttggaagct

SEQ ID NO: 78110 - DNA, 48837 bp, Oryza sativa
aaaaatattgtccacgtcatcatgcatatcaattgaaatacccaatatttcaatgccaaaagcctttggagttcccttccccattttcttgtgaatattgtttactgtgatttgttgaaggacaagatttaacccttgttgcatcgacaccatccacattagtgttcccttcatatagtattttcagctaaaacatcctagtgttatttgccatgaaaaaagtgctaaagttactgactgtgaagaactattgcagaaatgactataaggactatgctgaaatctgcttcaaagagtttggtgaccgagtgaaacattggatcaccttcaatgagccttggatcttctgctctaaggcctatgcatctggcacctatgccccgggccggtgttcaccctgggagatgggaaaatgcagcgttggagattcaggaagggagccttacactgcatgccatcaccaactacttgcccacgcagaaactgttcggttgtacagagagaaatatcagttcactgaagaagttgtcaggcagtcgcagttcatccatgataatgatttacatcgaagatccgcaaagttaagtttcataatccaaaattacttattgcttggcattcactttcagccaggtcctggtggtagagtttgccagtacagacattaacctttactagtagtagttgataaggaaaaaaaggaaagaaattctagaattcacaaaaaaaacaataaaaattggcacttaatcccaatgtgttatgtgccctagttagagaggtcaaaataggtcagagaaaatatttatgtattatacaagaccttctcacataaaaacaaaacatcatgccttaatctcggtcctcctaatacaaaggtctggatctgttggttaggttaaagatatactcctattattttattattttcatgctaaattcaatgaaagactttagagttgataagaaaagcaataaattcataaaaagcaaaacatctcccattaagttatcttcaaattcaaacacatatcagtatccaacatcacaaatgtttctgatagctagctcacaatttctgcgggtaacttgactagctaattactttattaactgcagcgctaatttatatcctgcatattatgaaatggagacatgcatattctagtccagtgatatattcaaagcttctgcaatttactgctacatgataatacgttcaaggccttataatttgaacatgattgttatacatttgttgttaatattatttttagggaacacaaaacctttgaccatgcatgcagattgaatgcttagtagaatcaattctgtttttcaaatcaaaaggaacaacaaaatgcttgacaaatgcaggccttacaaaaggggaagattggaataattgtgaactcacagtggtatgttcccttctccccatccaaaaccaacaaggatgcagcaagacgtgttctagatttcgtgcttggatggtaaattctttgtcacacataatttcttcattaggagactgaaaattctaactatgaaatcctttctaggcttatggatcctctcattagaggggactaccccctaaacatgagagaattggttggaaatcgcttgccaaagttcaccaaagagcaatctgaaatggtcaagggtgcatttgatttcattggacttaattactactcttcaagctatgctgagaatgttcttccatcgtatggtcttaagaacagctacaatactgatttccacgctaggattaccggtgagtcaacatattctgggatcagtcaacttcttttgtgcgtttgaaccatgaaatataaacatatggcaatttttttggaattttggatacatgcattttgtagcttttttttttgctactaggtgctaaccttgcccaattatgctaggtagtcgaaacggtactctcattggtcctcaggtgacctacagctttgttacccacaaaacaaattattagtaaaagtgcaaaacaatgatcaggtgacatgattgaactctataaacaatatgtgtgtaggctgcttcatcttggcttcatatataccctcaagggctccgtgaattgttgctttatatcaaggaaaactacggcaatcctaccatctttattactgaaaatggtaagttcccacaaacatataggtcatacaatttctccgcatttgttcaaaccaacactactataacaccttctgattcttctttctattttcctattttctccccaatctagccagtaagtgcacataggacttgaatattttttcttctcctatctatgtgagagagagagagagagttctcctctagcttctaactaaaagtgtatgaatcttactgatcctttgtactcgtacatctcaaggtgttgatgaagtcaataacaagaccatgccactcaaggaggccctgaatgataatacgaggatagaatattatcacaagcaccttctcgccctgcgaaatgctatgaggtcagaacatcaattcagacactcagctatcagtagacaacttaaagatggtactaacactgcattattccatatgcctccacagggatggagcaaacgtgaaggggtactttgcatggtctctgcttgacaactttgagtgggcggatggctacacactccggtttgggctaaactttgtggattacgatgatgggatgaagagacaccccaagaattcagcccattggttcaagaagttcctccgagaaatgaaacagggatgaaaagagtcgcacgcattgccttcttttttttcattgaacatcgaaattgagtgtcacagatgaaatgagtttgagatgtgcttctttgtttaggctatacaagagtaaacttcacaaaactacacgttttgttgtccaagttacaataaaaccacacaaattattagaagcaacagatgacaagtgattcacattttctctaagaaaaagaaaaagggaattacgccagaaatgcacacggggtactggatggaggctcacctcacctggaacgaggagaggggggattgagttgactgtgttgtggctgatgaaggggacgacgagagtagggactagcaaaggcttggaatctcgcgctgcctcgtcatttcaatcgtctcccattgggccatcgctgctggagctggtgctgccgccttcctccgattgggggttgtaacttgtaaggatgcagagctgaccgatcaagcggatccacgctgcccgcccgagcagaccgaagtttggtcgggtggaatgtagtagccatctgtggccggagcgtggggacggagaggatggcgagagggcggcgctagccatggcgcgcggcggcgacggcggctggatcgtggaggactggagggcggaggctcgagagagctggccttttcctcgtctggtgtaatgggctcaatcggacgaatcttcgatcctgaaaaccggcccacctcaaaagcttttgtaagcccaacaaggggtgtggaataagttcactttgagtcccttaactatagctcaaatttgattcatacccttatccgcaataccggatatgttgaccacccctcaaaaaaaaacttttaaaagtggtgtaatttgactccctgaaacggttttagaggacgatttcgctaacgtggtgcgttgacttggtccaacctactaagtcatcatgtgaaacccacccataaagtgacttctcttcttttcctcccccctctccacccacccatcaaatcagtgccaccccctcatcccccttctgctccatgtcgggccaccgtcggggacgaggaagcgtggacgaggccatcgtcgcgccaccggtgagcctattgccctcctctcggatccaccggtgccccaggaagtggaggcaactgcgagacgttggcccgttatattattattattattattacttgatcagatgattgcatttggaatagtaaagaacatctcattatattattatttttttacttgatcagatgattgcatttggaatagtaaagaacatctcgttatattattatttttttagagaaaaatatcttttacccggtctctacatctaactagatatatatgtagccttcatccaaccagatatatgagccttttaaaattaggaacttagcctatcaaacatgaaacttagccctcaaatagctcaatctgaaattgacttctatggagattttaactcgggaccttgggatgctactcaaatcactgcaaccgttaggctacgtgccttttcacaatagtatatcggatgactaaactgaattggctgatgcgatgcgccgaactttctaactaacctggcctctatatagatattttacctggatcgaagtgattaatgaaatcttccagattcaaaaaacaacaggagtttgatttcttgatgatataatgggagtcaatcacaaggctccgcattcgttgaaaagaaaaatcagagagagagagagagagattttcgtcgataaatcaagtgacttgaactaagctagcccaggagtaagaagacatcggataaaccataacacggcagcataattctgatatattccgaaccaaacattgcctaggataaaccgaccgaatatgtgtcacgatcctgcccgacactaccaacaacaccgtgcaacattagagcaataatccggctaatccctagtaggatacgcgggtgggttacatgccaaaatcccgagcatccgatccgcatcccggcggcatatctctcctcgccgtccgacggctacgtcccctgcctcgcttccaggcagatcgagcacacgcacgtacgtacgcagctagtacgtacgtacgtccatcgatatcatcctgatcgtgtctcactcacacgcgcgcagattgaagcggttcgtgataccctaaggcgccggttttaatttgcccggtctaagatgcgagcccgatgctcgtaatatgccgtgattagtgatagttttgggggtagaaatggattcttcggtttggacactgccaatcgatcgagcacggtgacggttctatctttttttttttggctcgtctgtttgctttgcaaaggttatcttatctctcgatcggtgtcagctaatggtacgtaggacaattgttcatggggaggaagcaagatagtgttttttttttttgtgtgtgtgtgtacacatgtctgtcaaagcaagaatgggaaatatattaatggagaatgattacatggtgcgttacgggcatgttcatataacatggtaggagtatagaagtaagaagatgcatgatgctccgttcaaaaaaaagaagatgcacatgtacatcgagactatcaactaaattaatttattttattttttatgtttgtgtctttgtagctagagaggtctagtacgcgagcaaagatcctgtcttttgttctttgttcaggccatgcatcatcattttgtcgctacgtccacattcagtagtgtgtggtaggacgtacgtacatatacgagactacgactacgtcgtcgatctaacactagaataatataatcgtcacgatggttactaattggttaattaactgcttcggctgtacttctgatgctacgatgtcactttaatttactaccttactttaccgactcattatgcattcttcgtaggtgacgtttcatattatttttacttattttctatttttatctgtctttggccaataataagatgcctaaagcaaagtacccatcttgtttaatttcctttgtttaatactggaaattaataagcaactgtagctctcttttttaatcttaagcaacatagagttttttttaagactcaagttattaatatttattaaggatagagttcatgggaaataatttcagtgcagtgcatcgtccgggtagaaaatcttatagcaaaggaccatccttacataaggtaagggaaaatgaactgcgagaacaaccttgcaaatgaaaccatacatcagttactgctgcgacaataagttctcagttttctagctgagaactaacataactagtttgcaagcggtgccataatataataacataagacatgctttgaattattgatcgttgctcatatttgaaaaacctgggctttgtttgattagaattccatcaaacttgccaaattatacctttgtttagactgttggatatccactcccatcttcttcatttttttttcattttttatcaccatcctacaattaattaggtggtgaggttgatggagatgaagataaagttatgtcacataatataaaaaaaagtttgattaattgatttttaattattatagacttgaaagtgagtttatctgatgttctaaagcaacttctatataaaaagtttttacatgaaatataccgtttaattgtttgaaaaacgtgctaacggaaatcgagaaaaatatatatctttaattagaaaataacaccacctaagaaagaacaggatgtagaagaagatgaaaaactacggaggaaacttcaaatcggacgctcgattttgtaaaaaaaatcggatggaaaatgtttcagttgatcaccggtgaaacattaagttatacatggtgaaaaaaatcagctaatgaaacatttaaaaattatgtgaaacacaacaaagatacacgtggaaaacataatgctatcgcatataaaacattgagtgttatcggacggaaacatatgttttgtcttatcagaatataatcatgtgatatcctattataaagatttagttataattaacacaacggtatgatcagataaataatttatgagaaatatcatttcgaagatgtctaaatgcatgcatggatgaagcgaagagatgatagaagcaggtaattgtatgaattttgtgaaacacagtaaagacacgcattgaaacattgagttttaatgatttcaaacacatgtttttttctttcagcatgatataaatatgtgttaacttgttgtaaatgtttaattacaggagaaaaaaatttaaagtaaggagaaaggaagaagaaaaaaaactaatcagatgcaatcttgcttgcatgcgagtgtcagcaaatggtttttcttctctcattgggcgaccaagcctaagatcttccaaaagtataaaaaataagtactccctccatcataaattatagggcgtcatatttttaagtaaaatcaaactcagtaacttttaactaataattttactaatcatatatatgctaaatattatacatattatatcactagattcatattttaaaatattttatgtgatgctaattttatatttgttgggaatatagcatataataaattaatgattaaagtatattattgaagatcgtttctactctcactttcatctccaatattgatttcacccctactttttagagtttttgtttttgccctcactttttttaaccaaacaaactttttgcccatgttttagatggagaagttaacggtgttaactactacgtaaaaggacatttttaccctctaccatctctttcctttcttcttctttcctgctacggaaaagggtttttccgtgcggtcaaaaaaaatttcgcgtgcagatgaatgatttttgcatgcaggtgacgcccccgcacgtgaaaattggattttttttccatgcttatatcgcccacacggaaaaataaaaaaccgaaaaaaataaaattcacaaattacccaaaccctaaccctagatctgctgctccccgccgccggatccaggcgggggactgtcgccgccgccagatccgggcgaagggcagccgccaccgccggatccttgcgtggggagggcggcgccgctcctggccgccgccgccgacgtcggcggcggccgcatgatgtggggagggtggcgctgttcccggccgcctcctcgtcgtcgtcgtcggcggcggcgccgctcacggctgctgcctcctcctcctcgatgtcggtggtggccaccgcgctacctccgccagcagccgcgacgggcgcctcctcgtgggcgcacggtgacggcgccgctcccggcagccgtctcctcattggcatcgtcatcgacggcggccaccgcgatgcctccggcagcagccgcaccagcctcttgcgcctcggtcgccagcagcccggccgccgcctcatcggcagcggcggcggcgagcgggcgcctcccgcctacgcgcttagagaaagcaaaggagaggagagttgaaaggcaaagagagagagaagtgtttcgctcagagagagagaggagtgaatattaaaaggagaaaggtagagagagtaggtgaaaattttgaagtgtatgggagggaatagcattttgaaaggtgtgtttcagttaagacgttcgcctgcggaaataaactcatttttacgtgcggttcactaaagaggaccgcgatttttccgtacggtcctcttaaatggaccgcatgggaaaatgagccgatttttccgtgcggaccgagttaccgtccgcacgcaattcaaaagggtccctgttcaggaaaatcatttgcatagtagtgtcaccaaacagtgctacctgccatcggcaggccgtaaggcggtgcaacggtggctacagcgtccaggttgtcgtgatgcaggcgccgaggcgcggggccactgtggacagacggcggcgtacgacaagcggcccggccatcggtgctgctcgccgcccctccccttgttctcttttcttcttttcctcctcctttcccgatgtcttcgtctgccatttgtgggcgacggggctcatcgggacggtgtcggcgcggccgtggggaagcatagtgttgccatggaacggcgacacggccttgtgtgggcatggcaggcgggcagcgggccggcgaacttgatgcgacttcttcggcgcgacagacgctgctccccttttttttggttttcttattgtttgctattgatgtatcacagcttggccgccgctcgccgccgcctacgcctgttctgctcgccggcgggaagagctgcgccctagcccgctcgctgccgccgtcgccgccgcctggaaaagttgatttgtgggcgagaaaagaaaaaggaaagtgttagatatttcctagtggtaaagaggtaaaacacaaattcgaatttttttcctttatttctctattttttttactgccataaacccgtcccactaactttcatccaaatcagaggtaaactcctcttttggttaaaaaaaagaggaaaaaacgaaaaacctaaaaagtagggataaaatcaatattaaaaataaaagtgagggctaaaaaaatatatatgttatactcacggaggaaacagaataagatcgacccaaaaatatactcctttttggagtaatttgtaacggagggagcagtatattttccaaaaactaccgtgacctttccccaagtcgacccaaaaggccaaaacccacgggcgcggaggccggccggcggagaccacaacggcacaacccctcgaccgcccggtaaatcccgtggcttacgaagaatatgcgcgcccatcgcctaggcggtaacaatggaggagcggcgcgcgacgtcgccgtcgcggcacagcttttgtcgcgacgcccttggccgccgcgggggggaatctgggggcggcctcgtatatatataccgtagcccgctgaggtcaccgctccaacgccacggcctcaaccgggagtggagactggagaggtggaggtggaggtggaggtgggaagctgccacttggcgccagcgcgccgctgcccacgctcggatcggaggtatggattccccttccccactcgctgcgtgatgaaccgatgaaccgtagtacttgatgatatgcctgatttgcttcggcattgtgccgcttctctgttagctgggagtttgtggcgtgtcgtttaactgaagtagagatgtgatgatgatctgaggtgagcgccattttttttttttggctaactctgtttgttctattcagtgaatatgagctctcttttttgtcccctttttatcattctgcttctatgggtcgcggagcgttcttggttggtgcagtgcaactgcaatgtcagtatgcatgccatagtaatgtgatggtgggatgtaatgctcctctgcttgctcgagctctttcttggttgtctatctatcttggatgatttgatcaatgtactacttattatctgctgatagtacccggggtccatttgcgctagtattgaacttcttcttctcttataatttgctgaaatcgcgagattatcgcttaggtttatcaatcagaacattatcatgtttatgcttcggttcgttcggtactggcacatgtcaaataagcggaaattctgctactttttcggcttaccatgaatggcacccaacatagcgtggttgttttgtcatgttgaactagtacaaatttttgcaccttaatatttgctttccgtgcatatccaattaacctgcccatcaaacttcttttcagatagctattattggggaaaaatattttcccagcttcttttatagtgactagactgtttatacatgcctgcgtaattgcttccttttgatgagctagtacattatagaccttgattttgttttgatggtacgggttggttattggtgtccatataatgaaattgcaacttgcgaccactccatgatagttacctggtcattccttgttggttaataagctattatttcaaatatgaatgttcatcctacttgtcatattatagacatttgtcacaattcaagtgaggaagaaattctgtaattttctatgggctagttgctgcgttaactacaataatggggctgacatcctgaggttatagtgttcgattaccaagttctaatttattaagaggaatgcaagtcaacatgcatgcctagcccatttacttttaatgagtagtgtaacttctgttgcagaagtactaatgacagctttctatataaatttcacaggttgatttatcaaggacaacaattcgtcagaaatggacccaaagagatcaatagatgatcaattttctaagttgcatccaagtttaccagttgatactagaattggcatagtgggagcaggaccaagtggcttatcagcagcctatgcactagctaagctaggttaccgcaatgtaactttgtttgagaaatgccatactgtttcagggatgtgtgagtccattgacattgaaggtgaggaaactactcagcaaaattatacagtcatcattttgtgcacacttttagttatcagcaacattcgtatgtaggacgaatatatgatttgggaggacaagttatagcagcaaacagtgcccctgttataactcaccttgcagaggaactagggtctgatttcgaagagatggatacacacaaactctccctgattgacagccaaacaggaaatattcgagatcttgaagtagctgaggactatgtatccatggtatctctgacgctaaaattacaggtgagttgttctagaataaaatttaaatttgaggtaactggataataagcatctaattatttataatattctctctatttcttgcatgcgtgttattcaataattcttacaggatgaagcaaataagtcaggccgagctggacttcatgctctcagtggattggcatccgacccgacccatgaatttttgaagcaaaatggaataaattcaatgccaaaatctgtagcatatggttacaccgcttcgggctatggttttgttcaagacatgccctatgctttcattcaggagtttactagaacctctatggctggtaaaatccggcgtttcaagcatggttacatgagcatgtgggagagattaagtaaatcattaccatttgaagttttttgtgacacgcaagttctgaatgtcaagcgcaacagttgtggtgcaaatgtaaccatcaagaacaacaatggtgaaaaacaagttttggagttcgacaaaattatactatcaggtgctgttgctttcaagaacagcaaaacatatcgatcctctagtcttactggtgagcatattttaaattcagtttggctggcattgaagctatagtatttcagttgccttattagtatgtatgatcttttgttcagatggagaaagtgaagtggtggaactaaacaatcttgaaagagaactattcagtaaagtacagactatcgactactatactactgttgttaagatcaatggattcgagcacataccaaagggattttactactttggagaattcatggaggatccaacaacaataggacaccctgtggcaatgcaaagattctttgctgacacaaacattttcttgttttggtcttatggaaattcagcagacatcaagggttcatttgtggctaaatgtgtgactgatgtcgtgagttctatgggaggcaatgttcagaaagtaattttgcaacggcggttcaagtatttccctcatgtcagcagtaaaggtatatatgttaataatatttctcctgttgcaaggtcttcttttttctcgtgataacattggtaatttcctgcattgcagacatgaaagatggattctatgagaggttggagtcccagttacaaggttttcagaacacttactatgttggaggtttgctagcatttgagcttaccgaaagaaacgcttcgtactccatcatggctgtttgtaagcactttgccattgatggtgagggagaactgactccttatgtcaaggtgagcaagaaataatggcgtaatatatctcaattattaattccaccttcatcaaatttcttagagaaattgtgcatatatttttccatacttgcagagattattccctttgtcccataatagaaatccatcacctcctagagatcttggtgagcttgaaggtgttgaatttcctgaccttccctcccttgatggatatttgcaatactggggaactcataaagtcactgagaagaatgttatctatacttggatcaatgaagaaggaaagctcatgaatcgaagaacctaccaggagcttcatgggaatgcatcttacgttgcacaaaaacttttaacaagcacaaaacctgttatcaagcctggtgatagagttctgcttattcacctccctggtttggagtttattgatgcattctttgggtgtattagagcaggagttataccagtccctgtattgccccctgatccaatgcaaagtggtggacaagctcttcttaaagtcgagaacatctctaagatgtgcaatgctgtggctattctatccacctcttcgtaccatgctgctgtacgagcaggttatatcaagaacatgtcactttagcaaagagagttcagaaatgctcagcacagtggcctgacatcccatggattcataccgactcatggataaagaactaccggcgaagctcagacagcttcaactcagacactgttttatttaccaaaccccagccaagtgacttgtgctttctacagttcacttcaggttccactggtgatgccaagggggtgatgataactcatgaaggacttatccacaacgtgaagactatgaaaaagcgttatagaagtacttcaaaaactgtccttgtcagttggcttccacagtatcatgacatgggtcttataggaggtcttttcactgctcttgtaagtggaggaacttctgttctattttcaccaatgatatttatcagaaacccccttctgtggttgcaaacgatcaatgactaccatggaacccatagtgcaggtccaaattttgcatttgaactcgtgataagaaggcttgaggctgagaagaacaaagtatatgacctctcatcaatggtcttcctcatgattgcggcagagccagtaaggcaaaaaactgtcagaaggttcatagagttaactcaaccttttggcctttctgaaggtgtcctcgcacctggatatggtctggctgagaactgtgtctatgttacctgtgccttcggtgaatgcaagccagttttcatagactggcaaggaagagtatgttgttggtttgttgagcaagatgatacagacactctcatcagaatgttgatcctgactctctaactgagcaccaagaagatggtgttgaaggtgagatatggattagcagtcctagttctggagtaggttattggggcaattcggaaatgagccagagaacttttttcaatcagcttaagaaccaccccaacaagaagttcacaagaaccggtgatttgggacggaccatcgatggtaacctttttattacaggaaggatcaaagatctcatcattgtcgctggtagaaatatttattctgcggatgtagagaagactgtggaaagttcttctgaggtcctccgaccaggctgttgtgctgtggtcggtatcccagaggaagttctggctcagaaaggcatctcaattccagattcttctgatcaggttggacttgttgtgattgcagaggttagagagggtaaggcagtctctaaagaggttgttaacaacatcaaagcacgtgtggtggaggagcatggtgtagctgttgcatctgtgaagcttatcaagcctagaaccatatgcaagacaacatctgggaagatacgaagatttgaatgcatgaggcagtttgttgacaatactcttagtttggctaagggcaaccatgtatctaagaaaaagggtctttttcggtctctgacaacaggaactggcatggagtcaaagaggtccctcttgaggcaaactgttgacctcaccattagccattggcccaaaagccaagttaaaaactccaatgaaataactgagtttctgacacaaatagtgtcagagcacactggcatttcaaaggataaaatttctctaactgacagtctaccttcgtatggttttgattctattgcagtggtacgagcagcccagaagctctcagattttcttggtgttcctgttggggccattgacatctttacagcaagctgcatttcggagcttgcaagcttcttggagaatttggtgcataagtcacaaacacagttggcaccttggcccaaaagcaaagtgaaaaactccaaggtgattatcgagtttctgacaaagattgtatcagatcaaacagggattccaaaggataaaatttctccgatggatagcctaccttcatatggttttgattcaattgcggtggtccaagcagcacagaaactctccgattttctcggtgtacctgttggagccattgacatatttacagctggttgcatttctgagctagctaccttcttggagaatttggcgcataagtcacagtcacagttggcacctggtgcatcttgctatattgaggatgagactcaagtggatcccatggatgccattagtccagaattcagtgttttgggtacgggcatcctgcaactgctggctcttacttatgtctgttttgtgctgctactcccagcatatcttgctagttcgacatacatgagcattttctctacagtcagtctggtcagatcaccattgctgagctatcttagttctttggttatggcacctattgtgtggatcttttatatctcgctcacttctttatcactgtctatcttggggaagtccttcctacagccaaattatgttctgatccctgatgtttcaatatggtcagttgactttgtgaaatggtgggcactaaacaaagcacaagcattagctgcaaagatgctagctgtgcatctaaagggcacaattttcttaaattattggttcaagatgcaaggagctcggattggttcatctgttgtcatcgacacagtagacataaccgatccatccctgttgacggttgcagatggtgcagttcttgcagaaggcgctcttgttcagggccatgaagtctgtaatgaagtgctgagttttaggcctatctggattggctgtgaggcttcgattggtccttatgcggtgcttcagaagggaactgttgtggaagatggagctgttgttccaccattgcagaagactggggctgggaaatcaacacgtcggactagcagaacttctgtaagcataaaggtaactaaagtatgtagacttcataatctacttcggtgtaataaaactatgatttgttatggtatacaacgatagtttgttccttcctgaccagaaacgtatagttgattatttctagacattgaatatagtaagctacagacttataattacaccataggccatttgaatttccttgtggtctttaacatggatgaagctgccaccaaagaacttccctacctttttacatttagtgaaaatattttttgagattcaggaagggacatatattttatcagggaaccataagcaaatcatttatgtacaagtggtcaagcagaaaaatcatataaattaaacaagatgaagggtttgtttggattgaagtcaatcttttggcaacttcaatagtattgtatagatatttggtccgataccaaatttttcccacactagtgcaaattctactcttaacaaatttggtagtgccgaaatttaccaatgttttggcacttccagtattttggtaagacaaaaaaatggcttcaaaccaaactagcccaaactcttttctgcatggtgcatagtgtctgcgtgtgtgcattttcattcgacagtggggtatatatctaactgccttcaaagttctcgattgcttctgcagaacatgtttgttcatggccatatttatataatgttattcgaatacaaaccgagtattttttctttgcagaaagaagcagccaaagcaaacatgatacttgaacacctcgttagcatctacgcagttggcatcctgggtgctctgtccggtgcaatcgtctacacactatacactcacttgtccggcaaagcggcttcgcctctgcatttctcctttgcatgcattgctggtgcgttccactggttaccagctgccatcactgcctatgctgttattgtccaggagacacccacaagtgcactgtcatttgctctcttcactgccttcgccgacctgagctatggtgtcatcctcagtattctcaccagtataaccagcagagcccttgctgcaaagcctggaaccaagcagaatggcattgcgagtttgatccaccggcgcataaccatctctgctcatgtcaggtttgccaagatgctatctggaacagaagccttctgcgtgtacctgaggcttctcggagcaaagattggcaggcattgctctatccgagccatcaatccggtggcgaatcctgagctgatcagcgtcggtgatggcgtccatctaggtgacttctgcaatattgttccagggttctactccaaggggggattcaccagtgcagagattaaggtccaggagaacaccgtggttggcagtggcagcttgctcctccctggctgtgtcctccaggagaatgtcatcctcggcgcgctctccgtcgcgccggagaacgctgttctccggcgtggcggcgtctacgtcgggtcacagtctccggccatggtgaagaacaccttgcttgacgaggatgaacggatcgaagagatggatcaggcatacaagaagattgttggcaacctcgcggcgaacttggccatcaccaccatgaacgtcaagtcgaggtacttccaccgcatcggcgtgagcggccgcggcgtcctgaggatgtacgaggagataccgtcgtttccccggcacaagatcttcgcctccggcaagtccttcccggtgatcgtccgccacagcaacagcctgagcgccgacgacgacgcgaggctcgacgcccgcggcgccgcggtgcggatcctctcggacaacgacggcgaggcgcctctcctcgacctcacactcaagagcggcaaggcgttctacgcgcgcaccatcgccgacttcgccacctggctggtctgcggcctgccggcgagggaggagcaggtcaagcgctcgccgcacatccgcgacgccgtctggggctctctccggagcaccgactcgtacaccgtgctccactactactccaacatatgccggctgctgcggttcgacgacggcagggagatgtacgccaagttcaagctccgtcctgctgatccagacgtccccgaggactccggcaaggtggtgccgaggggcatcctgccgccggagaccggcgcgatccccagggacgaggatgacacgcgccctctgctcttcctcgccgacgacttccgccggagagtgggctcaccggacggggtgcgctacgtgttccagctgcagctcagggaggtgcccaccgacgccgccgcccgcgacgtcgccctcgactgcacccggccgtgggacgaggccgagttcccttacatcgacgtcggcgaggtcagcatcggccgcaacctcccgacggaggagacggagaagctcgagttcaacccgttcctccggtgccccgaggtggacgtcatcccggcgacgtcgtgcgcgcagagcgcgtccatcgaccacggccgctcgctggtctacgagatatgccagcgcctgcggaacggcgagccgctgcccgcgtcgtggcgagctttcctggagcagtcggacaccaagatcgacctgtcaggatgcccggtcgctgccgccgcgacacccacaaggtctaacgccggcgacgccacgaaggtgacgctggccaggacgtggtaccaggcgctctgggccacgctgtgccagccgctgctgcaaacgctggtgccgtactctgtcctgggcctcgtcatcttcctcccgctcaggggcctcctcgccgtcgccgcggccacccgcttcccgctctactggctcctcccggcgttctgggccgcgtcgggcgtcgccgccatggccacgtgcgcggcggcgaagtgggcgctggtcggcagcagggtcgacggcgacacggtgcacatctggtcgccggccgtgttcctggacacggtctggcaggccgtgcgcgccgccacggcggagtacttcgccgagctgacgcccgggtcggcgccgttcgcggcgtggatgcgggtgatgggcgcctccgtgtcccccggcgacggcgtgtacgtggactccatgggcgcgctgctgaacccggagatggtgcgcctggagcgcggcgccgccgtcgggcgggacgcgctgctgttcggccacgtgtacgagggcgaggccgggaaggtgaagttcggcgccgtgtccgtcggggaggacgggttcgtcggcagccgcgccgtggccatgcccagcgtcacggtggacgacggcggctgcctcgccgcgctcgggctggccatgaagggggagacggtgaagcacagcatgtaagcaggacgatgacgaggaggcatgcatgcatgcatgatcagttgctgtgctgcttttactcttctttttcacttctttgaacttgttttatatacgtacgcgaattaggatcttggtgatcataatatggtagtactcctatgatcaataagtgaccgttggaagaagaaataaatgatcggtataatttgcctgcatatttgtaacgggttagatggaattatacggaatataatgaaacaaataaatcgaccaccatcgtggtcagcatatatatctgaacagcattagcattagcattagcagcagcagcagcatataagcaagatcggcacctgcgtcgctgtctcggtgatggtctttttccctgtttaaacttcaaaattttgtgatgtctttgtctgccatacggaaaaagggatatatggggatcgtttcgagtccatgaccatgttggtgatcgtttccaaaccaaacaaagctttccacactgttggcgaaaaggttgaggatactattatgaattttaaaccgatctcctgctaccgtccaaagcaaagagagaaaaaaaaggaggcaggcaatggcaaacctgtaaatacggagcggtatcgtgcaacgactctgacagcctcaacaacacccagccttcccctgcaccagctggccctgacgtcagcaaccggcagcgccgccgccaaaggatggaatcccaggcccagcaagccacaaccactgcacgtgggccccaccccctcatctctctccctctgcaccggggccccaccgcatcagcgctcgccaccaccgaggcaacgtgtccctttcgcgacactcgagtacgcgagaccgtacggcgtgaggcacctgcgctgcactgcagtactgcacctcccccccccccccccctgcaaaggttggaaggagcagaaaaggaaagaaaagcctcttctactactagtcttcttcacctttttttcctgtgcgtcttcccgttgctgcgcgtacacgattgaggcgcgggcgcgcggctagactctggatggctcatcctcattgggccgtcaagccgtgctgctgcttctgctgctgctgcctcctcgtcgccgccgtgctcgccgtcgccgtctttctggccatgtcgccgcccgccgccgccgccgccgccgcattggtgtcacaaccaggtaggttcaaaaagtgcggggtcttttctgtaacgtgagttcttgacgacgcggctttttgtagcggcggcggcggcattgcaacgggccgagacgacggcgaccatgtacaccgcgaaggagttgcgggagaagcaggacgtgaccaaggtcggtctgagctcaaaaaaaggtggctcttttcatggctttcttgccctgttcgatcgatctcatggtggtgtagggtttcttgatttggggggttgcagggcgcggaggaggacgtgaccacgacgacgacgacgacggggttcggcgcggagtcggagagggaggtgcccaccgggccggacccgatccaccaccacggccgggggcccaggcggcagtcaccgtgagtgcgaatcccccgtcgccgtcgccgggttaacgaatcgggcgtgaacccagaatcccatgagacgcgatggtctatgaaagaaagattgtgctcttcaattcgttttgctgaatctgtgatgcacttggggattttattcagattcatttcttgctgtagggaacacagtagtatgtctgaagaactaggcagctagcttaccaccattatctttgttttttgcataccaaactaaggaaaaaaaatacgattcataagttctccctaagttcttcttcctaaggaatctttgcatgcttccggatagttcctctttactctctcttcttgtattgtgatggatttgagttttgaacagggagcttgttcctgttcaagtattctgtatgttgatgcatgattgattgttcaagttgaggaaagaagcagcaaaactttttgttcctttttctgttcatggaaggatgaaaactgcagctttgttctgttgtgtgcaatgaaaagagttcatgtctagtcttctgatatgtgctggccctttttgaggcctggagcagcagcttggtccaatgtgcatatatctcggctcagaagtgcacaagacttgattcgaaattctacctggttgctgctacttgctggagtagcaagcatgcttgcctgttgtaatgcctttcttgttgtactccactttttaatttggtgcaacaagtcatacaatactatcatgttcaacctttcataatcgtataatgcaactccactgcacaagagaatatggttgtgtgtttatataattcagaaaatgggcattttgtgttagctatgagtgaactgagtatcagtgaggtgtgagggtacgtttcttatgttgtttgatctatgtatgtggttagaaccattttcaggttcccttcaaaattaagattttcagaacaacttatctataaactatgtaatccgtagcttttgatgtactgcgatttgcaatattgcaatgatcaaggtagagagcatctgaagttgatgtagaacgttatatttagttgacacaatgacagtatgaattaccttctgttccatgacattgcaattcatgtcgactacctggtttgatttccagcaatggatccaaaagctcgcattcttgtgatttacttgaaatgattgtagttgacgtattgcagttcaccgtttgctgacggtgtacagcttacacaaatcactgagagagcatgttggaaacaaacacgcagtagaaatgtttaatgatcagagcagaattcaagtatttttagccaaaaatgggggaaataaatgaagcatacaacgaccaagtactcctactagtacagaaataggtacagtttgactcctttaaatgtaggtcctatctgattcgtatctcttaaccacaataccagatatcttaaccccctaaccattaaaacgatgcaatttaatttctatcgacgggtgatacccgtagaccggatatagagagtattagggtacgctggtacaagggtctacgtaatacgacatcaagcagacaaaagacgaagattatactggttcaggccccttgataggtaatagccctaatccagttgatgtgagattatatgatggaaaacacaggttacaaagggaacaatggaactcgatggatccgacgagatcgtagtcgagttggttcgactagatcctcggcgatttggctcctgcaggctccgacttcgtaggctgtgggggttgtattggctctgagattcgatgccttaggtcctctccggggggtcccttttatatcgcagatcaggcggtttcccagtagaactcggagacatcagaccttacacgatacattgacgacccagtcttgtccgagtagaactctttctatccgtaaactccgtgaaggatttccttaatgtatgcagagagtatccatatgcgcgtgggtatgccataccgatatgcgacgtatatcgaagggtagagggtgtacctaacccgtaaccctgacagtagcccccgacttctgcttaaatgaactcgtgtaaccattcgcgacttctcgtgtctaaggctgttgtcgttcccggtgtgaggaccgtagagacaggacgtagtcgagaacaccatgtgaagcccaacggtcacgagtgaatttaactgaagtccaaaaaactgccgcgcgtaacggacccagaaatttccggcggccatctctctcctttccttggaattcgcaccgtcggtagtgcgtctatttaaatggaattttggggatccattttgaatgtccgcctattgtgaaagagaacattcccgcctgcaagcgttctttgtcttctccgctcccacaagaaaccctagctcgtcaacctccaccctttctccggcgatctccgatcggcgatggatctcggcaaatcatcctccaccagcgcgtcgctgaagaagcttcaggaggacggcgcccttcctggtcgtggaaccatggaaagggaagcaggaggtactgaaccccagcccgtcttaggtcgcatggttgcgatcgaggactacgttctctgcggttttctccctccaccttccgaatttcttctcttggttttgaacttctatggtctttctttgctccatctgaaccccgattctatagccttccttagtatttttttacatctttgtgaggcctacattggggtagagccctttctcgatctcttccgcttctactacgagttgcgttggatgtaatccaacagggtatcaggatgcgttggattccgacttcgggatggcctgaagtcgcgttatatccccttccagtgtccctcctctcgcagcaaatggcggacgaggtggttctatcttcagatagaagattcggaccctgtcttcgttgttcctgaggaacaaccagacaagattttgtcttggaccgcaaaaccccctttgaccccttctcttcagttgtttatcgatgtcgtcgtcgatctccgagtgcgaggtttgtcggggtatgaagtcgctgctaacttcattggtagacggatccagccgctccaggctcgggcccacccagcctttgactattctggaccagaggacgcgacccgggtttctcctcgggatatctttctcgcatttatcccgatatgcttgtgtgcgcgttcctcctggctcatcgaaacttggttctcgattcacaggtctgagcagcgaagctatgggacgtcgtgtcagctaggtgatgatcagtggcccgacgacggcgagtgatgtccccgttcccctttgcgaaaagggggcggccgaacgcgatgccgccatcaatgtaagtgtactcagtagtcattccgcgtttttcttccgagatcgctttgtgactttatgaagcgtaggctcttcctctgactgacatcatcgggctgctcgtggaccatcaggtggaggcgtcactgaaagagaaagtcgccaaggaggcatccgatgctgctgcgctgctgctaccacaagtggtggcaatgttcccacaaaggagaggaagttctcctctgtaagcggacatcgtcgcaaggcatctgtcccctcggtaagctatcctgttgtctgatcatacagccagaacaatttcgccttacttcgcatcaaccgttctccaggcctcggacgcgtctcccccgcctccatgacgacaacaacttgtgacacttggcgagaagtaagtggatgaatttaagttttcgcgattttgttcgagcgttgtctgagccatggctgtctcatagggcggcgcgggtgaaggcagtgcaggacgagtccagagggacttccggcgcgtctcccgctgtagcctcgacggatgtcgtgcttgcgcccgggagccgcgaggtgacaccaagcggcccagccagcgatcccgcggctggtcgtggtccaccggctgccgtcctcacctgggaggagctccaggtcgagatggggcgtctcctcaaagctggtgctcgcggcattggtcgcgagatttccgaggcgaggtcggcagcggcgtcggcaaacgagcgtgccgaccggctggcacatgagctggcggaagctcgtgaagacctcaagaagatgagggaattggtggccggcaacgagcgacaacggcagaggctcgagcaccgcatgtcggagctcgggaacaatttgtcggaaatccgtggctcgttgcgggtcacctacactggtctgcaccagctcgtcggggagtgcggcattaagtctaccatcccggcgaatctcgatgatttcttgctgacatcttctctagcggagctggcggcggcgatggaggagattccctccaagcatgcggtcaagatcggagaggagacgtccaacgggatctacaccggggcgtgccacgtccttgcgtgtgtgaggctggcgcatcctgaactcgatctgcgcgagatcttggatcagggggcggctagcgatacgcgtaaggaggtgatggaagaagtcaacgatctgggggaatctgttctcccaggttttgaagagtaggatctcttgtatcccttagacatgctgtgtaaaactttaatagatttcaaccgcctttgtgcgtgcagtcattatcctagctttctcttgcattttgatcttgagtactctttgtcccttgtagagatgttgatgacgaggatgtccagcagcgcgggcagcctgagtcaccggcgatcattccggctctcgcgtttgaaccacatgcgtcgctagacaatatagactagatcctagctacgaggacggagacggcgacgacttctttaggttagtggtccccttgtcccttttttgctcctccgactagatcggccgtgttctcgaaagagaagtgaagcttgactaagttattcccacattgaacagatcttgagggtgctcttgctgggcaagatcgtcgtatccaatattggaagacgaagtttgaagtagcggaactcgagaggacaatgctggcagtaaagaaggagcaagctgtggaaacgctccgaggtcgtgaggtgtggttcaactcgtacttgaagagttgctacacatccatggccaaggtctgtagagagctccgagtaccccgtggggatcccgaagagttggcggccggatatatctcgtggctgaacggggcctgtgctcagcttgaaggcgtcggcaagcgcatcgacgaagccttgaagcaggagtgtcgtcgatcgagccgatatgccggagggcacgtgttggcctgcatacgagaccatcgcccgcgactggacctcgattttctccgtgaaggttttgctcgttctcggaggactccggcggagatagaccacctggcgaagtcgatggtgtcgttggcggagaaggtcttacaatctatggactggcgttggccttcttggtagtctttgtatcctgcgattgtcatcttagggaaaagtgtaatatagccttagacttgtaaaaattgtaaggagtattttgtgaaatggaaaagaaatctatcttaacagatctttcttactctggatatcgtgtgtcagagtgtgttctcagttcacgactttagtcggtcgtttgagtcgcacactctccctagcccccagccttgtcgtcggagaaattttctcggaggataaggctcttggacctttggcctgccttggttgaataagcactgatcctagcccccagccatgaagttggaaagttagtttccgattacacggcttggttaatacgtacggcgagaactcttacacgaccaggtcttacatggtctttcgtctctacaggatctgacaaggccttatcggctctgggcgtccccagccgaagatcccttaggttcctcggaggccttgtcaagacggcgtaaagggacatgaggataggtttcaacgctaggtgtcatctgggtaagggatcatcgggcaagaacactttgattgtaatatggacctaggaataggctttattgatgttgtaaggtgtcttacaggtatggatgatattgactcatacatagaatttacgtagttggtcaatgtttcaacaatttgccaactcgcgaccatcaccatctgcaattttgaatgcgcctggccgcaagacttgtgtgatcatgtaaggtccttcccatttgggtgagagcttgtttcgccctgcttggctttgaacccgtcggaggacgtagtcgccgatcgaaagtatgcgtgctcggatgcgcttctcgtggtaacggcggagggcctgttggtaattggctgctcggacggcaactcgttcgcgatgttcctcgagtagattcacatcgacgtttcgctgctcctcctgatcctcgttggaatacttctgtactcgtgtactctgatgtcgtagctcgctagggagcatggcctcggagccgtacacgaggaagaagggtgtttccttgctagacgttgttggtgtggtgcgtacggcccatagtactgatgggagttcttcgaccaattttttatcatgtgacatgagcctgtcgtagacgtgggttttgatcccttgtagtactatgccgtttgccctttcgacttgtccgttgctttgagggtgagagaccgaggtgaagcatatcttgactcccagcccgatgcagtaatcctggaaatcggcgctgatgaactgagagccgttgtcggttatgatgcggtgcggtagtccgtatctgcagaatatccccttgatgaatttgatggcgttgtcggccttgatttcccccgtgggtactgctttgatccacttagtgaatttgtctatcaccacgaataggaacctgtagccgccctgtcctcgtgggaatggcccgagtatatcttacccccagcacgagaacggccaagtaagagggatagtctggagcgcttgcgcgggtagctttgtgtgcttactgtggaattgacaggcttcacatcgctggaccatgtcgcatgcatctttgagggcggttggcaaaaaaaacccttgtcgaaaagctttcctgaccaatgtccgaccagtggcgtgtgacccacagatgccttcatgtatatcaaggaggaggtgtttgccatcatcggacgagacgcatttgagaagtaccccgtttggcgctttcttgtatagatcgttgccgaccatacagtagatttttgctttacgggttattttctcggcctctatatcgtcctcgggcaactcctcgctgttgataaatttgattagtgggatgcgccagtcatctatggtcttgatatcggcaacgacgtgttctgcctttgtggcctccgagctaatgtcgggggcggctgggctaacttcgccgctaacctcttttactaatggcttcgtcaggatgtctagaaaagtgccgggctcgagcggttctcgtctggacgcacgtcgtgctagttcatctggctcgatgttgtccttgcggtagacgtgtcggacctcgatcccatcgaaccttttctctagcttcctgacttctgcgagatacttggataactcggggttagagcatttataatctttgtgcacgtggttcgcgactagctcggagtcccctttcatgattagtcgcttaaccccaagtgcagctgcagctcttatcccggcgagtagtccctcgtattcggctgtgttattggtcgccctgaagttgaggtggattgcgtgcttgaattgatctccggaaggagacgtcaagataaatcctgctcctgctccttggctgttgagtgcaccatcgaacgccattgtccatgtttcgttgtcgatttggttgtctgatttgttatcgggcatagtccaatcggctactgtcggtgacaagggaccgggggtatcttgactagaggtttggggcagctgcagtcacccacgtggcctgaccccctcgggggggtcgggcccgagggtgatgtggccgcccctccctctgtctccccgaggggtcaggccgctcccgtttcggccccaagggctggggcgccccgaccccctgtgggtttggcgccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgtgggttaggtggcaacaggcggcctttcgcacgcctcgccccgtcccgtcggaatgatgagagcctctaggcactcgtccctagccggagccggcgtgctgactcctggagttagcacgtcagtcccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcagagggtcattcggacaacagccatggcaaatctccgcccattaatgagggagtaacagggagatccccgatgtcaggcgagtgatgacgctgggcctcactcaaagacaagctgtgatttagcttccaggcgaaggcgcaagccagttttttcttttttgggaagatagggtgagtccccacccaaaagaagagtaggtagaagtggtgcatgtgggatccccttgagatataaaaggaggaccttgcccacttaagaaggggggagctcgggaaagaggggggagaagacctgagctcgtagaggagagaaagaggaagagggtttctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagtgcttagaacctcacctagcgcccccggccgaaccggcaaaggggggcccgcgcggtctcccggtgaggagccccacgctccgtcatctggcgcgccaggtagggggcgcgtgtgtttttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtactccaccgcccccctctcgccgaagtcttaggcgggaggaggcgctcgagggggtcgaaagatccgcgacttcgccgcccacgagcgatgaagaaggacggcgagacggagagcgtcgcctcctcgtctacggcgatggcagcacgccccagggcgcgctccaagctgcgggcgcgctcttgcgtcacccgcccgtcgtccccgatccagagactccagcccgacgttggctggatgacgtggccgacttggtcatgacggcgcagcagcgcctaggcgccggtgggcggtcctccgctgccaaggtctctggcgctgctaccgccggctccgtgtcgtcgaggcggagggcgcggcgagcggcggccgttacccgccgttcgtctgccattccctcgtcaatgcctccgacccaagaagatgtgcgtagggggccggatgcccgcctcagtatcgagcgccggcgcaatggtcgtcgtgctgcccacgcaacagaaggcgcttcctcgtccggagcgccacttcggttcgggcgcgggggccagccccccgtgcccccgcttggtggtgtcggctgttgagcctttgtggcgagccttcggaacgtccgttggcccccaaggttccggcccaccatcaccgaaaaatatgacggaagcgtcaaccccgccgagtttctccaggtctacacgaccgggatcgaggccgccgggggtgacgacagggtcatggcgaatttcttccccatggccctgaagggacaggcgcggggttggctaatgaacttgccgcccgcgtcggtccactcttgggaggatttgtgccagcagttcaccatgaacttccaaggcacatatccgcgcccagttgaagaagcggacttgcatgcggtacagcgaagggacgatgagtctcttcgctcgtacattcagcggttctgtcaagtccgcaacaccataccatgcatccccgcacacgcggtaatctacgcgttcagggggggcgtgcggcacaaccgcatgctcgaaaagatcgcctccaaggagccccagaccaccgcagagctttttcagctcgcggaccgtgtggctcgcaaggaggaggcctggacctggaactccaccggttccggtgtggcagcttcggccgcccccggatccgccgctcggtcagggcggcgggacaggaggaggaaaaagaggtcggcccattccgacgacgagggtcacgtcctcgccgtcgagggcgcttcgcgggccacccgaaaggggaggcctgcgagcgacaaaaaggaggccggcgctcccagcagggagcgcccgaccggcaagtggtgcgccgtgcacaacacctccctccatgacctcgcggactgccgcgcggtcaaaagtttggctgagcggacgaggaagtgggaggaggagaggaggcaggaacgccgtgagggcaaggccccggcggctccctccggcaaccggcgaagtgaggccaagcagaaggcccccgccgaggacatcgacgatggcgacgatgacctagggttccaggagcctggggccactatcgccatcgtcgatgggggagcgtgcgctcacgcttctcgtcagagcctcaaggccatgaagcgagagcttctggcagcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaacgtgaagttggggcgtgtcctcatagacgggggtgcagccctcaacatcctttcccccgcagcctttgacgccatcaaggccccggggatggtgcttcggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatgacggcggtccactacacctacctccagatgaagatgccgggccccggtggccccatctctgtccatggcaacctcaaagtcgcgcttgcttgtatggagcagcgcgcggaccacctcgccgccgcgtccaagcccgagggtggcaacgagaggctcagtacctccgtcctagccgccccgaggcagcggatgatcacgtgcgacgaggtcccggtcaaggaggttgccctgggcgacggcccgtccaagaccacacgaatcggtggtcttctggacggcaaataggaagacgcgcttgtctccttcctgtgggcaaacgccgacgtcttcgcctggagaccggcggacatgcccggggtcctcagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgagaggttatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgctttcattacccccataggaacttattgttatacgacaatgcctttcgggttaaagaatgcgggtcctacttttcaacgtactactcgaatttctttgggtagccagataggacgcaatgttgaggcctatgttgatgacttggttgtgaagacgcgcaaccaagagaccttactctcagatctagcggaaacttttgaaagtctccgctccgcccgcataaagctgaaccccgataagtgcgtgttcggcgtgcctgtgggcaagcttctcgggttcttggtctctgcccgaggcatcgaggccaaccccgagaagatacgagctatagagcggatgcgcccccccagcaagcttagggatgtgcagtgcgtcaccggctgcatggcgccctaagtcggttcatattgaggctgggagagaaggcactgcccctatttaagctcctcaaacgctccgggccgtttacctggacggaggaggctgagcgggccctcactcagttgaaggcgtacctcagttctcccccagtcctggtcgccccggagccagatgagccgttgctactctaccttgcggcaaccccgcaggtggtcagcgcggcgttggtcgtggagcgcgacgaggacaaccctcactccgcgcatccccaccctgcgtcgactcgacccgggagagagcaggcaggagaggcccccgagccgaacggcggcccgaggcccccgacggcctgagctggccctccgcctgcttgtccgacggtgccaggcgcccccgacccccaggatggccccggggccactgcgggaaggccgcgcctgtcgccctctgaccccgaggtcgtcgacacagaagccgagtgcgccccgcgtggcctctcggacgaagagcgccctggagatgcggcccctggcgaagaggatcggccccgccgaaaggtgcagcggcccgtctacttcgttagtgaggccctccgggacgccaagacccgataccctcaggcccagaagatgctttacgctattctgatggcttcgaggaagttgcgccattatttccaggctcatcgggtcacggtggtcacgtcttaccccctcggccaaatcttgcataaccgagagggtactggacgggtggtgaaatgggcaatcgaactctctgaattcgatttgcgctttgaaccacgccacgcgatcaagagccaggccctcgccgactttgtggcggagtggaccccagcccctgagcccatctccgtccccgaggccagctcgggcccctcgcagctgcctcacaccgcctactgggtgatgcagttcgacggctccctatctcttcagggcgccggtgcgggggtcacgttgacctcgccaagcggagacgtcctcagatacctggtccgcctcgactttcgggcgaccaacaatatggcggagtatgagggactccttgcgggactcagagtggcagctggactggggatccgccgcctcctggtgttaggcgactcccagttggtcgttaaccaggtctgtaaggagtaccgatgctctgacccgcagatggacgcttacgtgcgccaggtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcccagttcccctagattgattgcttggatcactgaaatccaggcgtacctcgcagataagactctacccgaggaccgcgaagggagtgaacgcgtccagcgcatctccaagcgctacgtgctggtggaagggaccctctatcggcgcgcggctaacggagtcctcctgaagtgcattcctcgggaacaaggtgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacagataacggcacccagttcactagttgatgaggacatcaacaccatcgatacatccacgtccccccatgtacagcatgatggtcctattacccgcgctcgtgcacgttaactaaattatcaggtgagttctttcttgagttcatattcctcgtctttataccccggagatgcgtgcactcgtgttttactcaggaacgatggagaggatccaaagggaagaggattcgcgcggggtggattcagactgcagggcagcgccaacttctgacggccgccacgacttcatgcgaactccgatttgggcgtgcaagtacttcacggaaagcttatcaagtctactttcaaatggatccagccacatgtccatatctattctggagcggccgcaattgtcattttactcccgactattttctgtcgatggtgctgcgtcacctcttttggcccaatgggctgtgtatccaagttgggcccattaggggcgcgtcctagggttggagcacgaccctatggtcgttcttccccctctttttatacctctagtcaccgccaagaacaggcgggttttgatgatagagatagcttcttgctaccagctcgcagcgcgcgtgttggctaaaccgcccgtctgcctgtaatcggaaccccaccatattgagtttgatagtgaaactttcatctttatctagcaatttcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgtcttcatctaatcgagttatcccttacctctcatcgaaagatcgggccacaaaccctagcgggttcgcatcaggtggtatcagagcgtggttcatcggtgagagaatttacccttcccttcgtcattaattttttttcctatagcccagaaaagaccaaaaaaaatagtagattagttttcccgtgatcctatagaccattgtgactttttactagtactgcttagttaaggcttgttgagttttcgattgcatcggttgtgttaatttgctggtcttagtgttaagcgattagagtttcgagttcttgccaccaccgcacatcgccaccttcatcaattttgccgtcatcaccaccgtcaccaccatcgcagtcacccaccaaatcactttctatttgtatttgatctgctgccgatagcttttgtgagttgccttgtatcctgccgccactagaaaggaaatagaaccctgattcgagtgaccttccttaaaacagtcatatctttttcatacggactcgaaattaggcttataatatatccacggacatctacaaaaaaagttacatccgggttcggcaaatttaaaatcgccaaattcctcttgcaaaattctgtttttgtggcgagaagcttcgggacctattcgcatagaactttgaaaaaaattctacaagcttcatactttgtccgtttgagataagattttctgtggttggttctagtgtgctcctggttgtgaaaaaaatatcaaaagaaaaaaaaagttgtgtctctctcctcagcactagagagagcaagcaaaaaaaaaaaaggatccagcgagcacaccccaccattccccctttgtcaccaccttccaccaccggttcttgttttcgttgctgtttgggtttgtgttttgtggcgtcctttgtggttaggctcgcgtctctacttcaactagcctaggaccagcactgtacactatacccttgagcgattattcaatttgctttggctaacgtggtttctagttttctcttgagcattgctttcagcccaccaacagctccactacaaacccgactacagcttgacaggtcttgttgctacagcaccgatacacctcgttccacggttgctaacttgtgggttgctgtccccctcctgtgggcaaggtaagaactggtaagagcttgtgagacaagctgcgagtgaagtgagagtgagcgtcttgcaaaagctacatcccaatagttgtgtagggtttacattacatcctccattgttttgttgtccttcatttctaaaccatggcaggtctagaggataaagatgaggagggtgcatctcattccccacgcaccaaaggcatcatccaatactttacaaggcaagtgaagcagcacacagaaggacttgatacagatttgcaggtgacaaatgagaagattggacaattggagtccacgcagatctccaccaacactaagcttacagggctggagatagcggtcgcccgcattgacactagccttgctgctcttgtgaggcattttgatgctctcaatgctggaggcaatggtgggggtaatgatgatgacattgacggagagtacgtcgaggataatttggaggatgaatatattgctgacactgaacaagatgatcgagatgctcgagatcgtcgacggctacacaacaatcgacgaggtatgggtggtcgccgccgacgcgaggtacgcaacaatgatgatgctttttctaaaattaaatttaaaattcctccttttgatggaaaatatgatcctgatgcgtacctctcttgggagattgctgttgaccaaaaatttgcatgccatgagtttcctgagaacactagagttagagctgctacgagtgagttcaccgattttgcttcggtttggtggatagaacatggcaagaaaaatcctaataacatgccacaaacttgggatgctttgaaacgggtcatgcgggctagatttgttccttcttactatgcacgtgacttgctgaataggttgcaacaattgagacagggtgcgaaaagtgtagaggaatattatcaggagttacaaatgggcttgcttcgttgtaatttagaggaaactgaggacgctgccatggctagatttttgggtgggttaaaccgcgagatttatgacatcgtagactataaagattacactaatatgacccgattgtttcatcttgcttgtaaggctgaaagggaagtgcagggacgacgtgctagtgccaaggctaatttttctgcaggtaaaacttcatcatggcagacacgcaccactcctccggccggccgtactacttctccatcttccacacccacaaccagtcgagcagcacctcctccatctggtgacaagtcagcgataaaggctgctcagccagcaccgagtgcttcttcaatggcatccacaggccgaatgagagatgttcagtgccaccgttgcaagggctttgggcatgtgcagcgtgactgccctagcaagcgagttttggtagtaaaaaacgatggtgagtactcctctgctagtgatttcgatgatgatacacttgctttgcttgcggctgaccatgcagataatgagccaccggaagagcacattggggctgcatttgcggatcactatgagagcctcattgtgcagcgtgtccttagcgcacaaatggagaaggcggagcaaaatcagcgacacacgttgttccaaacaaagtgtgtcgtcaaagagcgttgttgccgcatgatcattgatggaggtagctgcaacaacttggctagcagcgagatggtggagaagcttgcacttagcaccaaaccgcacccacatccatactacatccaatggctgaacaacagtggtaaggcgaaggtaacaaatttggtgcacattaattttgcaattggaaattaccatgatgttgttgaatgtgatgttttgcccatgcaagcttgtaatattctgctaggtagaccatggcaatttgatagggattctatgcatcatggtaggtcaaaccagtactcttttctgtaccatgataagaaaattgtgttgcatcccatgtctcctgaagatattttgcgtgatgatgttgctaaggctgccaaatccaaatgtgagagtgataaaaaagcccaatctgatggcaagaaacctgagacaatcaatttgaaacccagatgcttacttgctactaaatctgatattaatgagttgattgcatcaccttcagttgcctatgctttggtatgcaaagatgctttgatttcacttcacgatatgtagcattctttgccccctgctgttgctaacattttgcaggagtactctgatgtgtttcccaaggaagtgccaccggggctgccaccggtgcgcggcattgagcatcaaatcgacttgatcccaggtgcttccctaccgaatcgtgcgccataccgaaccaaccctgaggaaaccaaggagattcagcgtcaagttcatgagttgcttgataaagggtatgtacgcgagtctcttagtccatgtgcggttccggtaattttggtaccaaagaaagatggttcatggcgtatgtgtgttgattgtagagctattaataacattaccattcgatatcgtcatcctattcctaggttagatgatatgcttgatgaattgagtggctctattgtgttctccaaagttgatttgcgtagtggttaccaccagattcgtatgaagttgggtgatgaatggaaaacagcatttaaaacaaagtttgggttgtatgagtggttagtgatgccttttggtttaactaatgcacccagcactttcatgaggttgatgaatgaggttttgcgtcctttcattggaaaatttgtggtggtctactttgatgatatcttgatttacagcaagtctatgggtgaacattttaaacatttacgtgctgtttttaatgctcttcgtgatgcacgtttatttggtaaccttgagaagtgcaccttttgcacagatcgagtttcttttcttggctatgttgtaactccgcaggggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagagaacgccttccacatgttgaaagataagttgactcatgcacctctcctccaacttcccgattttaataagacttttgaacttgaatgtgatgctagtgggattggattgggtggtgttttgctacaagaaggaaaacctgttgcatattttagtgaaaagttgactgggcctgttctgaattattctacttatgataaggaattgtatgctcttgtgcgaactttagaaacatggcagcattatttgtggcccaaggaatttgtcatacattctgatcatgagtctttgaagcatattcgtagtcaagggaagctgaaccgtagacatgctaaatgggttgaatttattgaatcttttccttatgttatcaaacacaagaaagggaaggagaacatcattgctgatgctttgtctaggagatacactttgttgacacaacttgactacaagatttttggcctggaaacaatcaaagaccaatatgcgcatgatgctgattttaatgatgtgttgctgcattgtaaggatggaagaacatggaacaaattcgtcatcaatgatgggtttgttttcagagctaacaagctatgcattccagctagctccgttcgcctgttgttgttgcaggaagcgcatggaggcggtttgatgggacattttggcgccaagaagacacatgacatccttgctagtcatttcttttagccacagatgcgaagagatgttggcaggttcgttgctcgctgcgctacatgtcaaaaggctaagtcacgcttacatccacatggtttgtatatgcctcttcctgttcctactgttccttgggaagatatttcaatggactttgtgttaggattgcctaggaccaagagggggcgtgatagcatttttgtggttgtggatagattttctaaaatggcacatttcataccatgtcataaaactgatgatgcttctcatatcgctgatttgttctttcgagaaattgttcgcttgcatggtgtgccaaacacaattgtttctgatcgtgacacaaaatttcttagccatttttggagaactttgtgggctaaattggggactaaacttttgttttctactacttgtcatccccaaactgatggacaaactgaagtggtgaatagaaccttgtctactatgcttagggctgttttgaagaaaaatatcaagatgtgggaagaatgcttgcctcatattgaatttgcttataatcgttccttgcattctactacaaaaatgtgcccttttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggaattgaattttgaacctggagatttggtttggttgcatttgcgaaaagaacgatttcctgatttgagaaagtctaaattgatgcctagagctgatggaccatttaaagtgttagcaaagattaatgagaatgcatataagattgatttgcctgcagattttggggttagttccacatttaacgttgcagatttgaagccgtatttgggagaagaagatgagcttgagtcgaggacgactcaaatgcaagaaggggaggatgatgaggacatcaacaccatcgatacatccacgtccccccatgtacagcatgatggtcctattacccgcgctcgtgcatgttaactaaattatcaggtgagttctttcttgagttcatattcctcgtctttataccccggagatgcgtgcactcgtgttttactcaggaacgatggagaggatccaaagggaagagaattcgcgcggggtggattcggactgcagggcagcgccaacttctgacggccgccacgacttcatgcgaactccgatttgggcgtgcaagtacttcacggaaagcttatcaagtctctttcaaatggatccagccacatgtccatatctgttctggagcggccgcaattgtcattttactcccgactattttctgtcgatggtgctgcgtcacctcttttggcccaatgggctgtgtatccaagttgggcccattaggggcgcgtcctagggttggagcatgaccctatggtcgttcttccccctctttttatacctctagtcaccgccaagaacaggcgggttttgatgatagagatagcttcttgctaccagctcgcagcgcgcgtgttggctaaaccgcccgtctgcctgtaatcggaaccccaccatattgagtttgatagtgaaactttcatctttatctagcaatttcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgtcttcatctaatcgagttatcccttacctctcatcgaaagatcgggccacaaaccctagcgggttcgcatcactagtgagctcttcggtgactactgcgaagacatgggcatcaagctctgcttcgcctcccccgcccaccccagaagcaatggccaagtggagcgcgccaacgcggaaatcctcaagggcctcaaaaccaaaaccttcaacatcctcaagaagcacggcgactcgtggatcgaggagttgccagcggtgctttgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagaacgaaggcggcgcgcggcccttcgagccgcgcgctaacagcagagcctgtggcgctaccatcagcgtcacatccgggcccgatcactctgcgtcgacgacctcgtcctacgccgtgtccaaacgcgtgctggactgagcaagctctcaccaatgtgggagggtccgtatcgagtgatcggcgtcccccggccgggctccgttcggctggccacgggcgacggcacagagctgcctaatccatggaacatcgaacaccttcatcgcttctacccctagtgggggtcgggtgtcaggtctcgggctcgggccaaccccgcgcccccccgggcgtgcagggttggccgggggctaccacatgcatatccttatcttttttctcttccgtatttcagtaaaagcattttcgatttcctgaggattgtgtctgtgccatcgtttccttttgaagaatcttggcttgaattagcacgctcgtgcccgaccctgccctcggtggcccgggccggctaaaatcgccaaacggggcccagaaccgagccgtgccccggggcgtggtgaactccgggggggaatcggcaaaggaccacaatcgggtcatccataaccctcggtcaccacgctcccggcctggccagtctcgacacgcggatctccctaggcactagccccgacccgcgccacttgaggttgggacctgggcacgaccctcgttcaagccaagacacagaaggaccgcggcacggaccatcctcgtctcatacacacaacaaacttaactgacgcagaaatttcctctttacttgattacagattaaatcagtctatacaagaagggggcccgaaggcctcggaagaagaaggaaaagttattaagattggcgggggcctgggggctcactccgacgcccccgggccgtcggcctcgtcgtcgctgtcgtccgcgccgtcgtcaccgccctcctcgtcggagtcgagcgcgaacgcgagtcgaggggccgtaccctcgaagctgtggacgatgtggtcggcggcgtcccggaccctcgcacgtgcgccatcctcggttccgggagggaactcttccagcgctgcccacggggagaagtcagggtccctggcctggtagcttgccagtgcgagctccaccgccccccgggcgaggtccctcgaggatgacttgatcgcctcctcgagctcctcggggagccgctggagggtcccggccatctctgagaggcgctgggcgatgcccccctggttggcggcgtatttcgcggtccgcccgccccagaggcccgcctgccgcccggcacggtctagacgggaaacggcgtcccgaagcatgccaagccctacctcgcccgccaagcggagggcttcgacctccccggcggacgagtccagcgcgccctgcagctcggtgatggtgtgttcggcggctgcgaggcgggcggctaggtcgccgtcgcccgcggccgccccgccgctgcgcgctctcgcgtctagctccttcgcccgcgcctcgaattcagcggcccgctgatccagtgcggccctctcggcgcgggcgccttccagattgaggcgcgcctgctcctcccaccgctgcgccgcggcctcggcctcctcgagagctcgctcccactcagtgagctcgtcctcgcggaggcggagtgcggactcctcttcggcgcaggcagcctcgtgcgccgccagcgttgcctcccggatggcgacggcggcctcgtgacccgccagttccctctccttcgtgtccagggcgcgggcgcggtcctccagcaccgtggcgcgagcctcaagggcctcttcgcgctgccgggacgcgtcgagcttcttctctagctccgccgcccggctcccgtattggaggcagaggtcgtcccgcgccacgttgaacacggcggtggcgatgagggcagtctcccgctcctcctccacctccctggcgatctccgccaggtccctacgacgggcctcgagctctgaggcgtgccggcggtgtgccttgcggcccgcctccaccatggcttccaccgagcgccgcccctcttcgacgcgcgcccacgccgcatcgacctccgcccgctctgcctgcaggacctccatctgggcgcttaacccgtccaacaccgtggtgttcgcagcggccaaggcctgcaggaggggttctgcgctcagtggggcagcggaaggcagagaggagagccgcctcggtgtgggcgccgcgcggctcggcccgccgatggacgtgccggactcgggggcgttccccgaggctggctcgccccaagcatcgcccgaggggtcgggcccgagcggcgcgcccgcggcctcgtcgtgggcggcctcggaagtcgtcgtcgcctcgggcggagtcgggtcgggggcttggcaggccgcccggcgtacggacggactcctcggcccggcggagtctggcctcctcccaagcggcttcctcagcctggcgagcccggacggcctcctgggcagcttcttcggcttcccggaggcggtctgcggcttctcgccggtcagctccccgcctccgggcctccgcggtcgccgtctcctcggcctcagaccggccggacttggaatggcgggaagggcgcgacgggatctcgctgaggcagaagaaaaaccagaagacgaaaaacgggtgagtgaaaacttgccttgggagatgggagaatgaatacggccgcagtgggcgcggggacgaacctgcgaggaggtcggctaaacgaccaccttgagggggagatgaggtttccccggcatggttcggtcccccccatcttgcggagccgcttcttttttcgctccccctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagaagcacgaccccctcccggggtagattgttcccccctgcggctcccgcccgcgccatcgtggcctcgaggagcccactcccctgacgccccgaccgcctgcatgatggtcaggatgttggcgcgctctggatcgctgcagagggggaggacaccttgggggatgagggatgcctccacggagctgagattcagcacccgttggatcaccatcttgaagtcttcagggacccagtcccatttgaccccctggtgggtcctcatgtagtcctcgaacccggtgtactcccaggcgccccgggcgcgccgctggagcggcgcgatccggcgacgaaggtaatcgccgtacaccatggcccccgtgagcccctgggatcgcaaaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccccgcggctagaagtagcagccaccgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagattataaagctccagaacatccatgaagaaagaagagaatggcgggaccagccctgccattgtgaaggaaaggaagaatacggaccgccccgggtagtgtggtgccgggcgtccctcacccagtgcgaccacctcccggccggtggcagattccggcatgaatcggcgcggcagcccggcctgcctctcgctcacgatgcgagaaggtggcagcacgctaccgtcgagcggtgcggagccccgtgccatgacgccggcggaggaggggcttgagagcgagtgagtgcggcgaaggtagggcacaggaaacgagaagttagaacgcaagcggcgaaggcaaggggaataatggcgagaggaaggaaacgaatctcttcctcggcgtctttatacccttaccaacgctatgcccggctcctcgcttcccgcgcccactatctcgccccctcgtttctcgcgcccactcctccaataatcccgctcgcccgtttgcggcgcacgaggcggatgtgcggccgtggcagtcgagatggcacatatcgtgcgcgcgttaactacgctcgccgaccgatgcaccatcatcacatctccaggcgaaacgaaccggctcgtcccaattcgcgcgctactcaagtaatgtagcggtcttgaagaaagccgctcattattatcggtcagtttttcccttgccgatgtgcgcgatttgcgaccactggattcctacccgcctgtagagaccggccccacctgtcaccaggcctaaggagtggcgtcatgcccgagcgctttcctcgaggagggcgatcgccctggcataacgccgggggctactgtcggtgacaagggaccgggggtatcttgactagaggtttggggcagctgcagtcacccacgtggcctgaccccctcgggggggtcgggcccgagggtgatgtggccgcccctccctctgtctccccgaggggtcgggccgctcccgtttcggccccaagggctggggtgccccgaccccctgtgggtttggcgccatgtgtgtggattaggtgagcacagcggcgctcacctaaccgcgtttattgcgggttagacgagcgccccacgccgcatttaatgcagcgcagcacactcgttcggtccgtgacaggtcacagtgtgtgaccggtcacagaccggtcagatcgcgggttaggtggcaacaggcggccttttgcacgcctcgccccgtcccgtcggaatgatgagagcctctaggcactcgtccctagccggagccgtcgtgctgactcctggagttagcacgtcagtcccggcatattcataccaggcttcatcgcaac

SEQ ID NO: 78111 - DNA, 41770 bp, Oryza sativa
  unsure (1)..(41770): unsure at all n locations
tgatccgtgtgggttacaagatttctccatgttccgcatcagaaatgggcgcgcttctctttttgtttaggtctaagggtttagtggagtgaagtgtgtgtgggttttgggcttgcagatgcttggagcgctatgtctagtgtttttttttacaagtaatttagtagtacacttgaacaccggcacgtttgaactggcaccagcattttgttggcattggggattgctcatttccaagtgtaagaatgaggcgtgattggggcatacttgcaacataggaatttcatgggaaacaattcatttccataggaactagagggaattcaactgttccgcgcaggtcctgttgtttaagagttcagtgtttcaacttttaaatgccttttgatactggaagcaggggaataaatagatcccagttaactgaattacgacttaaagtgccaaattcgatgaatggttcaatctcaatctgactccttgttgctctgagaagtgcagctacgatctaaatgcacagcctaaatacaatagcatccaaatattatgtttcttttcgtatcatctagaacggttacaatgtctatcattcatttcaatgcatattttcctttgttggtagctatgttaaccaaagagtgctaaagactcaagtttctctgcagggaggagataggaaggatgttttcttctaccaggctgatgaccagcattacataccgagggctcttcttgtggatctagagccgagagtgatcaacggaatacagaacagtgagtacaggaatctatacaatcatgagaatatatttgtggctgagcatggaggtggtgctgggaacaactgggctagtggatatcaccaggtatactttgatctgtcttatccatatttcatctgctacactgctaatcaattctgtaggtttgtcagccgatcaccaatgctataggttttgttatattctgtcattagatcaattgtgcctgtgtttcttcagtcagagtttaatatatctttcacattaatgttttttttcctatttacacactatagggtgagcaagttgttgatgatatcatggatatgatagacagagaagcagatggaagtgatagccttgagggttttgtgttatgccactcaattgctggtggaactggttcaggtcatttatctcgatctcctttcttggtttcattcatttgtcttagttttctgtaaatcaccatctattgtaactggagcgtatattggtgttttaacatgtggcttagtgtgtatatgggatgctgtagttgcaatatggaaaagtagtatttccacatgtcagttttcttacaatagttatctaattttgttcactcttccctcatttaggtatgggttcttacctgttggagactctgaatgaccgatacagcaaaaagcttgtccagacatacagtgttttcccaaatcagatggaaacaagtgatgttgttgtccagccatataattcgcttttaactctgaagcggctgacactgaatgctgactgtgtggttgttcttgacaatacggcccttaataggattgctgtggaacgtcttcatttagcaaatcctacttttgcacaaacaaactctttggtctcaacagttatgtctgcaagcacaactactctgaggtatcctggatatatgaacaatgacctggttggccttcttgcctctttgatccctactccaaggtgtcattttctgatgacaggttacactccattgactgttgaacgacaggtgatttgatcatatttgttgcattggttcatgtaacatttgatttcacattttatctgtttagtaactacttttcttgagtttagtttgggggttggtagactagtatatactatgtcaaatacatattactttccctgccttcttttgtgacaaatggggaaaaattcagttcatgatataatgatatgctcaattgcaggttaacatgatacgcaagacaacagtattagatgttatgaggcgacttctgcaggtattctttgcttccttaggaataggatgcttgccactttatgatctttatgaaatttaaattttggacctttatttgttgtcttgcagaccaaaaatataatggtgtcatcatatgctcgaaataaggaagctagtcaggctaaatacatctccatacttaacatcattcagggagaggtggatcctacacaggtaaagttctgttaaatgggtttattagtttagctttatccatagcagctggaatattgaaatgaaatttgcctagttctgaagcagaatgaagatctcgttcttctgatcctttggaattgcttgttcattccattcttatcttttggtattctcatgcatttaggtccatgagagcctacaaaggatacgtgaaaggaagcttgttaacttcattgagtggggacctgcaagcattcaggtcattatacaactagaataattttaggttaaacctttttgacatattgatttattgttatttcaactgccacaggttgccttatcaagaaaatctccatatgtacaaaccacgcatagggtacctttctctcactctctcactatctttttttttgtcaattcaagtgcaatgtttgaatcactaatgtttgtctacaggttagtggattgatgctggcgaatcatactagtatccgtcacttattcagcaaatgcctgggacagtatgaaaagctaaggaaaaagcaagcttttcttgacaactacagaaagttcccaatgtttgaggtaagaaactctattccttcaatttcatccattttcattacctgagtaatttccaaatttgaagtttctggttaaactaggtatgtttgaagtgctacaatgtaattccctgttcaaaacctgtttgacaccaacaattttgaacattccactagcaattttacattaaagtataaaacaaacatgaactgtagcactataagtttcttgtttttcttgaagtgaaatgctttcagtactatatatgatcttgtgaggaaacctgtccattattctgtccaaaatactcaacgttttggcctctctatacaggacaatgatctctctgaatttgatgaatctcgagaaataatagagagcttagttgatgagtacaaggcttgcgaatcaccagactacatcaaatgggggatggaggtacgtctttgctccatttcagtatatttgttatttactttatgtgaaatgctgagcaatctgttggaaaataggatgctggagaggcaaacgttgcggccgcacttgattcgaagttagtggtgtaaatatgaaggtaacgcattggactccattcctgatatagcttgctgtacgggtacctggaacctttgttgaactttttggagaaatattttgtacatggccttgatgagcacattattctcctaaagaagtgcatttattttatcagcagtccttgtgttgtggagagttggagatattatggtgttaaattaggtgtatcgacagtgacactactaaattcgttactcctttgattttcactctgttagctactcccccgtcccaatatagttgtccttttatgttgtttagcatagattaagtttaagaataaaagacagtaatgtcccttattaaatgatgtatgcttgtgagtagaattttgaaacctggaatttaggacgaaggggttataatattgtcttttaaacctcttgtcatgagctatgacttgtacatgcaggtcctacaagaatgcaactctaattgcctgatggtcatcagttcgatggcagctgctcgactcgttcccactctagtgctagatgcgtttcctcagcattcttcaagtttgcttctcgtgttagtgttacagcctgtgcgacatgagtgtatatcttgacccacttcgaactggccgtagtttgtgctgttccgttttgggttgcaatcccttctgggatgctttgtatgtgtggatgcgtgtgatgtactgatactgatgggttttgtgccagaatagcatgcagagctctaattgttggtgcagacaaatggtttgacagatctggctgattactgtaatgtactagagtgtaaaaacagctcgcgtctttggctgcgcctatggttttgcatccagccagccagtttgttcactttggtaattccataactttctactctcaaaacttctattaaaatttggtaaggtctcaaagtaaaaaccatcggtctatacaataccttaccaaaattaggcaacgaagtaaataagccctgaaaagtgagttatgattaatttgatgtgataaattactagctggaattctttcgtattggtctgatcattcaccagatgagccctagacgtactcgagtatagttcaccagcaggacaacgaatgaccctgacttaaattccatttaattttactgctgactgttgtacaaccagtaaatacatttttgggaagtgtaagctacaattctaccatcaatatattcttccagcaatacaaatattttggtacagctcatgatcatccaacttcctaaatgctacacccggttgttaatgacatgagaaacaaaataaggtaaaagagaaattaaactgctgaactgctaacaattaccaacgcaaaatcacacccacagaaaaggcagctgctggtgcttgtaagctgggaaaatttccttttttgaggcagttttccttcccacctcaaatgagaacgaactagctgcagcataaaagcgaaaacctgggccttcggttatgtgagaatgctcttcagcttggacttctggtcgtcggttagggttttcgggaataaaacctcgaaagttacatataggtcgcctttcttgttgctctggtacaatggcattccttcccctttgaacttcctaacctccttgggtttggtgatcccctaaatattcacgacgaaattgtgatgatcagttgcagtattgcaggtgatgaatgagaatgactacagtgtacaagaattcttgatggtgtggggggtggattaaaccttggtgccaatttccaccatatgattgtccagatgcttaatggtcttctcgaagccgaccagagcttggagctgcaggaccaaaggatggtcaggaaatacaggctaaagtgatgaacaaactaaaagaacagcccaagctctacagttagttacaatgattagtagtaagggatttcatggtttccactgctagattggcactccaagatttgggttttgccagatcttggattttatcaagttactgaggtggctggacatggaactcctcccatccacagtggctgaaaagccggaaacatatttggatttttttttatccatataagatgataaacttctttgtcatcttgggactttggtccttataatgtgaccaagtttttcacgcaaggttgtcatcaggctaattttcacaggataactacacctttaaagagagttaattagaacatgcataacagacgggggtgagcagtaccagggagattgtaacagttgtgtgcaggtcattgccttctcttctgaatcgctcatgtggtgctgttcggatcctaaactgctcatgaagcattcatttgatgataaatattagtaaaacagatcaccccctcacaataaactttaaccaaccagaaaaaggtgctaagcaaaccttcaaatctccaggttcaccatcaatcttaggctctccttcctcaaagaatgaaacttcctgcaaatataaaatggtgcggccaaatcaacatccaaactgtaaagtagaacttatagtgatgaatagaatataatgttcatgacaaacaactgtctctgatcatgttagtagcctgaggaaattaaaggccaccacataaattcaatagttcacatgaaagatcaagatctctttcctgtatcaggccaaattccaaaagctgctagtaatttgccaattaccaggtaaaaagaagcattgattggctttaacataaaaaaagcaaacaataccaattaacaagccactgattagtgttgtgatccatgaatcagccagtttgactgaaggtttcaaattctaatagtaaacaatgaagtgctgatcataaatgacagcttattagtttagcagtttagcatctagaagtagcaatagcatgtggtacacttacaaccatagtacatataatcttatctaatgttgacaaaataatggaggaaggcacacactaaatcacagcgcatcgcacaaatgtctagaaagtgaacagaacagttgctctgtacctgcccatcttgcattcctttctcaatatcaacagtcaaaaaatcaccttctcgcacatacttcacatttgcacactggtcacagacctaaaaagacaaatgcaacctattattatggagtgaaaaaaacaataaaagaataaaaataaagatatttatgttaaatcatgccaaactgtggaataacacagcaaggggcaatcaatacctgctcggtcatttgttgatacattcctggaccaatttgtctatggtaaacttcgtttctgcaattgcatcgcctctttcctggtgctggctttatgacgtttttctcccgccaaacctatcatataaacaaaaataacaaagtaaatttggagcggtaatttccatgtcagtgcagccttcacggacactcaagcatgctactgaatagagcggcaaggtaatgtaatcacttgatttacatattgtttatgtaatttatataacttatctacactacatctttcttgtcctcattcctcagctagtcaaacttggttacctttagtgagccgcccatgtacaagtcctccaatgaagcatccagttcaacgatcacatcatcaccttttataatctgctcttcctcctcttccatcccaccaccaccaccaccgaagaagctacagagttcaggaacaaaacagtaaagcgatgattaagaacaaaatgatacaataaaagtaaatgccaattaggttgaattgcatctagctaagatactactgtctaatgtgtttacatgcagactgttgacattagatttcctgatcttaaactttatatattcagttagttcctggtgagcacatcaccaacacatttagaattttgttccacaatggaggggtttgtgttattgtcgaacaaagagctagatatttacatgaaaagacctcttaaatcagatatatattgatatatggaggcgtacaggcatttatcttcagactcaatttgttactaccacctataaaagtagctcacatgtacagttatagctcagagaaggctaaaacaataaatgctaccccctccattccaaaatgtaagttgttttagttttgtcccaagtcaaagactttaatcaagtatatagaaacctaattaatatctacaataccaaataattaccccctccgtttcatattataagactttctagcattacccatattcttatanatnttaatgaatctanacatagcattacccacattcatatagattttaatgaatttaaacacatatatgtctagattcattaagatctatatgaatatgggtaatgctagaaagtcttataatatgaaacggaggaagtacactactgagacatatttcatggtggattttaatgaaactaatttgatgttggcacaattttccataaacctagtcaaagtcaggatttggaacaccatacttatgacaaaaccaaaacaccatccattttggaacggatggagtagatagcacattggcctcacctgctaaagatgtcctgaatgttcatcccgccgccgccacctctcccaccctgggcctggaactgcttcagcccctcctcgccataccggtcatagatcttcctcttctcctgatccgtcaagatctcataagctgcaacaatacaacacctttacccattaattccccctcatgtgcaccaaattttcagtcttaaaaatgagcaccaatttttcagtccaacaatgggctccaatttttcagtccaacaacgagcaccaatttttcagtccagcaatgggctccaatttttcagtccagcaatgggctccaatttttcagtccaacaatgggcaccaactttgcagtcttaacaaaggggggtggattcgttaccattgttgatctcggcgaatcgcttgttggcctcctcgttgttgggattcttgtcggggtggtacttgagcgcgagcttgcggtaggaacgcttgatctgatcctcggacgcgcccttgggcacttgcagcacgtcgtagtagctcttcctgattcacaaacacccaaaaaggaaaaaaaaatccaccaaaatttcagttgaatccaatccagtataatcctcaacagaatgcgcaccaacatgatacatacagatctcaagctgatttaataataaaaagttaaaaaaggagagcccattgcgattgggagataaactggatcagatcatgaggagggataaaaaagaagagaagttcacacgaagcgggagagggagagctgagctgatcggaaaccctaccccgcgacggccgccacgaagtgcagcagcagaagaagcagcggccctatccaccgcggcgccgccatcgccgtcccctcccgcgccgccctctcaccgagcggccaagggcgcctagggtctccccgcgggtgggtcgcggatctagggtcaggcgagagggtgtgcctcctcctcctcctccttccgcgcgctcgccggcgatgcctcgcctccgcgtcgccgccgccgtcgagtcggagtcgtctcgtcttttctccctctctctctctctcactcgcggtttaaaagcttctagaagaaacccgagggcgttgtggtggggttgggggggagacgtggaaggtgatgacgtggaccaatcggggacggggaacgggtggcggtagcgaatggggtggcgccacgtgggaagtcctttttgccttttgagtcaggcgatgcaccggaggattgtacacgtcagcaaacggtgggttgacctgtcgtgtgcgtcgttggtaaacccaacttgccccgcatggcacgctgatgagtacaatattattttttttccattaattttgggttgtattcttttacaataaataaaatacgtgctattagagcagtacaatagcagactataagtcagctgcaaacatattttaagaagataaatgagaagatagaagagcagcggctacagatttgtaaccagctgtagcacggacttcaagatatagtgtgtgtatgacaggtgggccaagtatcaatagtgtagtatgtaactattgtatgaatgagctattagattggctatagatgaattggagctagtagttgcctatactattaaacttgctctactactccctccgtttcaggttaagtcaaactgctttaagtttgactaagtttgtagaaaaaataataaaatttttaactcagcacaaaattattataaagatatattcaattattgatttaatgatactaatttggtattataaatattattatatttgtgcataaacttagtcatatttaaagtagtttgactttgatcaaagtcaaaacgtcttataacctgaaacggaaggagtagtaaactctaaaccgtctacaaacacctatggaggaaagagaataaataatgagaagggtcggctctcatacaaaagttaattaagaaagatatgagagaaaaaaaaatagagccaccgttatactcctcatatcctaaatataaggctcaatcactcctaacatagaaaccaagaaataatttaatcaccttctcgttgatcatattcatacatgtaggcaatgtgattggggagcttaatgttagaggatttaaaataaaccaaatttaaagggccaagaggcgatagttatgtatgcatacatgcacgtcttatattatgacttaggaaaattggttttgccatatattttgatacggagtgagtaggctatatttttctcatcccattttaattatcgtatttgcaaaatggtatcgaaatcaagacaagaaaacatcattctttatgtaattaaacctcgtcgattgaggtgttggaatgcctcacataagtgcatgcagatcttttgtacacgcggatgattattataaatcattcagttatttagccagtgtcatttatctctatctctactattataaaaaccgaagatgttttcgctgaaatttaggtatgacagccgtgtttgaattggtttttgagtcgttacgtcatccatgtttgaataggttttatgtcgctcgtatccaattcgatgtgagtctaaaataactattatatttatacactctccatctcaacctaacccaacccatccccctcccagcccaacccaaccggcccacatcatctcgccatcctctcccgctcgtcccttccctgatcgccgtcatttttctctcttttttttcctcatgatcatcttgaatcctctccctctccttccaatctcctctcttctttttctcccttttctcttttttcatcctcttatttttctcttatcgtaaatatctttcttttgaaattgtcattgcttgagttgtatctacagtaaaaagaaacttccgctaattgaatagtcaaaattttaaactttggttaatgaggtgtatcaaaatacacacacgtcaatttatggaagagccacccaatcgatttgtgagtttatgaaaatgtgtacatacggggttttttaccccctcccatccgttcctcactcgatcaccatcttctctctcttcctcctgatcctctccctccccttccaatctcctctccttttttctcttttttcatcctcttattttctcttctcataaatatttgtcttttgaaattgtcattgtttaacttgtatctacaataaaaaaaacttccactaactgaatattcaaaatttcaaacttcggtcgatgaagtgtatctaaatacaaatacatcaacttatggaagagccacccaatcgatttgtgaggttatgtaaatgtgtacatgtggtgtttttcatgtgacgacgtatgaagcaagcgcaacttggctcaatgctatatgatttctaattttgttttgtcttgtttcagtttatcgtttaaattaacagggtttttattaattatgaaaattttctttcatatgttgcaacgtacaagcatttttgctagtccataaaacagaaaaaactatgcatagctcgttgaaagatagattctgttatattttcaggaaactgtatcctctcgccgaagcagtgacattctctttctctataagctgataggtagcatttgaaacagattattcattaattaaattaatttcacaatctatctacttaattatagagataatttgaatattttaaaaagtaaagttaacaaataactaagtggtataagaaacataagaagcatgagaaagtttttctttgaaaaagaaaatcatatttattaaatcgtggaacaaacaatctacgacaataatttgataaaaatatgtaaaaataacatagattaaaccaaacacgctacatcctttgcacaagcgaactgctaatacaggactgatgcaatacttgtttttagaacttttggagacatactaatcagtagctggaatagctcagtggttagagcgtgtggctgttaaccacaaggtcggaggttcaagccctccttctagcgttattttttttctattatttcttttcatttttttaaaaaattacaaacatagccttccaaattgcaatattcactaaattcatttttctaaaaatcctattatttattttcattttttaaaaaattacaaacatagccttccaaattgcaatattcactaaattcattttctaaaaattgcaaacatagccttacaaattgcaatattcactaagttctcactctttttttcttttcagtttttttaaaattgcaaacatagccttccaaattatttttttaaattacaaacatagccttccaaattgcaatattcattaaattcatttttctaaaaattacaaacatagccttacaaattgcaatattcactaaattctcattctttttttattttcatttttttaaaaaaattgcaaacatagccttccaaattgaaatattcactaaattctcactatatttttttgttaattttttcttttcaattttttaattgcaaacatagcattccaaattgcaataatcactaaattatcactctattttttatttattttttaaaaattgcaaacatagccttccaaattgcaatatttactaaattctcactccaattttttcttaactttttatttttaatttttctaaaaattgcaaacatagccttccaaattgcaatattcactaaattctcactctaattttttttataatttgcaaacatagccttccaattcttccattttttttcttttctttctccccactaaattttcattttttttataaactgcaatattcagtaaattctcactctagcagacaaatttttacaaagttacaaatatagccttccaaaaggaccatttctcactctagtagataactttttacaaaattacaatcatagccttctttttttttctctttacgtagcataattctcactctaagctaattttttttaacaaaattgcaaccatagcctttcatttttttttcttaagtctaattttttccttttctttcttccctacacaattctcactctagtagatttttttttacaaaattgcaaatatagcctttcaaatggaccagtctcactatggtagatattttttggcaaaattctatataattctcaccctagcactctccaaatgagtagtcccactctagtaattaaatttgtacaaaattctatgtatttcctgcgttattcttattgtagtagatatttttttacaaaatcctgcatagttctcttctcactctagtaaatacatttttacaaaattgcaaaacctatgcttcaaaaaggagccatggttttttcttactaggggaggaggggttacctccgtgatggatggtaagcttagtttctgtggtaaaccataaaaaagcggatacaatttattaaaaaataatcaaaattccattttaattccgttgaacttggtgaggttgccaagctcttaccgttactgaaccccggcgatgaacaataaacctggttactacggtaaccatcgcatgtgaaaccctaaaacgtggatgccttcttcaatgcataaaaaactttttcttaacataatctttctactacctccgtttcaggttataagattttctagtattgcctacattcatatagatattaatgaatctaggcatacatatatgcctagattgattaacatatatatgaatatgggcaatgctagaaaatcttataatataaaacagaggaagtagtaaataagctctctacgaagtgcagaggtaaaaaaaataatgccattgacagtcttaccaggcactcagtatatgaaaattaaacaattgaacaacttgataactgaatactactattagactatagcaatatctatatctatactcctttaaaacacccaatggtgatggtggatggtgaatggtgaatccaccacaagccatcactactgccatatgggtcttcaaatagtgggtaggtggacttttgtcccttccccaacctcaaaccatcaaacagagagaatatttttttaatatttttgagggctttaaagtgttgagggttctctttttaaattcccgttgcaacgcaccggtatttaggtagaaaaaaaatcaccaaacgtgcgggtcctattcgcaaaactccccgttccgtttgatttaacggccggagatttttcccacaaactcgttaacctccatcttctcttctcctctcacgagctcgcagctcaagcgcacccagccatggcgactcctcagatctcgcgcaaagccctcgcctccctcctcctcctcgtcgccgccgccgccgcggtctccaccgcgtccgccgacgacgtgctcgccctcaccgagtccaccttcgagaaggaggtcggccaggaccgcgccgccctcgtcgagttctacgcgccatggtaataagcgatgatggtgtgcgtgcatctttgggtttttcttcttccttttctttttcggatccgcgcggggcgtgtgtgtgttctggatctctgtgatgatgaaatgggctcgggatcgcggctggatcggtggcggcgtagctctcattctcggaatttcgtagcggattcttgagatcggtgaggttttgggtggcttgtgtggagtggatcgagttgatgttaggctggaaaaatattcggatctttggctgaagtatcgatcttggccgcggagtgttgcgtggatctttcttgacatcacagattcgtttacttttccggtcccttattttgtagtatcgatcagatgtgtgagattttgcaaggtttttagggcttttatgttatatcttgcggtggttggtgttgggggagggtttatgtatagagaaattcgatattttttaaatgtttgtgattgattttgttttcaggtgtggtcactgcaagaagcttgcccctgaatacgaaaaactcggtgcaagtttcaagaaagccaaatcagtcctaattgcgaaggtaaatctcatgttttttaggtgtttggaaatttaatgtcaaggccgttttgtgtcatatcttcgctgtttgcatgccagtagttctctatcgtttgcattccatatggaaagaaaataaaaatggcattcctgtttagtggatatatgttattaggatctaataattttatgtgtttgttgatgaattgactccattttgtctatccaggttgactgtgatgagcacaagagtgtgtgcagcaagtatggagtttctgggtaccccacaatccaatggttccccaaaggttccttggagcccaagaagtgagaatacatgcttctttgttgattactcaatcactacattttctgtcgtaaagaacaatgaccctaatgttaaacttactgtttaggtatgaaggtcaacgtaccgcggaagcccttgcagaatatgttaactctgaagcaggtagacgaacgcactttccaaccaagctatcggtctccttgtttggaaaattaactgcattttttattaccatgaaacatattatgtatgatatttcagttttcaccagtcagaggattatttcataagcaataagtactgaaatatcaatgctacttggctacttcctgctattatggagcccaaaagctgttgcagctaattacatatcactgctttctcattacatgttgtcatgtctcattttcattatttgttgaacagttggctattggcaaaccaacatgctatattagctttcaaagtcccaacactgttgtaaatctttctgccttgtctttcagccaccaatgtaaagatagctgcagttccttctagtgtcgtggttcttaccccagagaccttcgactctgttgtccttgatgaaaccaaagatgtccttgtagagttctatgccccatggtatgctattatgatcagcctgttgttcatcaaacctttttatcatgctgtatcaatgaatttaattttgttggatgctgctttgttttgcaggtgtggtcactgcaagcatcttgctccggttagtagtacacctcagtattttgcaaagttgcaaaataatgcattgtcatttttctattttgtctaaactcaaacttgcacttgttttagatttatgagaagctagcttctgtttataagcaagatgagggtgttgttattgccaatcttgatgctgacaaacacactgccttggcagagaagtatgctttctgaactttgttctaatagttcttgtctacattgattaccctcgacatttcgatgtaacggcatagcttatgttggaatggtatttgctttcctgaagaaaattttctactgttattgtacttctcctaactgttagatctaacatacacatacctgtttttataggatgtgtggttggtcatgtatgtttttcttccccataagagaatttttaatcatgcatgccacttcaggtatggagtttctggtttccccacattgaaattcttcccaaagggaaacaaagctggtgaagattatgatggcggtcgcgagttggatgacttcgtcaagtttattaatgagaaatgtggaaccagccgtgattcaaagggtcagcttacttcagaggtagtgcttttatatagaaggtacttaaatacttaaatttacataatccaattccaatataatctattggttgcttctgtaggctggcattgtcgaaagcttggctcctcttgtgaaggagttccttggtgcagcaaatgataagcggaaagaagccctctccaaaatggaagaggatgttgcgaagctcactggccctgctgccaagtactaaattttcatctctgtttttaaattttgttatgtaggtttggcatcgtcactgtgtgaatttaaccattttgctaaagcaggtacggaaagatctatgtgaactctgcaaagaagatcatggagaagggctctgaatacactaagaaggaatctgagaggcttcaacgcatgttggagaaggtgagcaacaaaagtttctattcctcaattcactttggacatcatattacttaatctagaatctgatttccatgcttcatcatatgacagtcgatcagtccttccaaagccgatgaattcgtcatcaagaagaacatcctttcgactttctcctcttaaagggtgtcccacgtaccccgacgagcaattggggtatagtcagtagcgcaatgcctgtctccaagaatggaaaacagaaagaaatgaaaagaaaaggcaatatcgatatcagcaagagatggcaatggaagttcgttagttgggtattctgttgaacaaacatgtatcccactgcccggcatgatcttttttttttctttctgctatttgcttttgtggttacagggattgacatagcaatcagctagtttactcaagaacacaagaggttttgtaaccatcccgtgatgagtgatgacaccgttctacgtttgtcaatccaataatttgataattcagtttacattatttctgtttaccctggtgaaagagagcatatgttgcttttgcttttgggtttgaagaatgtggagttgctcctattttgttttgttcagtgtatgtgtaggggatgggcatcaagctagttctgccttcttcgagcttggttcgaaattaaaatattttaattatatcagcgttttatatatagttagaaagcaactgtagaaaccagtttcagctgagatagactacaaaacgtttattcaaaccaaccataataagtttaatcttgtagatgcagaaaaacaactgtaattggaacgattttgaacgacaactgtaattccgttcgttcagattatcaactgaatattataagttgcggagtgtctttgcagacatccggtagagctggaacaaatcaacaatacatataagataagaggaaaaaaaaataatggccctgcccaaaaatgatacgcacaaatccagaaaatttaaaagttctgcagcagtaaatactgtcaagtactaataacctgagagttaaataagaacgatatgcacaaatccagaaaataaagaagttctgcagcagtaaatactgtcaagtactaataacctgaggtgatatgcacaaatccagaaaataaagttctgcagcagtaactgctaaggttaaatttcatccaggaacatttagttccatttgtacatgatcccaaccggcgaagctatagcacagaatgatgtatcagttcataccattttgaggttgtgtagacaatcaaatggcgctaaaataccgcatttcaggggttaattttactcaaaggttacaatttcaggatctcgaaaagcacatgttcatactaggggttacagtggattgaacatcaatcagaattatcataagcatatgagccataatctcccacaaaaataatttccaggaaaatggcatatggtgtgatctctctgctacctattcttatccatgctggttagtttactacagtccttgtcctcttgcttaaacttgaggtcactcagacaaccatgcggggtgcaatcctcaatgtaatctatatcatgctctggtcgcccatagctgttttccggcatctggtaactgactccatcactgattgtttctctatgtgatgacgatctttctgccccttccaaaccctctagatgttcatgctgatgttcatcctcatggtcgtgtgcatgttcttgttcttgtctgccacagaacgacagttcatatgcatgtggtccctgaaccctcatttgcactgacctcagtagtgctgttttcctcaggtcacctccatggcacatgtcatttggagaagatgggaaccggccttcattttcagagccacgacgaggattagagcagacgaccgacgagagtgagcagctgggcagagggtacgggtttgcggataaaagaccagattgtggtttctggaatcggtgtggggatgacattggactagttgaagggctaaccattgcatcggtttgacttccattgggtaattgagtgtcgtagcaccggtagtcatctgaatcttcagacattggtgagtattgggatattatttcatccctgcaaggagacatataacaagactcatggtgaaacacagacctgaactagaccatgatatgtgctgagaagtataagagctaaatttgattgaacaaaactagcaatgcattctatcgaatatattagctaattagaaaattatattctggatgatatttaattatcttactgtaaagtacttgtgtcatcagcatgtgtatctaagtgtgtattcatcggcatgttgaaaaatgttacttgtgccagagtttctgtcatcaaacaaagtgctccttccacatggcctgtgccatggatatgtaagtttgtgggcatcttgtttgcttagcatgtgcaggaacatgccaaagacctatgtttcatgagtttcaatgtcaacatgccggtgcaagtgttcaagcaatcattgaggagatcaaatcacgctctccagaacaaccagttcacccagaaagcatacagacaacagattgctgtccagattatccatgagcaaacagtgcacatgcaaaactactagaaccaactaaaaaaaaatctagaaatttcatacatccatcatggtatgagaaattaacatgaagtttgcaacaataagaaattgaaatattcaccctacaaaatgtcatgttgtgaggtgccttaagctacctataaatatggctttcggttaaagtagagatatcgaggataactattgattttaatttgaagaacccataggaggtctgtatgtcgttcaattaagacgaaaaggacagccaatcccgattacttcccattgatcatgggttacaacccctcaatcataaagcatgcttacaacttactaacttgctaaacattctgatccaggaaaaaaaacatagataaatttctaaattttgatcacacctatccatttaaccatttttttgggggcaaaagatggatcacgttacaactgaagtctgaagttgacatagaactttatttgcctctacaagttagactaactattaacttcggcaagtaaatgaataatgcacacataataatgaggccttcaccatcatcttcttaccttcaatattgaatactccgatttcttacaccacaaaattgagcatgtatacatgaacaagcacagacgaagttcatcaactttgtaagaaaaatgtagataaaatctgagcacacatacctgaaataagaggtattctccgacctcgcaggggactccatgatattgtcaaccagtgaatctccgacagacaatccattcaaactggatgccattatctgcaatagccaatatccaatctaacatataagtaaaacactggaattttggtctcacagtaataatataaatgaattgcattctagagtgggatatgaactagtacaccaagaactgaagcaaggcagcaccgtttcacagagcgagaggaaagaaagaaacagaagaacatagtacaattcagcatccaaaacgacgaaatcgcccaagaatcagagtcaaatgaacacggatcgagacaaacaagaataggtaattaattaattaatagaatgaagggaacgtgcaaagcaccaaaaaaaagcccctaaacctgaaaaagactagtgatataaccagtaataaatcaaagtaaattacccgaatccctgagtcccatttcgcttcaattccaataatcacagagtaaaaaaaggccacacaaatcgacggaacaacggagaaaatcctctctctctaccgacacccaaattaaccaagaaacgaaaccgccccgaatccgagccgcggcggccaccccccaagaacaccgagccacgaaaattccccggacgcagagggcgggcgctgccatggcccatggggagagggagagagagagagacctcgctgaggtagcgcttgtgggagtggaggttgtccacgtacacgtcctcctccggatccctcccgcgcttcccgccgcccgaaggcggcgacattgccgcctccccgccgccgccgccgcccaccatccgtggccaggtcgggatcgcaagcggggattggctcgcaacttcttcttcttggagagtttgcgagtggaaggaagaacagaaaagggaaagccggaggaggaggagaagctttggtctttttttcgtttgtttcctttttttttttactccagaaaaaagaaagtatcatttgcaattgggccggccgattaacggcccggaaagcaaaatggggccccattaatgcataatacttgagccaatgataatattctgttctgtttttcttcactcgtatgactatttttctcctacctttaagttgtactccttctgtccctttttttttaaggtaaatgatgttacatgacatcgtgacttcgcagttttagcagtaggatatcgcgcaaagtgatttttaggtgaagacactctcaagagttaggccatgcccaacgctccacgctagagtgtggtctcacccctcttgacgcgaatatttgtgccagctcgactgggaccgtgccctcgcagagctccgcgaccccctgcagagtgtcgtatggtttcgtcagcttttggcgaggaaaatgtgaggaatgggcgaggaaccgaattgggggagaggtgtcgctctgtcccgtagccccaggacgttgaggccaactacctcctgcgccaaggtcgaagatggcgaggaagtaggcaggggagaagaagatggggcgccgccgcctccatccggcgccaacgtgcctcgatccgcccctgccgcctccatccggcgttgccgcgcctcaatctgccactaccgcgcctcgatccgccgctcgatccggcgacaccgcctcgattcgccgccgccgccttcatccgttgctgttgcgcctcaatccagtgtcggggagagaggcgcaccgccagggaggggagcgccggggagagattgggaggggagatggtcatgagaggactgatggtggtatttatatatgtttgtgatttttagggggtatattgcaaatattgtatgtatatgcaaataaaaataatccaagggttaaaatgcaaaatgtgaccgactgacaggtactgaaacgtaaaaataagataggggtatggcttgcactgtgtgagggatatcaccggtgtggtttcatcccacttggcatcacctttttttatggggctataccctgtgttgggcatgcccttagatatttgctagtggacaccgtatctattaaaataataatttccggataaggaggagagaaaaatcgcgtgaaatatcaaaaatgtccttgggttgatccacatgtcaactctcatatgtctcttctctcgatcccctccttctagcgcagcatcgggtcggagctcgacatggcctccggaactcctcctcgacaccccactccccaggcaacgcggacgacgatgacagggaacggcggcgacggcaccacaccaattccgactggcgtagctccggcgatgccgccctggatccacatgacagtcgtcgccctcgccctcacggcgagttccttggtgcgtgccctcctcattgtgccaccgtccatcagctcggtcgcagccgtcaccacgtcggcgctagcgacctgctcgcaccaccgccactgccttgcgctggccagagcaacgccgcatcccctgcaccaaacaaaccaacacctcgttgagtcccttctgtttttcctcgcgccatcacgctcccaagacctctctaactctattccctcaaaaaatttaaagggaagttgagcggagagccgccgccgccggccgcctcgggacctcgccgctgcgcagctccaaactgcctctcaatagttccaaagccctttcctctcctttaatcgagccgccatccaccatagccacatcgccatcgccatcccaaacccactgcgccgccggccatggcgctccctgactctagccacccttggccacgtcgctgcctctagaaggtgcgggagggcccactatagccgtcccggccttcggccaagccaccccctgcgccgcccgttgccaacgggcacgtgccaagccgtcacgcacgctcacattcccaccgagatgcggcgtgatgcgatgcatcaccggaaggaggggatagagagaagagagataagggagctaacatgtgggcccaagggcatttttgatatttcacgcgatttctctcctgacctgaaaattattattttaatgagtgtggtgtccactagcaaatatccaattttttatagtgtcttccctcaaagtcatttcacgcagtgtcttacagctaaaaccgcgaagtcacggtgtcctatcacaaaatttgcccttttttttttaacatactgaaaactaaccattttctaatcctgcatcatgccgctttttatgttttcaataacttcctaaacctaggaaaatacaattagagggaccttctaaaactaacttgcataaaatctctttctggtatttaacttcttttgtgtttttcatttaaaaatatagttggttaaattaaggtgtttcttgatttggttttaatttaaaaccttcctttgactaaaattcttttattcaaatttagtttgaaaaccctttttacttttatgaattatggtccaagaaaccttcccatactgtcctagaacctaaaacaaagcaattccaattttattagaattaattgttaacccatcctttgatcttaaacctattatttgattcttgatccaaattcttccttttgatctagccactgatttaattcctgtggcttgatttcctttttggcacaagaataatattattgcaaatattgtgaataattgctcttgtgctaagaaaataccaatttatattcttcactcaactttccctattagccacaaataattcttcaaatacttctactatcaaatttaggattcaaatcctatttattttacctccaatcattctcttccaaacatatatatatatatatatatatatatatatatatatatatatatatatatatatatatatatatatatatatatatatatatatatatgtcgtaggctctccggaccttccattataattgagagatgaagtgaataattcaagtcatcaaacaagcataatgaaatatccgacgcctcgagagaggaatattggagatattgctaggcctttagcctgccagtcaacttcagcctgagacgtgcccgtcaaaccactcgaaggcggcgaccagatgtgttacacattcaggagacttgacaaaaatggctaaagttctacaacatctcaaatattcctaactcatactcatgtgaatctagttcccaggatgtgcactagattcacattttcatctcaagcatgattatacatagcaaacacaaataagatgaaagcgattataaactacatctactttagttacattggccgaccggccaaataaataatagaacagcggaaacttgtctacccaatccacaagcacaccgactaggggtttacccattatgttcaagtcctagaagaagcagtcgataacccgcatcactcaaagactaagtctaaatcctgcaagcaaaagttaattcaacagcaagagtcagtacattattagaaataatgtactggcaagcaccaagacaagcctaacaccctacttgcaaggtatataatcaaggaaggcatagtatggttctttttagcataaagcaagttttatttgcataaaacacattcaaaacggatttgctttcaaataaaatttcagcaagctagtacttagcatatgggcatcaaagtaggcattaatcatgtataaatattcacctcattgccatccatggcagcaaagagatcattctcaaatctcatcacaatttgaaggtaaatttcagcatttaggagaataaacacaagtctatactcaatacatatccacacgccgctcatgaccgcgagcacggctaatcgattagttttaactctgcagagtttgtacactttacccacatgatgcgaaataataatcatgcaagagcatggcacgcgatacataagtacccgatttattacccgcaacaaagcttttccaaaattcatgatttagccttacaccagcacgatacgtgttcctccatcctagtcatactggaaatatgacctagaaccgttaagtggcgggcccacgccttgaacttaacgccgtggtggcggacacaacgggaacccacccacgtggcacaataccgttgtattggacagacttagtcacctaaactaccacgtcggggtaaataggaagttcctctgagttatccgaactcatacacaccggcctaccagaatgtaaggctaaaccataaataatttactaagtttggactatcccatactagcacatgtggttgtactgtatacgaaatgaactgacattgagtgaagtccttaggtcggtttgggcgcactctccccctatcggtacacaactaatcaccatatgtgcaccacttgaggcccaaacctaaaatccatgctttccaccattttatttatcaaaatcacaagtattaaagttctgtccagattaattaaaaatcaattttcatgtttgaaatgagcccataatgacaaggaagaccattctaagcatggctatgctttatagtaacctagtgtcaccaaaactcatatataaagtggtatagccatattgttcctaaggttaggaatgaggaatatggatatatgtggagttaaggtgataatgcaaataataggagtttatctaacaagtttaacaaaattttaatttattagtgtacaatcgacatgcaagatttgcaaacattttcaataacctccaaaagataggttcaaagtgatcaaagagagggaggtgggacttgccttgcaactggaaaatgtcagcacctaaatcacttcttcaccgattaagcaatcatctatacaaagtacacgttatgcaattaaacaccgaaatatgcgaaaaatccaaaatgctctaaaatggatgatttgtgcacagtgaataggtaccggtctaaaattaatttaggtgaaagaatttctattttatctcattttatttgggagttatgaattttagaagtttcgtcggtatagtgtaggatttacttagttactattgtgaaatgctgttgtaaggtgattcttattaagtttatgtttgctggggtgaagatatttgttttctaagactaacaaatttggtttcataatttttagagttaatatgaattatttatgtattttacaagttttaacgtgttctaggcatatattccctatgtgtacatggctttggagatttaggtccagaacttgctctaacttgctagtgttgtataaaatgagtattttagttaactaatctaatcttagtttataaaattttagtgttcaaattactttacttcacattttataagctaggggatgttctatgttagaaacttaacatatcaatctggagattattatataagttaaggatactaagttttggtggaaggggatggatctatgccttcactggttcaacaagttttatttggatttatttggagctaccaagcatatatatactttttcatatgtattgtttaaccattactatgtgtttagtacctattctaccaaattaaggttcagagccatggtctgtaagagggtgctataattcactctactaggttgaagtatattacttgctggttctatagaaaatttggttcacttcatttagactatagatgaattttctacaaatgttactatttaaggtatgctccatgttgcttattccttacttaaatacttaggggttttcattatactgtaagtatgtctttttattttataacattgaagtgcacaaccctatgattctactgaatttgggtttactcaaaaaggatctaagatgaattttatataaacttctaaagttcagcttatgtaaaactagtcattttaaaggtaatagttttagaggcattcgatgtatagtatgtatactatttcattttgctttataggagaacataagttggtggatctgtagaaactgagtttgctccaaaatgagttgaaatgaattttgtatgcattttataaatttgtgcatgctttatgtgtgatttaacttggataaattttagaggctaaatttgtactgtgagtgcaagtttttattccataacactaaagttcacaatttggtgagttgacagaaatttgtatcatcttaaaatgagctatatttaattttatatggattttacaagttttaggtactttccttttataatttcagatttttgtttccaaggggtccactgtcagtgaatgatcaatatacaaaaagatccctgaggtttctaagaatcaacccgcagacctagcctcatatgtcagtgagttgaaaagttgcacattaaaccttatagttgtttaaattctcgaaacaaggtccctgacttcttttctcacgcacagaggcagaacagccatggctgagctcgatctcgagctcaccggcgacaaacgatggctcgtttgggggtgcaaccaaaatacaaaatgaagatcatgttattgcgattccattcttctacttttctcggtcagtggacatcggagtaacgccggcggcgagtccgaaaggaggatgttttcgggtggtgatgcatgtgcttctacaatcatgtattggttaattgggtgcatgcatgtatgttctataggctgaagggtgctcaccgagatggtagacatggctggggtagctaggtttatgacggtggctcgtgtaacggctcggcggcggcaagaacctctgggtgaacggcgatggctcaatcagctccaagaactatcatgcatgtgtgtccatgaggttagagaggccccagagatgctactgatgcatggaattgggttggtactcaccggagggggtggattcggcaacggcgacggtgaccggaggtggagaagacggtggacgatctccacactcgtagcaccatccttcgagattcttgaggggaaatggagaggaggtcgaggcgaagacgctggcgcgacagcttggcccggcttggtccagataagcgggaacggcgatgatgtcgctgcggcggtgcacagagcgcgctctagagcgaccatgacatggcggcgttcccgctgctgtagaagatgaaatggaatgggatcaaaaccaaagttgttcgtcatggtgagatgagaatggaacgagtatgagttagagatgaagagggctcgacaacggttggcgatgtccctcttcttggcggccggcgacgaaagagaggtggagagggagagctggagcttcctccctcggttggattggcactgggatggtgggtgaagaatggcgacgcagctgggtggaggtgaagcctcggttcggcgctgccacgtcgaggccacgcgtcgtacacagccggcgccaatctctctctctcggctgtctttggtccggctggaagatttgcacagggtgaggacgagccagagtggctgccaagtgggtccaggtcgtggcaaactaagctagggtgagagggttgggcagaaacgtgggtgaacaaaaggtttgaatgattttaaggattatttctctctcccactttagtatttcaattatttaatttgtgggtagaataatttagtgtggatttttctgaaggtagatgaagatacctagattccattttctttgattgcactcaaaaattatggatagattactcacagaaattagaggaatatgggttctttggaaactagttcgaatttttaggagacctaaacagagaagataaattctggaaaaattatttttattcatgataaattacctagtatttgaataaattattttacttatacacttttatgcagttaaatgcacttttagacaaagtatggttttagccgattaagaactacagttaatctagtttttattagtttgactaatttatttgaggtaccaaatttagttattaaattataccaaaattacagtgagttgtatgtgttgagtagagcctacatgaattttcccatgattttatcttgcatgaattattttagataattcgcaggacttatgtcttatatgtgtttccctttcctaaatgcatgaaaatgtttataaaagttatatttggactctcattaacatgaggtgatgttgatatgttagaattacagtttaccttacacatgtcataagctccttccctatttatgcataagtttactttagtattaaattaagagaatgcttatagagatgattaaaatagaatataccctatatgatataatttatttgttcactttcatgttcatgacatgtcttcagatggatatccaaattagttttgtgaggcttgacattagccatgttgattttttttaaggtgtatggtttctgtgtattattttccattagttagcactaggccctaatggtttagttgtttgtctagattgcaattatattcatgagacctattatgaaatgcaaatcgaaaatccaaatgcatatgaaggactcaagtcaaaatatgatttatgcaagtatgcatgctttcacttgggttgcatccaagtcctaggttaaaggtgaaaaagtttttaatttgttctcaaattttattcttgcaagagttggatcaactccacctaggtttaaaatagaaatttttggtttacaaaattgaagaacttccctttcaactagttttgatggaaattccttaatcctagaattcaggtacgttacaatatatatatatatatatatatatatatatatatatatatatatacacacacacacacacacacacacacacacacacacacacacacacacacacacacacacacattgaggaattatattgttaattcccctctcatttgagtgcattaaattccaccatattccacttccaaaaatattgcactcaaattagaaaatatctcttttggaaattagatccaaatataatttcctttcaaccttccctattcaaattatctccaaatatattttcctttcaaaatcttctattcaaattccttccaaatacaaattctcctctaaatcaaattattcagccccaggaaaaattagactttcttccttctacgtttgggccgaattctccttttcctccttttcctttcctcagtacaagtcggcccaattagcccagccggccccaccgcacagaagcagccgctccatccttctctgtggacgccaccgccgtgcgccatcggtgcgccgtcgcccacaatcctaccgccgccgccgctagcttgccgtcgacgctaagaaatcgtttccgacgtcatccgccacctcataccgtcgacgtcagtccctggaacgaatcaccgtcgtcgaccaatccagagacgaagcggcgccgtcttttcttcacgacagcgtcgccgtggccgagtcgacgaccgcctctacaaccgccttcggaaaccgcctctccgagacctataaatagccagcaacccctcccctttcctccacacaagccgagctcctcgagctctctctctcttagccatgtccggccattgccgcccccacccgatctccctttccgtagctccacaacccaaaccctcgcgccatcggccttgtctcggcgaggtgaatccgttttttccctttcccctctcctttagccaccattgccggccgaagagagctcttgttgtcgccgttccggcatcctccctctccctctctgccagctaccgccttccctggatatgcggtactcgggaacaccacccgacaccggcgtcgccgtcttccaactatcgaagagccggcgcccctcctccctctctcccctctgttacccggctggaaggaggagaaagaaagaaacgggaggaagaaggaaaagaaaaagaaaaagaaaggctgacaggtgggcccctgcacagtaactcttcgtattttctctatttaattcaaatcctaatctttagaagcccatatctcctaaaccgtagatccgattccagtcaaacttggacctaaattcatataaattcaaaatctatattttgataccaaatttgctattttaagattttatttgaatttccttaatttattcaaatactatttggataaatatttgattaaatcttataattgaatttacaacttaagtttatatttgcttttcaaatattttcttttattccaaattacccctttagccactaaaaagccgccagttggaactttacgccttccacagggacgttcgcggtttactatccccgacgtcggactgttggttgtaaagcccggcaaaaaccaaacctaaggtcgaagtgctgctcctggcaccccacgccttgatgcgtatagcggtcggagcttcactattccctcgacctccacagcacgccgcacagttagctctcgggctctgtgtgatcttagccgctccgccgccactcacggttgtcggagtaacactttcgccccaccaaacctacaccaacctcatattcctctagccgatatattgtcggtcgacaccggctagagaagacactaaatctagccgttatgctgccaactctagcaacgactagcaaacaaccaaaccctagccgataccttgctagtcaaatcccagttgtcatccaaattccataccctctacaatactacctatccaccatattctcagccacctactttctgtctaccagaacctacacataaaatatagagtctagccgatatgctacccaaaaatactaaaccctaggtatgatcctaccaaaacctaccatcagccgatactagctatataaccgttcaaccagttcaatcatccagtatacttcccatcctcctactaatcaaacccacacatgaaatataagcaacagtagttgcttaatcccctctagcctccaactctctagaacctccgcataaaatatcagcacagtaatccatataccctataaaagagatagactataccctaaaccctagccctcctaaccgtttatctctttcttgctattttatggattttattgaaattggttcttcatctttcttagtagagtctattttattttggatggcaacctgtggtatctcaaggatcgaataatcaggttgcctatctcggatttatttgtgttggagcaaggcaagttattattcctccccttgagcataattaccctatattctatatttctattctatgcattagccattcatgattttgaatgcataacctgaacatatagcaaaccagatatgctagcttttgcttagccctgcctagttagactgcataaaaatataatgaacttagattgggacagtacgtaagatttggttgatttccgggtggctagtactgtcccggtcgatataattgccaccaaatacttatgtcgaacgaacgagtacgaccgcagcttctagaatggggacagacctagatattatgttaattaacaatgtggtacctctgtacagtggttccttttgtaagtcctcgcgcaggaggcaatcttatgctgagcagggcatcttatgatatttaccgaggcgcaggtaaatatactgattttcgctcatgagctgtgtgtgtgattttatggaaacctggttgagatgacatggggtctctcatccagttctctctagaaaccccgggaacgccagaactcctcttgctgctgataacgttacgttcagagcgcatggggactagagttcatggaacatgtgccactattgttaataacctaatactgggccatgactaagctaatgaatattagcaagtcgtggactgcgggtaaagcatatatctactgcagtagaatattcatgaaactattcgaatagctgtgctcacggaattgagtaccgagactcatatggtatttggttagaaacttaattccagattttattaaatactgttgcatcaaacacattgcaggatttctccttctatattctctgctttctgcaagtaatcatagccctactcaaatactactaattcatacattcatattgaatataatagcttgctgagtacgttgtactcacccttgcttcaacccccacctttttcagagtccatttggagttcttatcgaagccgagagttcaatcacataagttagttccctttaaacctagtcttgaagtctagtattgttagatggtttaattctatagcaaaacggcagagttgagtcatcatatagcttctgctgtattagttagccacaagtttgtaaatacccatatattttgtaataacatctcctctggagtcttgatcaaacgtatgcaatgaagatccagattgttgaacctgtatcaatctactaatccagggcttgatacagtctaaacatgtcggttactgaatcattagttttgggacccgacatttttttactaactaacatcaaatattaaagggaaattttgctacaggacaccgtgacttcgcggttttagctataggacacttcacgaagtgacttttgggggaaaacactcccaaaagttagatatttgctgatggacatcgcacgtattaaagtaataatttccggttgaagaggagagagaaatctcgtgaaatgtcagaaatgcccttcggcccacatgtcagctctcctatctatcttctctctctatcccctccttcacttctctctctaatatcttctctctctatcccacttgtcagcgacagcggtgagcaggtgaggtccgacggcgggagggcgagggaagagcggacgtgaccaacggcgcacctagacagcagcaccgcccgaacagcaagcgagctgtgtatggaggagcggcggcgtggctggaccatgacggctacagtgcgcggagtaaggagggaagggctccgtcagcggccggtgccgctgtctgggcgcaccgctggccggagacgtcgccctcccgtcatcgcggccgctccacacttaccctcccgatgccaccgccacttaacctcacctgccgcccgtcatcgctgacatgtgggatagagaaagaagagatcaattagagagagaagtgaaggaggggatagagagaagagagataggagagctgacatgtgggcccaagggcgtttctgacattccacacgatttttctctcatcttcaatcggaatgcggtgtccaccagcaaatatccaactttaaagagtgttttcccccaaaagtcacttcgtgcaatgtggtacagtaaaactgcgaagtcatggtgttctgtagcaaaatttgtgatgggaccggccttaaaaaaattacgtccctgaagccacgcctacgcgtgcgcgtgcactgtggagtgaggagcttgacttctttttttgagtttctctcctatgtggacaaacttgctcctcgcttttgtgcgacgcactgctactgccctaaaatagccatgatgtccataggagtacttgattccggtatatgtatctacatggagtagcctgttcttttttccccaaaagctgctaaattacaatttatgtgggcgttcaactcaaaattgtgaaacgaaaatttctaacccacaattttttcttcataataatagcttctttcattattattgcgtgaaaattagtaaattatacatgctccaactttcttatgaacaaatacactccacacgtagaagtagctacgaatatattgtactccatcattctcaaaatataaaaactactctatccgtttcaaaatgtttgacaccgttaactttttagtacgtgtttgaccattcgtcttattcaaaaaatttaagtaattatttattcttttcatatcatttgattcattgttaaatatactttcatgtacacatatagttttacatattttatattttttttaatcagacgaacggtcaaacatgtgctaaaaagttaacagtgtcaaacattttaaaacggagggagtatatgttttagtttttatatttttttttgcgggggaaggagaataaattaatcacagtcctcgccaacaaaatgcgagataaaggtacaattttctcctagccaaaaactagagagggactcagctctagctttatttgctaaaaagtgactaataacattctgactacgctgaactttgcttatggcaatttgccgatccccagccattagtgatttagcctcctgagctatattagccagaactgagcgatctttgtctgggtgatttaagagctggatcacagaactgcaatcagtttccacttggattggaagaagagtccagtggagcgctaagtgaagaccttccacacacgcgtgcagttcggcttccaaggggccactgcaactatcaagagatctgcaggaactaaagatcacattacccaggcaatttctgagaatcattccaatacctcccttctcagaattaatgtcaaaggagccatccacatttagcttcatccacccattcctcggcctttcccaacgacggttttccgctccaggggtatgtttgattgctgtagttttcgggaaattaacactcaccacatatttacctttctccaagttcacctagggattttgtcggatcatgaacagagagtccacataactctctataaatcttttcgaaacctccattggtggggctggtttattgtgcataacttcgttcctcacaaaccagttccgccaaatgatcatgagaactagagctctctcatactctgaaagcttttctagacaatcaaagagccaaaaattaccgaactggattgatttgacgtccaaggagatactccctgatttgtgcatactcacccagagtgaatttgcatggacacaacggcacagtgcatgtcctgcatcttctttttctctgtcacaaatgccacaaacatcaaatctttccaagttcctcttcttcttgttctccatggttgctaggctgttagaagccaccctccaagcaaaaatcctgaccttttgtgggacattacatttccagattagttcccaagatttattaagtctgctcgaggacgagcttgagcaattattcatgtcggcgagctgcaaggccaacttgtaagcacttcgaacagaaaatctgccagttttgtccggatgccatgctataaaatcctcctccaagcgagcagaaatacagatcttctgaatgatgtctgcatctatttttagaaaatactgattgatcttggctgaatcccaagttccatcttctgcaattagatctgacacccatttcagtctacagtttgctttacttgataccggtcttcgtgacaaatctctcgggatccagggatcgcgccatattctgactgaattaccattcccaattctccagatgattccctttttcaataaatccaaaccatattcaatgccatgccaagtaggagaagcatttgcactaaaagttgtatcagtcagagaaccatgcggaaagtatttagccttgagcacttgggcacataggctgtttgggaattcgatcaatcgccaagcttgacgagttaacagggcctggttaaacaatttgtaatctctgaaccctaaacccccattgatttttgctttcgtcagggaatcccaggccctccaatgtgttctcctccggccattatctgcaccccaccaaaaattccttgtcatcttagtcagttcatcatagactgaatctgggaacttaaaaagccccatcacatagactggtatggcctggataacagccttgatcaagatttcttttcccccactagaaaggaaattttcaccccattgaattacccttttcgcgatttttgcttgcaaactctgaaacctccctttatgcattcttccctcaggtgtagggaagcctaggtatctgtcctcaaagttatccctctccacctgcagagtgtttcttatatcctcacttactgatgagggagaagcttcaccgaagaggatcgaacacttggcagggttaataagctgtccagttccttgagcataattggtcagaacctccttcaccacttctgcctccttcttttcagctttaaagaagagcagtgtgtcgtcagcaaacaataagtatgaaattcccggggcttggcgacaaatcttgagcggagttagggaattttgtgccactttttccttgagcaagagggacaagccatcggccacaaataaaaataggaatggcgacagaggttctccttgcctgagacctctagttggagcgaaagagcgaagtaaggttccattgaatttaaccgagtatctcaccgtggttacacacaacataatccaactaacccaacggtgagcgaaacccaacttgttcaaagccaactccaaaaatcgccagtctactctatcataggcctttgagagatccaacttatacgcacaagcagcactgttagctttcttgttcttttgaatcgagtggaaacattcaaacgctaatagggcattgtcagttatcattcgaccctgtatgaatgcgctttgctctttagaaaccagatcatcaagaattggtctcaacctgttaactagacacttagaaaccactttatacaccacgttacaaagacttatcggccgataatccttcaaatcaataggttggtctttttttgggataagaactatagctgtatcattcactcctttaggcattaacccagattggaaaaaattcctgactgccaggattatgtcactctttaaggtgccccaatttctctgataaaatctggctggaaagccatccggcctaggggatttaaggggtccaatttgaaatattgcttgagcaatttcttcctccttgaattcctgacagagcttctcattcatagcatctgtgactttctcctggaacaaccgggtgacactttctgggttaagactcggatcagccttataaactccctgaaaatactcagtagccatagtttccagcaccgatgtcgtactatgaatagcaccgttctcatctctcaacttagagatcttatttttcttagctctccaaactgcgcggctatgaaagaaacgagtgtttcggtctccttcctttagccaatttacccgagagcgttgaagccataacatttcctctctatacagcatttcattcatatggtcagttgcttggcggatagaagatctagcagcatttgacgctataagatcctccaactttttccttgccttttccaattcctttccaacatttttcacctttgttttactccaggatctcaaagcagacataactctaccgagggcaatattaatatcgccgaggtcagttttaacaccagcattaatccatgcttcctcaataacctgcacagactctggttccctttcccacacaatttcataatgaagacacttctgacggggtcgagtggtatccttcactatgaactctagcaagataggactgtgatctgaacagggggacacaagatgtgagacttgtgcttctggaaaaaggtctctccatttatcatcagccactgctctatccaacctgaccttcacatttctccatccatctcttctattgtcatatgtatgcggaacccctttgaagcctaaatcctgtaaatcacagtcatataaggcatcacgaaaattctgcatctgagtttcacaacgtgggttttttgagaagtgctcgaactgccaaagggtttcattaaaatctccaataaccatccaaggcagagcggatgactgtcgaattgtcctgagtagtgaccacatacgatgtctattctcaacccgaggttcgccatacacaaaggtgatatgccattgaggctcatcaggggataatcgcacatacgcatcaatatatcttttattaatatctttgacatcgactgaaacagactcatcccaatacaaagcaagaccaccactcttaccttcactactgacaccaacaaaacctctaaaggccaacttccttctaagacgactcatcttttccacactttgtctagtttcacataaaaagactaactgggaacctgccttttggattaaggcacgcaaatcttgaactgtcgccgtgttccccagaccgcgacagttccaggctagacaactcattgctcctggcgagacccattcttaggtcccgccagtttaccagcagccccggggctggttgcttccatatctttaccattagcattcatatccgctccctttttaaggcgcttcaacgctcttggtgtcacccctgacacggctcctgtattggtctgatcatactctaggatagcttgttttacagtccccaagcccttagcaacaggagccgtcaaagccttcctcttagtaggactaatacagtctgcactagagctttcttcaagggattcttggtgagaattcaaattgcggattgctgggatcatttccattgacggcagagaggcagactcctccacaggcccgactttgtgctcactcctcttcttcgaggaattctgctcagaaacagacagaagattagctttatccgctaactgtgcatcaaccgattcttccccttttccctctttggaatcaaacccatcaaatgcatcaactcttggtagagtatcttcgtggatattaactctctgcatctgaccagccgaagaagagcttgcgcttcctgcacctctgaaggacaacttcctctgaaccccataactctgaaaagctttcactttactcaccttcctctcaaaaggttttaaaggagaacagcgaagttcaacagaaaacatcaggggatcttcctcatttgcaagccttttttcacactccttatctgaatgcccaataaatccacagaagaaacaaaagtgtggtatcctctcatatctcagattaaatctccgaatttcctcagcccccttcaccttgattttgatagctaacatcctcttcagtggacgattgactgggagatccacacggattctgaaaaaatcatgtttattacagccgtcctcctgaacatccacctctcgaaccttgcctagtttactgccatagattacacctctttctttgttcatcataacaaggggaagatcgtagattctgacccaaataggcactgtttctaggggtaccatagaaggactcaccaacccgttaaagtctgcgactagcagtgcatcgcctctatgaagccacgaacgaacttgtgatctccttctgcactaaaggatactataaacagattatccttcaaagatttataactcatctctgctcgcaggcgccaagctcttcgcatatcctcaaacaatgctacctggttagggaacttaagggaatagaacctcgcaagaacagtccattgaccggccttcttcacttcatcctcttccaactcaatctccactgcatcatcatcttcaactgttatttcaccttgcatgaacgctgtcgggcgttggcttgatgaagtattctcatggtctcccccagtcagactcttatcccgcgctggattttgagtcttcagatcagaactttgttcctccaaattttcagattgaacaacctggatagccagatcctcatagttcctcatgttcttggacgtcgccatcgcagcaccgagtagcttcgggcgggtaactatcgcattgatagtccctttgtcgcccccaccaccagtagctgccatgggaagactcgcaaggactcggaggaagaaccctagattagaacctgatcgaggcgtgtgacgagatcgagaattttgtgtaattgcctcccttacttctgcaggtatatattgccacaggctaggaaaactaatcgtaacagatattttcctcaaaacatctaatccgaggatatcttgataaaccttcggacccaaggattcttgtttaccaagatcaaaccccgttatcccaaaccagaatatagcagatccaatcttcataccataattcataatggaccatgttggaaacctttgcagcaccgatcgtcgattcctcccatattggaaaacaaagaatccaaagggaaaggaaccaggaacaggtcggaaagtatgaataccttgataaggaaggaacgcagacgaaggctctgcagacgtcctgagtagatcggagtagaactccatccattttcttctcccattggagaaaatggctgccgcgcgccagtcgcccgggcgccgccaaaaccctaaccctaacttcatcagtttttatattttgatacggagttaccaatattatttcatcccttgcctagagccttgcagctaagcacgcttcagtatgtgcatcgacgccaccgagctctctcgccacctccaccaccatcctctccatcgccggcgccggcagccgaataggcacctcgacgccctcctcgccgtccccgctcctcctcccggcgacgtggaacgtcgccagcgtcgccgtcgccggcccgccgtacgccggcgcgccccacccgacgtccac

SEQ ID NO: 78112 - DNA, 1483 bp, Oryza sativa
atgtcaatcgacccccgacttcatccatctccatccgtgtacttttgtttatgaccagactgagccacaaattaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaagttataaaaccacctaatattgcctaattaatcagcgaagcatctacctaaattcatactagtggaaccatgaatagagtgtccactagttggggttttgtttattctagggtgaacaaggtaataataacagtagcaataataatgtcttaacaaaggtaaataggcatggctaaataaaacagtgataacgcgggaatttaaataaagcgatcatgcattaatttaaatcaaaataattttataaactgggattcaatatgctcaaggatgatgtgacttgccttgctcagagagaacggccttccgaaccttcggcaacgaccgcaaaccacgcttcgcgaacctccggaacgacgaaagctacgcggagcacacaagcaaagctacaagcctataaagaagcaataacaacacataaaaaagaaagcacacagttctttaggttataacaaacattaagagacttgaacgggtcgattcggagctcgtatgaccaagatatgatcatccgaagtttaatgctgttatatggagatttgcggattattataattaagctttgcaactataaaacatgtgtaagcgctagcctggaaaagacaggaaggctgcgccgttgacatgcggaccccacatgtcaacctaaaggaccgcggtagaccgggtacacaaagacggttctcgggtcgacggaagcagaccccgtgtgtcaaccgaggcgagtggccgacaaacggactccactaaacaccacacggcctgcacacgtggaaaccacgcggctaccgagcgggcacactaacacggacactacacggtcaccacccgcacgcgtgaacgactaccgacaccggtacacgggtaccggggccgagaaccgcacaacgagcacgggcgacaccgaaaggacgaggacggggcagcgagggagagggatccttaccaccacgcgacgaggcgcgggaacgacaacgacgaacgggcgcggcggagacagacgggcacaacggagacgaacggcgaggggacggcttcggcggcgatccttggacgaaggcgagacgcggccggcacgaggcttgacgacgcggagccgagaacgaagacgaggacggggctgcagcggctcgcttgacgaatgcggacgacggacgagaacggctcgacggagggacaaac

SEQ ID NO: 78113 - DNA, 2785 bp, Oryza sativa
cgaggccgagggagaagacggcgcggtcggactgtgctccggcgaggagggagaggcggctggaggcggccggcgcggaggaaagagaagggcgacggcgggaacgcgcctccggcggtcaccgcgcgaaacggagggcaagccggggtggaggaggtggcggcgacgctggaggaggcgacggcgctgtcggccggtgcacggtcgaggcggcacacgcggctggaggcggcccgcggcgtgggaaaaaaaagaaggctgccgggagatggctagggaccacggggaggctcgggagggggctaaaacgagagaacgggggatgaggatcccattttatatgagagaagagggagccggccacgggggaggtcggaacggcggcgggaatggcggccgacggccatggaaagcgaccggacttggcgcgtccgttcccggggattgaaggcacgaatcaagggggaatttgggggcaattgaagaggattcaatggggattaaaaccccccaattaattttggaattggccaattgaatcaagcggatttggaggagggagcgagctaggtttccgggagagagagagagaggtggccgggcggctggaggagggagacgacgcgcctgacgcgtgggccccacgcggtcgggcgcgcggtcagcgcgcggcaacggcgcgcacgcgcgcgcacgtgcgctggacgggcgggagggcgccgctcgggttgggccgggcggccggcccatgaagaaaagaaggggaggcggcttgggccgggcaggccgggggggggggagagacagccccggaaaaaaagggaagaaggagctgggcccaggggaaaggggcccaagagaagggagagaaggagaggaagagaaagaaagggaggaaagggagacttccgcccgtggcccgaggggagagaggaaggactttgggccagacttggcccaaaggaggaaggaggggtatttttaggtttttatttttaataaactttgttaattgtttttgttgcttaataattatttccggtgctctgaaaattcaagtaaaatttgagggctccttttagaccaaggcgaatttaacaaaaattctccgggccacatttgaatttttcttgtacgtattttagtgtttgccaatttctttccgaattttaattaattctattattccttttagcgaatgatttttaatttcgggacgaatttatcaggacgtgacatcagttcaatacactttcggcgcatcgcgacctttttctactttcattgtttcgacgagttcttgttctctagttgggctgcatcgttttcgatctccggcgagaggtaaaacttgttattgcggcttgcgttctcgggattagtgctcacatctttatgacactctaatcttgtttatgtgaatcgtcgagttatcataaatgcaatataatctagattgattttactatctggtcttgtcggctcgtctctatcatcgaaatcagccgatagaatcaggtaatatcattggtttagatcatatagtatatccaccatctcgaaaaagttttcattggcttgtttactagatcttatgtttctctctatgcttaatgctacatcaattaagtttgatctaataagtaatatttagaaccataatctctagcttgcttcatgattgctaatagagatagtatcggagtttcagccgatcttacctggtttagttatcttgttctttatttatttacttgacatgctaaatctgccatttatattaagatctcgctaagactaaacatattaagcttgatctcaatctacttgggtcttcctaatagtagaccgacacttgtttaatatatttaatctataatgatatcttagtataaagatgtattggagcaatagccgatacacactagatttacctatcagctatgcaatgaacataaataatctttcctttgaagtacttttaaacttaagtgatttatactgtctcggcagccatccgatctatcccaatcgcttggtttaaacacatttcgaagtatagattatatattgttattatctaaagccgataaagtaaatttagccctttgtttactatatatatcactgctgatccgaaatataccgcatcggcttgctctcagacgatatgtcatcagcaatccagatgatcggttatcgttgatggatttaagtttggtttctttgtttcttgttgattgcaggatcaaaccaactggcacgctctgaacccaaaagcaaatttaggacctgcactagagtaaagcaaatctctcaggccagtgcgtgttttttgcatcaacacgcttttggcacgcctagtgggacaacctttggtagttcttcatcatggttgataaaaaacatgatatcgatgatgaaaacatcatcccggtgatgctagataaactgacagaggagcagaaggcgactctggaacagatgatgaatcagttgcaaaatcagtatctacattcgttcacattgactcggcacggtacggtaatccaaagacacaaggtcacgttaccgttcgatgatgaaggggcaagctctcctaaggatataatgggtaaagatgagaaagctaaatgaagtactgaggagttccatactttgcaagatcgcattgattcagctatttatcacggattgatcaaccagtcgggagtgcttgtcaacaccttaaccaatatgataaagactgtggttgatggtacgatagctgagcaccaagttaagg

SEQ ID NO: 78114 - DNA, 1382 bp, Oryza sativa
tcagcatggggggcacaatatacctcatctttctctagaacaagttgctgcattgttcaagacaaagcagccagtggttgagccgattcagcaaattcctatagggcaaccatcatttattccacagcagcagtagatggggatgtcttaggctcctggtacttagttcatccctgaacaatccatccatttggcacatcaatctccccaacatcatatgggaggtaatgtaaacatccttattcaccttaggtacaatatcggccaagaggatcacctcaaccccaatacctgcctcaatacaatcagttacatcagatgcagcagcaattgggagggacacctcgacagcaaccttgggttgatatgatagccaatgtgatgagggaacaatttggtcttaagcccaaggacggtggtaatttgtattggcatccgtacccagagtactttgaaagggttccattgccaaaccgatacaaggttccagatttttcaaaattctcaggacaagacaatgtgtccacttatgagcatgttagccgattctccgttcagtgtggagaagcatcggctaatgatgcgttaaaagttaggttgtttcctttgattttgtctggatcaacatttacatggttttcatctttgccaaataattctatacaaagttggcaagatctagagaagcaatttcacaagtatttctcaagtggagtgcatgagatgaagttgtctgatttgacagcaatcaggcagaagccaaaggagtctgtcctagattatattcaatgatttagggatatgaggaatggatgctgtatcttggctttgacagattctcagttagccaatcttactttccaaggcttattgacaccaattaaagagatatttttagttcaagccttcgagagtatagctcatctagcccaaaaagtatcagcacataagcaaagattccatgaggctaggaaggcataagaaaagatcaataatgttgatcaatatgcttctgagtctgatgaagatgatcccgaagtagctgcaactgagtgggctaggaacaagaagattgttacttgtcaatgggttaggaattctggaagggaagtgaagtttgattttgacattactaaagctgataggatttttgatttgttgctttgagaaaaacatattcaacttcccgctggtcatgtaatcccatcggctaatgaattggggaagaggaaatattgcaagtggcataacacaggatctcatttcactaatgattgcatttcagacaacagatttaatcggctattgaacaaggaaggataaagtttgatgatccaaagaagccgatgaagattgatggtaatccgtttactgtcaacatg

SEQ ID NO: 78115 - DNA, 707 bp, Oryza sativa
gattaggataaaatacccaaccatttgctccgattcttgaggggaaagatagaggaggatgagaggataaaaacccttcaaaaatcgaaagaatcggggtcggattgggtgcggatttgagggcacaaggtggcgcggtagggcggctcgggctcggcttggccggcggctggagaagaaagatgggtccgacatgtgggtcccacatgtcggtgacccgaggagaagggggcgggcggcgtcggctgggccggcttgggccggttcgaccgcgcggggaagagaagagttgggccgaaatcggcccaacgacttaggggaggattttaaaaacttttccaattaaaataattcgtgaaatgatgtttcatttattaaaatacttcccttgctcaaacaattcctagaaaattctagaaaatagaggaacaagcaaagtatttaataaaattttatctagctcatttttatattgagatttaacaaattaaaattaggtcttatcttttaagcttttaaaattatttctaataattccttttaaacaacaatttataatttaaggattttaaacaagaaaagaacttaacaattataattagatcattattgatcaaataattactgaactgttctttgtatcatttaggaattgagctccgaaaaatccgagaaaattccagagagtataattaaccatggagaat

SEQ ID NO: 78116 - DNA, 9263 bp, Oryza sativa
tcaagacttttaaaattatttctaaaaattccaattaaacaacaatttataaattttgaattttcagggtgtgacattaagaccataaacaaagcactgccgggagatacccggattatctttgtaagttttctttccaataaaagcaagaaactgtgtttaagatagtgtacacattcgggtattcttggtcgctaaccatttcacgttgagattaagagcgagggtcatacgatgcctaagaacacgggagccacatcaaccgtacaccatggtgatccttggtaatgcgatacgctttataagaggccccagtatcacatacttggtttttgacgtctcatgacacaaaagaccaagtgtgggggagggaggtctacgagcttgcatgaagaattccatcaaccaagaccatcttggtttacagttggtgttagtcttaccttgctgaaaaaaggaaaaaaaagagaaaaaaaaaggagagacaacaaaaaaatgaaaaaaaaagatgggagaagaggaagagagcaagagagctgacgggctacatttagatcaaagaatgcattatgtgtgagtctttaaaaaatggctatacaccttgctggtagcgatcatgatgcctggctacacccagcctctctcttgagctcatgtgttgccttggcttagccttcatccactcctagctgtgcacaactcctcactcttgcatcacctactcgcacacaagcaagaggagatgcactcttcttttctaggtgttttctgctccactccagttggtacttgcatatttgctcaaaaagagatgcatcctacgtctctacaacattgtaccaacggagagaatttaacttccaatctcttcacccagcgaaataaataaaataagatgtgtgggcgtgccagtgtactaagtacacaaaataaaatagaagaaggaaaatgcattttattataattcttgaagaattacaaaaatacaaaaatccttggtcaaatgcgctccacagctcattgacgaggtggatctgacttggcgactgtgttctcatggttcccggggtctcggaaaacacccggttaattactctcgcgggttagaccgcgagacacctcaaattaagctacgctggtcgtcgtcgtcggtcttcgcttcacattctcccatgcatgattgtgatggtggtgatggtgtcgatgtgtgtgggcgctagtagcggttcacggcctcgtcggtccgtgcgccggtgtaggtgacatcgacttcatatagactccacttgtccgtgccatttagcctcatcagtcttaaaaagcgtatgtagttggcataggttttttggttgtaagcactaggaggctggtacaactcttcttgaccgtcttggtgccatgtcaatagtgggagaataattgggagagaacattgaccaatcgttttgctcgattatcgtcgcggtaggtctctggctcggtgtagaggtacatgttggtatggccttcagtcgaccaatcaccgtgacactcgggatagcgctgcttttctggtttctagcacaatggctgaagatcattgtggtacaggagtatgccttccgatcattgcactgcacactcaagattaagtgattttaggggatgttaggggcgtagcctagcccgggaacgatgagatacgttctaggaactgggtggccctcttgtatatgtgcctgacaatcggagccgaacccaaattttgttgggtcgcctccgatcgtagtggcttaactcgggagtgcaccgacgacggccacgacgaaatcatacgtcatgtgtatgggcgttgtggagtgagagacatcggtggggatgccgaactcgtgatcactagatggtgaggtgaggattcatgtgaggatgacgccagtggcagcgacaagttgaagaacttcgccggcagcagtcgagcagcagacggtggtgcatatgcatagatatatgtatatatatccaagaatttcgtcattggacagccggggtcgtcgagcgtgacgacagcgtgagacggacgcgaggtcattaccagcccgcggtgatgccaagaatgttcgtgaaaacagctagtggctccaaacttgcacgttggcgacgaatgcacgattggtaccggcaacgacgacaagaacgggcttgtcattggcggagaaacaatcagtgcgggcgatgatgaccagaaacaggttcgccatcggtgatagccgcaaggataaatgtatgccaatgatcgttgaagatgacgaggatacgtcctgtttgtggacgagatcgcatcaccggcatcgatgacaatcatgaagacgcctcggcggtgcgggtctgagagtatgatcggcgacggcaacgattcggcaatcatcgtcgatggcggtgtacatataaagattttgtcatcgagcggtcaagaccggcgagcatgacaccgtatttgtgggtatgaggatgatcccgacgtgccgaagcgaaagcgtcgtggaaggatggcacgacgacctcagccagctaaagcgaagggatcatggctggacttggcgacgatcgtgcaagcaccaagcaatggcgctccggcattcttctcaggtggctcgacaattataacatgaggaagatcatagcattggcgaggatgatttagtagacatcggcggcaacccgcagaggctacgatgagcgtgggggacagagggcgtcaccgattagtagtctttgtggggcatctctgcccagcaaggctgcatcatgacaggtgccggcacatatagtctgacaataccatcgcggcttgtggatgatatgttaacgacctccgggtatcggcaaccaaccccttggcaacctgagaatggccttctccggtgggcatcggatggtgatggggacaagcgttagttggcaacgcctcatcgtctatggatttgggcggcttagcggcgtccacgggacaacggcaactccaacgagatggctcaagacgcaaccagagctaatgacgcctttgtcagaaaaaaactcacgcgaactggctctcagtctctctaaaacacacactctgacgcttgtaggtgcagctacagctaactgaagaagttccgaaaatacagagtcgtacagaacaactgacgaacagagttggcgctgcgtaatacagtgcagctttttcggttttctcttctatttattcatctccacacagattttgttacatgtataatagaatcaaatcatgacaatctcggatcaactactgaccgcgccatcccacgatccgagccgagtcattgcagctaaagaaggaagcaaatatgctaaaacagaaaaatgctattctactggctagaattcagactccaacagaactctacatgcaacgaaacaaaagagaatataaatgctcaagattacaatccaacaattcaccccctaatcttgaagcatcagactggaactaatcccagcttgcctctcaactccaaaaatcgaatcttaccaagaggctttgttaaaatatctgcatgttgctcctctaaccttatgtattccacctccacccgtttctgatcaacacaatcccagatgaaataaaactttgtatcaatatgtttactgcgatcatgaagcacaggattcttcaagagacttatagcagacttgttatcaaccttgatcagtgcacaaccaggttcttggccttccaactcacctattggtcgagccagccacactccttgtacagcagcagttgcagcagctatatattcagcctcacacgaagatattgctaccaccttttgtttttgtgactgccaactgatcaaactgtctcccaatttaaatagaactccggttgtactctttctatcatcaatatccccagccatatcactgtcactatagccattcagctgaggaacctgttgttgcttctttctgaattccaccccgagattcagagtacctgccacatacctcaaaactacctgggtggcctgcgcaattgcgcggctagcacccaaacaaaatcatatattttttagtattattctacttaaaatttattaaatagctatctcattgtcttaagactttgaaagaccaaaccttatcatcctcgtgtttctaattatatagtttttaaaagttacaccagtatcatcctcgtgtttctaattatatagtttttaaaagtcacaccagttgctacctcctatgtcatctctttctttatttgcttactcgatctatcactatttctattcattctttctggaacctttaaaatttggattttatagttttagagtttattgtcatatagggtttcgtttttataatttccagatgtcccgtcaaacgttgcgattatactcctctacgacccgtccactgtctcttctctttattgtcattgagatttgtcacgtcccaaaacgaccctaaaatatatcctttaaattatgcctagaataattaaaatccgtgtgaaagcctccaaaaattaaaatgtgcaaagtaaaagtcaaacaaggcttagaggatttttgtatatttcctaaaagcctgaaatgtgtaaataaattttagtggaattttcggagcacaaaaaaataattaagaaataaataaagttaaaaaggttttataaaaaaagaaaaaccctaaaagtcccccttccctcctttgggccggctcggcccatctccctctcccccctctctctctctctcctctcccccgcagcccattcggcctccctccccgcgcgcgcaccgctgacaggcgggcccgcccgccaccctcactgacgggtggggcccacccatcatccccgtcctcccgccgttcctgccgccccgcccgcgccaagcgccaccgccgccgccaaatccgccacataccgtcgtccccgcgtgcaataaagtggggggaaatactccccatgattccctctccctttccccccatttttccctctctcgcgttcaaacgggcggatttgcccccgcaaatctcgccgccgccattgatggcggccgaacctcccgcgccggtttccttcctccccagccgctctctccccttccaaccctatttaaacccttcccgcacctcctccgttcgtttccgcctctcgccgcccttcctcctcgccggattcgagctcgcgacgtcgctctctctctccgccatcgccgccgagctccggtccgccgccgtcgtcgccccggaccgcctcccacctcggcgccgcctccttcggcttcgccgcatccttgccgacctcgtccacctctccgtttcggtcgccgaccgccggagcgctgccgtccccgtcgacccgagccttgccaccgcctccctccgctctggccgcctcctccgtcgccgccgtcgcctcggggtgagttgtggaccgtcgcctcctttcccccttccctcccctctctcggccgccgctccgccgagctgatggtctccgggcgagggaagccgcctcccgtcgaccgcgccggcatggccgccctcgggcgcgccgagtggctgccgcgtggggcccggctgtcagccgcccgcgcgctcgggtgcggctgacgtgtggggcccacggcgccggccggcgtgagccagggtgcacccggtccaccgtggaccgtgaggctgccgcgtgggccccactcccatggacccggtccgcgcaccccctccccctcggctgacgcaataaaccctttttaaattaaaatttaaataaagaaattcgcaaatattcatttaaatagcatataaacttcaaatggccataacttggccatttgaactcggaattggaccattcaagtctctaatttttccttaagaagtcaagaacccatttttgtgctttgtttctgcttgttatatggagtttattagagtaaaagccttttcttttctgttggtcgtgtagacgctgcagcttcggaagatccgctcttcgtggaggttgaagccgacgtttgggaaagggagcaaggaaagtcacatcatccttgaacatattgaatcccaatttataaaattattttgatttaaattattgcattatcgctttatttaaattcccgcgttatcattgttttatttagccatgcctatttacctttgttatgaccttattattattgctattgttattattaccttgttcaccctagaataaaccaaaccccaactagtggacactctactcatggtaccactagtatgaatttaggtagatgcttcgccgcttaattaggcaacattaggtggttttacaactctagactttgggaatattcatatcacctggacattatggaatggttcaattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtttgattataaacaaaagtacccggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggaggttccggccgtaggtagggttgggtcggtactcttgtctatggctaggatgggttggaaactatgtcatgtcttccgtctgtataccatggtggtatgtggcacgtggttacatgtgaggaagatgtgtcttgtgggtaaagatctacacctctgatcagagtataacctattcgaatagccgcgccctcggttatgggcaagccgagcaatgtaccaaagttagtgttttaattcttaaaaccttcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctagggacatatttacaaaatagctttgagcaactaagtgtcttttaatgctgtttactgcaaaccctaacccctatattatggctcccttgtactcccttccatttattctgcacttatgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtctttcgctgttttttgtttgtcttcttgtgtgctgggccttcgctgcccatgtaataaattaactatttacgcttccgcttgataaactctgaaatgtatcaacttttggtgtaccttgcctcctcggacaaggaataatacacgcacgtaaggaacgcccgttgggttatttccggtcgtgacaagattttaaaaatcaaacataattatcgtttgggttcatttttactttaagtcccgtcaaaccgtcagcggctttgctattgtactcttctacggctcgcccgctgcctcctttctttattgtcgttgagattttaaaatcgaacatgattatcattaggtttttttactttttggaagttccgatcctttaaaatttgaacgatgccactatgcccctctacagcccgtctgtcgcctactctttattgtcattgtgattctaaagatcgaacataactattgttgaaattcattttttattttctataactcttatacgcccgcccgctgcttctccttttatgtcattgaaattttaaaaatcgaatatgattatcaatggggtttatttttttactttctagaagtcccggcaaccgccttacttgtttgcttcacagcctgcctgacgtccctccttttaatcgtcattaggattctatttgttgttttattaacatttctaatttcagaacttatttttttaaaaaaattagttaataccgtattgtgttctttaaatgtttttattttttttatttttaatttcagttgtttcaaaattgtattcctacttaaactctcttttagtttttcaaattttagatattattttattttttatttgaaattttaattaatctcgtattgggttcttatacggactcttctttcaacattgcttatttttaattccgaatttcagctaattttaaattgaatttctacttgagctctccttttattttcttttgctaatttcggattttttttatttttattccgaattttaattaatctcgtattgggttcttatatggactcttcttttaatatttcttatttttaatttcgaatttcagctatttttaaattggacttctacttggactctcctttccttttctaattttagattttattttttttattttaaattttggttaatctcatattgggttcttatatggaaacttctttcaatatttcttatttttaattccgaatttcaggtatttttaaattagacttctacttggactctcctttttctttttttctttttcttcgattaatgtgggaatttctagcccccacagcgaacgtggtgcctcctttcaaggctgttttaataatataatagatagatatgtttcatggcagcccaatgttcagaggtcggtttctccataaacctgctaacataaccaaccgaataacttagatgaggtcttgtgttcaccaagtacctcaagctcccaattatgcttctgaattgagtttcctccatacattctcctccctcctttctcaacttcaaccgagcatccatgggagtctgacatggattacaatccctcatcccagctttgtcaagtatctttgctgcatatgcaccttgagacactgtgatcccttcctttgcatgtttcacctccatcccgagataataagagagcagaccgagatcactcattttaaaaagagcctgcatctgctccttaaacttgtttatttccatcagacttgctcctgtagtaatgagatcatccacatatacaccaaccacaagtcatgagttcttctctcctcgagtatacacagcacttttgacaccactcttgacaaaa

SEQ ID NO: 78117 - DNA, 693 bp, Oryza sativa
gggcccagccagcccagtgaaggtggagtactctgctcatccccacaagccacagttctccctccaaaaaccaaaaaaaaaaagttggaaaatactgcttccttctactaccccagcaatacctacagccctggaacattggccatgccaaaaagttaggctttctttccattcattcattcattcatcagctagcaaagcaaagcattttctcagctcaagttgcttgctcctcttctttctttcttcctcctccccttccctttcaggactcctccccccacatcagtagctttcactgcccaaaccctctttgtgggtggcaaccctagattattaatgtcctcctcctcatcatcaccatctcctcctcttcttcctcccctgcttctctctccagattctcttctcatctggtcccttccttcccctgctttgcttgctcaggtaaaacctctcccctccttgcaagattctcccctttcttggcatgctccaagatttttctttcctcctacatcgccggcaagatcgcttctgttaatgtttccgcgccatttttttttgtttgcagctagctgatcgcacgtgggtagggtgagtgtgtgtgcgtgtgtggatgggagtccacgcaatgtcgtgccacggcggcggcggcggtggcggcgaaggggcactgtcggggctgcagga

SEQ ID NO: 78118 - DNA, 14556 bp, Oryza sativa
cgacctgcaggcatgcaagcttattacattgtatagtggctacatattggttcttaacgaaatcagcatagcttatggtgtattggcccctgcctttgtgtgattatataactcaacaaattgtttgtcattttacttgcttagaaggtagagggttggagatatatcacttcttgtttccaataaattataagcgaatgttatttgacggaatcccatccccacaatattaacaaatattaacaggtggcatatagctcccaagtccccaccaccggtgccactatctgccgcaactcccaaagtccccatcaccatgctgtttagggtggaaaataacatctgagatctcgtttgtttagagatacatatatgtgcgggcgtgccagtgtacctaaatacacaatgtaaacaaaacatagggaacatgctctttattaatcttaaatgatcataaatacaaattcccaatgtaatatatatgtatgcgcgctccataatctgtcattggacagatctgacttgtgcgatatggtctcctgattcctggggcctcgagaagctcccagttaattacctccgtaggtctaggcctgcaagagaacctccgattaagctgcttgtggtcgtctcgtcgtctccgcttcacgttctccatgcatggttgtgatgatgatgtagatgtgtgtgtgtgtgtgtaagcgccggcagcgatccatggcctcgtcggtccgtgcgctggtgttggtcgcccaccctccgtcgtctagcctcgtcggtcttgaacaacgtgtcgacgtagattgttggtgaagacatgcatggagttgcatagcttgaacgacttgacgtcacagcagttgcgtcgagattagattagagaagaatcagggaggaattattgaagatggttgatatagacggcggccggatttaatcaaagctcggcatctcatttgggacaaataagaaaaaccaacaggacttcttcagcccacgcattggtttgtgcatggcactgtagcagcgatgacatgtcatcctccaattggttggccacgttgccacaataatttacttaatcaacatgcattagctagcttgttgccatccaacagcactggctcaccgtcctcccgtcgtccttcctctgtactgcagccatacttgcctccatcgtcatccgctggtttcgacgctatgcgtgatgcttgacctccggcatgagaactgatagaagtcttggcagtcggcggcagctccggcgatcctcggcgcgctccggcagggcggcttcccgacgacctcctccatggttagcccgctccagtgcggtgaagcttgcaaatcaaggatgtctggtatctcggcgaggtcgcagcttcgggtagatgcatcaccagcggcttgaattagcagcgtcgagtctagggacaagtagcactacgtcggcttgaacagacgccggcatcgatgaggcttctgtgacgcgtagatgaatcggccaccgcaagttccccggcgacgacgatacgcgcagatggatccctatgcatggatttgtgcgtgctgtagatgaaagaaaacgaaacaatcttgctagcttttacctggactagccatcaagctcctctcctgcgcttgctgatgatcggatcaccgcgcgtgccctctcctgccggacgccgggactccggccgaagtcgctcgccgccgccggtgcgtgtcgtcgatggatggatcgccgatgagagttgatggatggatgtgttgatgctggatgggtagatgcgttgatgatgggtggcttgtggatgctagatgcgttggtgaatgaatgtgtggatgagttcgtgaatgcccctagctgccgaggggtcgacgccttatataggggtctgaggtctgtgctcgccacgtccgcacgccgtttcctccgcgtcaagttcgttgtagataaggcttgatcgatcaatttgttatttgttcatatccttctttgattttatctcttagcttctcctagcgtcaaatatctgatttgtaattcgctttgtttctctactgctgggccacagtccggtgataagcgcctcgccagcgctcgcgcgaagtaactaactagatcaagtttgttatagagataaaatcaattggtttgttggttatctcttaattcatctggttttatctcttccgcatattaacttctgaaatcttggcgcgtaggcagctaccgtcttcggccatgggccgagcccatgattaatcactcggatatgcataggttgcttaatcacccaggcatgcacacacatacgaccgtctactgtagtacatgcatgcatgcacgtgattgcctcaccagccaatcttcacacggctagttattggttaattatacatgcacatatactaatccaagtatatatattcccagctgcctgtgcatgcatttatttgcgtgtatatacatggccgagcattgtgtagaaatgataagctagccaacttacaaactgcttgtttgctttgtccatcatgagtaagtcttgtgtacacatataatcgccaaaataccatcaaacacatgccccccaccaagtaaattttgatcgtggagcgagcgaaattaacttggtgtcgtgtcggctcatgcgatacatgtccggtagagtttagtcatgcgacgaaaggactcccatgttgaagcttatctccggccgtgcgttgaaagaaaaacaaagctagaccgtcatcggccaggactccaaatccttggcagttacgagtaatttggatgaagcctatatattgctggtcatgcctgtgcatcgattatgcaatatggcgcctcaggtgtttaactccatcgcaggtatatatccattgtcgattctttagccaccggaattaggatgcttcttgatcatcctgtactttttcatcaggcaaccatcttgagagggccagggaagacggagtatccagggttgcaggcgagcgtggcgccagcgaccggggcggcggagagcgtgtcccacgagacgggcggagaacgggggacaggcgagtaacatgagacaggcgctcggcaggagatagacacactgtcgaagataagcgcccgggaggatccggcggcaagcaacagaaggagaccaagggtgacgacccttcccagcatatcacgaagatcccggtccatagagatgatcgaggaggatacaaacgccacggcgagtcaatcgaattcctgcgtgactggcgtcataagaaggagagaactgctcgtcctaacagacttccattgccgaaatcttctaaaaagggtctgcgtattgaagattctccacaccccgagctggaccgcaccatgcgtgagaagcgaggaaaaaaccccgtagtttatgagagggtatcatccacggagtcttcaagcgatgatcgtcgccgccgccgccgctctgtggttcccgacacggagcttgatgctgtccagttgagtgactcctcctcctcttcttcttcttctgatggcactagcaaggtatccgtgtttccccaattctttttttttctcttaaaattctttgtcatagtggtttgataacctgtctcttagaacatacttgcaactcaggatactatagagcaggcaactgcattgggtggacttaaagctactgcctcttccgatgttgctccggtacctattgacgatgtaccttcagttgtgccggctgctaatgctcctgtccgctcttctccggtgatgccggcggctgatgccgcttcagctccgggatcctcgactcaaaagcatcaagaaggtaaggatgattagactcctaatagaggtcatattctcctttgctttctcttgatgtattttcttctttctttgctttttctgagaaaagtgtactatacccattgtagaaacttcaggcaatccatccgacacagcttgccagatgaacgagttgatggagaagacgtcccgttaccttgctgagttccggacgggcggtcgctatctccaacttaactctgtgagttcggcgaaacgtgtgctttctcatgagaaaatgatttcaaatgctattccaaattaacctaccaaaaccaaagtgtgaaaaatgattcaggtgtttcttcggaatatccctccaaaaaagggtttatatctttttgctgcttgtaaaaagagaactattttcaaaagtgagctttagagactataacaaaacccacctcaaatagttttactggaatttcgttatacagattacaaactaaaagatttctttcaagttttgttttcaaagttcttcaaaaacaaatcccttccaaagtaagctgtgatgagattcaattttagttacagtctaaagtttttcttgaggactggattgcagaaactgtgcttaaagcgtaccatccaaaaataaattatttcaaaagcttacgaaatcgttaaaccaattttctatgaaacattgctatttgaataaaacagatctcattctacatattagcaggggtgggcccactagtgattcaaggatattcagatgtatacccaagatttttggacaaaaaatacgtatatgtactctatacttcatatatgtattcaaaaaattaaagaagctttaaactactcatcttgggccttgtttcaccatttattctcggaataagttcaccagagatccccaacttaacaacgagattttttgaggtcccttaaccacaaaaccagaaatgtgtacccctaaactctctcaaaccgtttaccggaggtccctcggcagtatttttgcccagttttgctgacgtggcatcctagtcaacaaaaaaaatttaaaaagtacgtgggacccacaagtcagctctcttcttcagtgaggcggccgggcagatgagggcgtggcgacaggcggcggtgcgggcacagcggcgtgcggggaagaagcgggagaggggagaggaggcgggcgcggcgtcgggcggcatggagcgagcgcgccagcggtggcgggagagggggagagaggcggctgggacggcgggagtggcgggcagggcagcgggcgagagtggcagcggagcggcggcgctcgtcatgctccagctcttcaccaccggcgttgtcgtcgtgttggttgacctccacgagcgtggtaggcggagtagtggtgggcggagggcggcgagcgattacgatggagcggggggcttggtcggcgagcgggggggagggggggcgcaagtgtggcggcggagcagcggcaagcggtcgacggcgacctcttcgctgatgcggagcgccaccccttctcccgccggcctcatctccgcccttgaagacaaggttgataggctcctcgtcgtcgtcgccgtccccgggtgggagcggcggcgtggggggctcgtaatcgtcgtcgtcgggcagggcggcattggcgcccttcttggcttcttgccggagaggagagagagctggccgagcttcactcgcgagcttgtcggcggcaatggcgtccctccgcgcacgagagaagaaaggccaaaagcccgtgaacgcatgcatgcatgcagtagagagaaaaagaccaaagcaaaagcagcttgtgattgatttgcaggctacacgggttgaaagtgacaagatcgatcgatcgaatatatatgtatatattcatgaatgaatgcatactctaggcctcgcccacggcgacgacgatgggggagagccgatgacgacggcggccacggcaagcggctgctccgcccgcagcctccgctccgccgccgcgctccgctgcctccgctccgccgccggacggccgcgccgcgtagcctcgcccacagcgacgacgacggtggagagccgacgacgagggcggccacggcgcgcggctgctccgcccgcagcctccgctccgccgccgcgctccgctgcctccgctccgccgccggacggccgcgccgcgtcgcctcgcccacggcgacgacgacggtggagagccgacgacgagggcggccacggtgcgcggctgctccgcccgcagcctccgctccgccgccgcgctccgctgcctccgctccgccgccgaacggccgcgccgtgtagcctcgctcacggcaacgacgacggtggagagccgaagacgacggcggctacggcgcgcggctgctccgcccgcagcctgaaggaggagaggagagagaaaagaaaagaaaagagaagaggagagaaggagatgaaaagagaagaaaaaaaaaagatgtgcagctgacatgtgagtcccacgtatttttttaatttatttttgctgactaggatgccacatcagcaaaaccgggcaaaaatactgctgagagacgtctggtgaacggtttgagtgagtttaggggtaaacatttctggttttgtggttaagtaaccttaaaaaatctcgctgttaagttgagggacctctggtgaacttattcatttattctctattaggcccaaatttcccactcccctccccctttcatctcagcccgtactcagtttgggccgcaactcagcccatttttcctccccggctaacccaaatccccaaaccggccaaccctagacctagaggaatgagggggagaggggttggagcggggaggcgggcggcggtggccggcgattcgcggctttcacacggcgtgtggcggtggcgactgcggcgcggctcgtcggcgcgggcgtggcttggcgccagtgcggcaggaggcggcacgtcggcggcagctgcggcgtgcgcgtcggcggctggaggcggcgcgtcggcggctgcggcgtgcagttgccgacctgccgccgagatcagacaccgaccccgatcacgaccagaggtaggagcaggaccggtgggcgcgctagtccaccgaccactccttcagcatcaatgaccgcgaggagctccgtttcgtcctccttccccagctttcccacctcctctcttcctttctctcttgccaattgccaattggacataaggatctctcggtagagctaaacagaggaaacctgttgtgtggtgaaatggatctatgactgggaaggaaaacaaattgtcagggggaaattagtggccgattgacactggctaaaataataaatcttcggtttagacctcttggcatcactgtcacggtcacctgtgaattgcattcttatcttcatacttgcaatgaagattttaggagtgggaactactttctccgttccacaatgtaagttattctagcattttccacatttatattgatgttaatgaatctagtctgctagaatgacttacattgtgaaacggagggagtacaattcattgatttagtatacttgcttgcttgcttagtttgtagaattgtagttgcctagttaagtatctgagtagtggtctagtggacactgcacaatagttcatagtttataccatattatcatatttgtttaattttcataacttatgattaattttatgttatatacgctatatattataattattagtgtgttatactacacaagctattttttaggcttttaggcgtatgaacattttttttacctcttcccagtttgaatacacaagttcaaaaagctgggcccgccactacatattagctggtctacgttagaaaaggacgcactcacacgagacaaagatattggagaaggaatctcaaatgttcctagctatggactgctaacatatccccaacagatacattgcacacgaaataatattatgaagggataacatatctgacttttttcttgtattgtttagtcaaatgcatttatcctctcatgaacaataagctcagatatcttgctacctcgtcatcacctatttgtttcgacatttatttttttttttttttgatatagaggtacaatgatgagcatctaatctactgacgtggaagattttattttgtaagaaataggggtattttttgcttaatatatcttccatacatcagcccaatctgtacaatatagatttcaccaaaggtcagcactagatatatcaaacaaaagactcgtatctctacaaaattctcgtgtcagaaccaatagcaataaccagacataaaataggaataactcagagataagcagccatttcagctgacttaacacagtttttccgataccctctgctagtggaagctcatgcacaacttttgcaaaacctgttaggagatttgaacatctatactaatataaaaaaaaggagttgtacccctccaatcctactagccaaatcactcggattaatccctaccgtccatccgcgtgcacgaattcaccaccgcatatactaatataaaaaggaggggttgtacccctccaatcctactagccaaatcactcggattaatccctaccgtccatccgcgcgcacgaatttaccaccgcacgattccacacgcaaacttcgctcctcctccacacgcgaagacttcgctcctcctcctccacgcgtggacttcgcttctcctcctgcatgtagcgccgccgcatcctcgccgtcgccggagctcctccccgcgcgtactgccaccgcatcctcgccggagccgctgcccacgccgacatcttctgctgccgccgccagatccggcttcttccctaccgttgcggccggatccgacctcggccccatccgccgccgccgccgaggtcggcccctcccgtccctgccgccggagtacatccatgtttccctcctcgctgtcgtccacaggctccgccaatgcaatggcctctaccttccctcgaccaccgtcttctggacaaaaaacattctttaagacctgtcaatatgaaaagtacttgccattgatgttctcattttttacaaccaccaaactataacagacaatgagaacccagaaacgacttaacataattttctgttctctgcactacgtcactaatgtgcacacataattaaataaacaacttgaagcaacttgttggagtcccaattaataagtgcggaactcactaccgatttcatatatatgcagcatttccgatcccttccttgctcatggcaaatctcatatactactcattgctcatcattcttcctttcctactcctgattaatttctacaaagctatgttcagctcccgcaagcaagccggacggcttccaccgtgcccatggcagctccctatcatgggtagtatacaccatttgatcggtgatctcccacaccgctccttacatgatctatcacgacggtatgggcctgtcatgttactcaagtttggacaggtaccattcattattgtttcttccccggaggctgccaaggatatcatgaagactcatgacagcatatttgcgatgagaccgcaaagcgagataatgaagatcattacaaagagaggacaggggcttgtgttcgcgccctatgatgatcaatggaggcagctccgtaagatctgcatccgtgagctcttgtgtgccaagcgtgtccagtccttctgcgccatccgggaagaggaggctgcacgccttgtgaagtccatatcaagtgatcaagcacatctagtgaacctcagtaagaagcttgccgactatgctaccgacgcagctattcgcatcatcactggtactaggtttgagaatcaagaggttcgcgacaaattccagtactaccaagatgagggtgttcatcttgcggcaagcttctgcacagccaacctatgcccatctctccagcttggaaacactctgagccgaactgctcgcaaagcagagatatatcgggaggggatgtttgcattcataggtgggattattgatgaacaccaggagaggagagcacaagatatgtatcataaggaagacttgatagatgtactcctaaggatccagcaggaaggctctcttgagtccccagttagcatggaaacaatcaagttcttaatttttgtaagatttttgccattagctacagcaaaactacatgagttttctcctcatttttctaacctaatgttttttttccaaattcaattttaggatattttggctgggggaagtgagacagtgacaacagtattacagtgggctatgacagaactaatgaggaatccaacagtgatgtccaaggcgcaagacgaagttagggaggttttcaagtggaaaaagatggtaagtaatgatgatataaataaactcacttacctgcagtttgttattaaggagactgtacggttacataccccggggccacttttcatgagggagtgccaggagcaatgtcaagtgatgggctatgacgtgccaaagggtacaaaatttctactaaatctgtggtcgatctcaagagatccgaaatattgggatgatccagaaacattcaaacctgagagattcgagaatgatgcaagagatttcaaaggaaatgactttgaattcattccatttggtgctgggagaaggatgtgccctggtatgttgtttgggctcgccaatattgagctggctcttgcaaaccttttattttattttgactggagtcttcccgacggagttctacccagtgaattggacatgacagaaaactttggagttactgtccggaagaaggaagatctcttgttgcatgcttctctatatgcacaactttcttgctgattatttccatggtgaataattcaatggttgtaattttaatgatttattattttgtcagtatcctcattgtttgaggctttgatgttgtggttttctttagcagaatatacatctgctgcatatagtatgtttaaaaactaatatctgcaacagttcccatccgtccaaaatataagcatctttagtttagtttttttatggagattaaagtgaagtgaaaaaattacaatacatttaattaaaatacacacatatcattattataaagcccatctataacaggtcaaaagataaggacaagatttccttatagcctccacaaggagtatattcgactcggagaaacattcttaattaaaatggtcagtgtgttaggataaggacaagatctctttgtttgaagattgcactttgcaacagccgacacaccttgtggagtatttttcagatctttctcccagtcatttgtgatgttcatatgatgactttagactgaaattagagtgcccagatggtattattgaagcccctcaatgagaagtgataaaggaatggaaatgcgtttttgtttataatacttgacttgcagcaaccatggacgactgcagctcccataatgtgtttttattaaaatatttgatttgacttgcagcaaacattcacaaaactgcagtttaattgactgcaaaagaggcaaacctaaaccaagtgggagtccatctagttaatttggactacttaggtgaagtccttcatgtttgccgcaaattttatgggtagcctgttaatgtgtacatggacaggataaacttcctgtttttctaccatgtgacccatttgtacaaaacaagcattatgatggttttcataggactcattcattactaaagtacatgcatgcgccatgtcctcagggtatcgcaagtagagtggaaaattcaccacaaaaaatgattttcgatcacagttgattgggagtagatttatctcgtttttagcgcgcaagcttcccgaactactaaacggtacgttgtttgtaaaaattttctatatggaagttgttttaaaaatcatatatattatccaccttttacatttgaaataattaatactcaactaatcatgagctaatgtctcagctcattttgcgtagcttctgatcaatcttcttgttttcccttctctcaaacaatctattaaaactatacaggtggtttatgaggaacccatgcagtacgccaggtgccgtgtcaccgtttgcatgtgaaaatagccctactttcatcatctcgggtgactgcatccaaaaatattttggaagctgagaagcataagtcaactgcctagaaaatattttgaaaggttcttgtgttaagtcaagtctgtcgcatgtgccaacgatttccacgagcaatcgaattatgtttcgaccggcggcacattcccatccatagaaatacatcttccttttgttagatccagtcgcccaaagtgcccatgcaaatacattttagaagtctctagaaactgttggacaaaagtctattttacacacccaaactattttattggatcgcttaatccttcaaactattctcttgctcattttaacctgtaaagtattaaaatagttcactttagtcatttattctttgtttctgtttgtatgcttgtatttaacttgattttttttaagaatattactgaaaccattatcaaatttataagatattttaaatttttttatgactatttgctcgaaattataaacctcagtatttaaatcagtcatagtgcttttcgacttatgtaaatagtgattgaaaaattctaataaacattaataggtatgttgtaatgcatctatctatcctaccaaattttggtgcaaaatactatttagagagaataaattaagagaaatatgctggcggtaaggtgaaccctttttaataattggaggtgtacaatgcttaaacaatcatgtgtgttccagcaaaattattccgggagtacaatgaaatttttttctaacctttcgatgtgatgatttggttgtatgcaaactcatacattgaaacttacaaacaaaactcaattattgcttgcgtagtgtgtttctccatatttttttctatacctgctctgcttctacaggtagcttacaagatggaaacagggggtcctagctaattagattggatggagtacacgcatgctcacatgctattttatacagatgttgttttcccagactgcacactggagttatttatacatgtgatgaagtctttatttatcatgattcataactacgattgttaattaggcattagaatacaaaatttctacgtcgtcgtaatggaatatgctgtttgtcaagttgttgagacgtcttatttcgtacaaatagctcgatagtaagcaggttgttactggctttaatatcctaatgttgcaaaacaaaaaaaacagagtacacacaaacatcacgagtgtttcactaacctcatcaattgtacatgtacgctaaataaattggccgtctatttcacatgttaatttaataacaatttcatatttcacggacttctgttgttattcagtcacgtaaataaattggccgtctatttcacatctgattaagactttgggttgaaattgttacgcaagcaattcgatcaatatcatatactggaaccatatgtcaccggttcaaactatgacgggcgcgcaaataaatgctagtagcatcttgcgagcacacattgatccttattttatttttatcacaagtttaattaattagtagcgggcattagttagaagagtgattgatgcccaggttgaatatattggctctcagtactctactctaaacaactattttaactcaacataaaaaaaaaaaactacatccacggatagaatgataccttccacacgctagctaggtattcgcgttagtcaattggccggtagaaaattcattattccataacgataagctgacactagtgagaaaattattatcttaaatatcactaatagtagcctaattaaggctattaatacataggctaacgactactttctcgagtatatgcacgagtatcaattatcaaactttacaaaagagtaaaatgaatggtatacacattctcaaacttggacctatgtgtcatctacgtcaacttgtaaaataccactactacagaaacccagattggtgccggttggaaacaagccataggtaccgaatttcccaacaggcaccccgcagacggtacgatgaccaaagtcatcggtgccggtttagaaccgacacctataacaaatataggtgccgattgtggggtttcaaaccggcacctaagatgttttcacgagccaaaaaaaccggctcaatgcatcggcttgattcgagccaatgcatcgagcaacttccaatcacccaaatccgagaaaacatccatcaacattcctgtaccaagattccataacacatttctcacgatctcaccgtccatccaacaacaacaaagacgggcagtggtgtataatttaataaaaacaacaccacatttcttgccgcatccaacaacacattaaacaacaacaacaaaatcaaaaaccaacaaggaacactgttgtggaggcagccactgcatctttgtggaagcctccggccacgcccggcctccaccacagccaacgtcccctgtgcccagcctcctcgaccaccacccccggatctggcctcccccaagcgccagtggggaggggcgatgccggatttggccgtccctgagcgccggtggcgatggggcatgccgga

SEQ ID NO: 78119 - DNA, 3327 bp, Oryza sativa
tccctgccggcgtccggcaccgcctcgtactccgggtggcgtggcgcggcgacgtcgcgcggcagaggcggccggcgcgcggagaggagctccctcgcccacaccggcttcaccgtcggcgcgccgggcaccccgcgcgcgaactcccccaccgccgtcatgaactgcgcgacgccggcggcgtcggcgaggcagtggcagatctggagcccccacacgaagccgccgcaccgcatgcgcgtgacctggaagtagagcagcggccgccccacgacgccgctgtcggcgtacgcgccgtcggcggcgcacaggagctcctcgtggcgcggcacgggcgggccggtcacctccccgagctcatccatcgccaccccggactccgccgcgacgaacaccgcgccctcgccggtgcactcgacgagcagcttcctcccggggctcgcctccacgatgcggccggcgagcgggtagtagtggacgagcgcctccgcgagcgcggcgcggagcacggcggcggggtcgacgccgtccatggcggcgcgccgccggtacaggaagaggcccgagcggtagaaccggaggccctcctggtcgtcgatgtccgacagcggcttgaactcgtgcggcgtcgccctcgccggcgccaccagctccgccgcgccgcggcgcaccgacgacatcgtcctcgccatgttcacactagctggacaatctcttcgtgagctcttctgctgcttgctttgcttgcattgtgattggcgatgtgagcaatatatatacgcgtgcatgggcgttgtggtggtaggtatagactaacctatggaattcctgaccgtcatcgttttatttatgattgtattatgctttccttcgtcttataaggatttttagctgcacaactagatgtttggattcatggttgaaagctgttatattttagaccggaggtaataagccataacagcttataaaaaagtatttgcatgtaatgttttgtgagggctgctataaaacgggatcccgttgtaacgggatagacatattaactattcttttgcacaagtatcatatgtatcaggtcctaggtatcatatataataggtaatatgtatcataggtatcgggtaccatgtagctggtaccaacgagatagacatattaactattcttttgcacaagtatcacaagtatcaagttctaggtatcatatatactaggtaatatgtatcacaggtatcgggtaccatgtagctggtaccacaacagttatcacttatcaggtatcaggtactgtctcatagaaggatatcccattccaacgggataccgttgtctaggttttttgattttttatatatatttgttttaattaatttaaaattaaatgctgaaaaataaactacgacaaaaaacctataattaactacaaaatcaaattttaatattcaaattttagatgcttcttataattaagtagaagggtaaatgatggaaataatatgccttggccacctagcccctaggggcatcgatgattatccttcgaaatggtccaccaaatgtttgcaaccaatgcatcaatatgtttgattatttgatttcatatagtagtttaacccttttaaggaaaactatagatttttcgaaaaaatactgtaaaactaaatatttgaatgccaatttaattaatctcaaaactgtatacttataactctagcaaaacagtactgacatggacatctaaactttaacattcatagttttgtcgtaaatttattattaaaactgtaatttattaatctgcaatacatcgtcttaataatgtatttttatataagtttagtactaaaaccgttgttatgcgacatgtcactcaaaatctctgtacgaattttgcaatggcttggttaaagtttttatagttttgcaaaatttactcttaaagaaaaaacagccagtcatacacgctagctttgatcttactctcacctacgaaattctaacacacatgccatatactttgatcttaattaatcttcaacgttgtcacacactatacatccatcaacggccggtcagctgatgcatcctggtcaatcaatcaaaccaggaatgtgttgagcaaatgatgatcaaatcataaattaagtgatccagcatgcactactgtatagctagacgactcttcttcttaattccatcatcttttgaatttggatgaaatactcttccatctgttgaccactacaccggattttagcgtaaaaagcgatagtggcatagtgcgaattcctcaagattcgacgacgttgagatttcatgcgtgcgacgagctatagccacagcccacgatcgacgacctcttcttcgtggacagcgccggtcagctcgatcgatcagcgccgccgccttgccggaatttaattattgtgcaccggggccggaatccaatatacttatatatacttatatatagttcatcctctgtagataatactatttctctcttctctcattgagccacatcaccctgattatttctataacatttagatgatatatctatggtctaaattgtctcttctttcttctatcataaaaacatacaatcttaattatttttaggctcaaaatgatatcaaattattttagttttaataataaaattacattttatatgtacacattatttaacttaatttttcacagcaacacggcagagtattcatctagtttagtttaattattgtgcatgccggcgtataggaaacggcggtagtgggtggcagatgatcttaccggtcaccactgatttgggtgttggttggcaccattaattaattaattagctttaaggagtagcacaagattaattaattaagttttgattattacaaacttgaaaaatggattaatcttatactattttagagcactttcgtatagaaagttttcgcatgaaacgtaccatctagtagtttgaaaagcgtgtcacgagtatccaaaattttatttgttggagaaacgaacgcagcctgaataatcttccatggaaagataaaactacaggaaagataaaactacactaagatcgtatttgagaagcttaaaattctgaaaattagttgattgatatgtaggatatgtctggggtgtttaagattcttataagcatatggttggcatctagcttcaactgagtttatttttgagagaatcccttgtatgtcactgaaaattggtctgatcctttatatgccattgaaaattggttcttcccttatatgccattgatccaaatttgcacaccctctcatgccactcccg

SEQ ID NO: 78120 - DNA, 1136 bp, Oryza sativa
cttgcttgttaataatgtgatatggccgggatatccgaagtgaaaattattttttctcgatcgacacgatgtcatagaggtataggttcaaagtgaaacttatttttgttctaagcgatgtggaagtatatattcaataatcacaaagtgtaacttttctaaaattaattaattaatttgtatgtttcattttacaatgtgttttgatttttttataaataaaaattttaaagtttgatgaagtttttcgaaaaaacgtactaatcctttttaatacaactagtagtatgcacgtacgtactttgcaacagaccatgcccatataagtggataggtagattgaggataaagcactggaagcatggaccatacccatataatcggatgcgtggattgaggataaagaactggaaatacggccaatcatgcataattggggattggattgaagataaagagtggatcctgcaagggtaactccacttttaaagtagtagagaaataaatatactatcaaaatataattaacttggatttagtaaaactaatttggtattgtaagtgtttttacgctttctctatatatttaatcaaacatcgttttttaatataaaatggaggcatatcaattaacatatacttagtgattatagctagggaaggggtaaagctgcttgaacatgcattgtgtcgataattggggtgcaacctaggaatatatagccgtcggacatccatagccgactaggctattgaccttaagtacagaagatcgagagcaactttcagtcaaatcaagtcacgcacggcacgattaacaattatatgtgcatgcacgtgacttagaccacatcttttcattgattcaataatacaattaacagtggacacttttagaatctctatctagctaatctctaccccctctctcaataaaaactttacaacttgcatgaacaataatcgtatcgtttcaatctcaacaaaatagtatgcatatattaacagtggccttaaaccaagagtcaatcaacaatctacaataccccctagagtcaaatttgtttgaaattctttacacgtctattttttttatagaggattaactatttcctcacatataaacttaagtttcg

SEQ ID NO: 78121 - DNA, 1087 bp, Oryza sativa
ctctcattttctttttttttcttttctttttctctgattaattgtggaatttctagcacccacagtgaacgtggtgcctcctttcaaagctgttttaataatataatagatattagttatttataaattgtattcctaattgaaatctttttttttctttttctaattttagatttttttaaaaaaatagttaatactgtattatgttattttaatgtttttattttcaatttcggttgtttcaaaatcgtattcctacttgaactctcttttcatttttctaattttggatattattttattttttattcaaaattttaagtaatcccgtattgggttcttatatggattcttctttcagtattgctttttttaatttagaattttagctatttttaaattttattcctacttgaactcttcttttattttcttttgctaatttcggatttatttttatttttattctgaattttaattaatctcgtattgggttcttatatggatacttctttcaatattccttattttaattccgaatttcagctatttttaaattgtattctaacttggactctccttttcgtttctaattttggattttattttatttttattttgaattttgattaatctcgtattgggttcttatatggaaacttctttcaatattgcttatttttaattccgaatttcagctatttttaaattggacttctacttggactctcctttttctttttttttctttttcttggattaatgtgggaattctagcccccacggcaaacgtggtgtcttctttcaaagctcttttaataatataatagattgtgaaaactacatcgtaactacctactgtataatataacttgcatcgcatgtactctgatctccgtttattggtatttatcgctttgactttttctattaagttttttcaggtttaatcaagtttatagaaaatgttagcaacatgtataattccaaattagtttatttcatctaacattgaatatattttaataatatatttgttttggtttcactactcaccttgacattttgccctttccgaccgctacct

SEQ ID NO: 78122 - DNA, 1066 bp, Oryza sativa
gtccggtattgacagttcgagggtgtattatatcgggttttgtagttcgggggtgtattttagataagcacaagagttcgagggtgtaaaatggactttcccctcttttttttttctccatcggtaatctgcaccagtgacggatactagcgtgtgagctgaattttgtttatcccatcatatgcatatatgatactaggttgtaattataacccaccttagacaagtgtcctcgatggcaagctaaaataccatcccatcacaggtgaacagcctcattgtcgggtgtttgttactactcatcacaaatatttacctccactgacgggccttcatccattaaagatgaggtagagtcattactaatcagtcatctctgacgagagccttacctgtcacaattgacggtttgggccatcagtgctgatttggcgcagtgacctataaatgtgtgtgagggaaaacaaatctcataaaaaatatcatgatttcaatatcctaaatacagacaaatttcttttttaaaaattttagaaaacaataccacaaatctctatttaagttgaaagaactgactctagttgctatttcattttcgagcagtttttatagcagttgacttaggccaagtgtgccaaagttgtcacggccctcttacatcttggaccactaactgctactcctatgatctatagctgtttgactacttaaaaatgacggattaaacggctgcatggatggaaaaagaaaaagaaagagaagaacaaaaggattcatcaatcatcattcgttagacaactccattattttgccctggcataaataagaatgttatcctaattatgccttgtcggtcagtactcaatagaacatgcaagctccctcttatcacctatggaaatacttattttgattcatctatttgtttgtgaaagcctatagaaaataaggtagttgtaggtatgacctacttacagtgagctcactcattgtccaatggcaacaggaggcagttgctacactgacatataatggtggctacgttggaaacgtgtcagtgtgccat

SEQ ID NO: 78123 - DNA, 12170 bp, Oryza sativa
aggtggtgggacgaagaggaggagggacggtgccggtggccttcccacgcctctgccgcctccgccgggccgttgcccggcagccgccgaggtccgccgcctcccctctggctacatcaggcagacgggagggcgctatcaccgctgctgccgcctccaccgggccactgccaccgccactctgccggccgccgcctagaccggtgagagagaacgagcgagatagagaggcgagagagagacggaaagaacgagagagagagacggagaggataaggacggatctgatgcgcgcgttgtattgtaaggccggcgctcgatcggctcggcttggtagagatgcaggttctagggtgggccccgtgccaactagtccgatgggatgggttctaaaagatgccagttttttttttacaaccggcctctatatctgacaggagtaaaaggtgctggtaccttttaggtgacaaaggtgccagttcttgctcgttttggcgtgtgggcgggctggtgggcgggaatggcactgtaggggctggtttttaccactttcagtacctatagttccgacttatattagtgtttctgtagtagtgtacatatatgggactaatcttgatttaatgtatcacgtaaggtccaaaatgcaattgacagctcaatgctaatttggccatccacaatggaataaaatcgcattcagcggcgccctctgctatagcatgaccaagatcagctcagtccgctagtgtgcttgttcaagaggagacaaagaaaccgcgtttacagcggtggatctcgtcggtgatatgatgtcctcggagcaaggatggatgacctgatagcacgagggtgataccacacgttgtatcgcccatctcagctccaagtagctcacaggttgcagtgatttgagtagcactctaaggtcctgtgttcaaatctccatagaagcaaattttagattgggttatttatgggctaaattccctatttgctagttcctagtttaataaggctgcatatatccggttggatatagagccggtaaaagaaatacccatctaaaaaaagagattttctaaggtgcttgggatataggagagccgttgatttcttataatctaaaaaaaatatcggctccaagtaccttcttttgttgtcctccgggtaccccctttgccccctctttcacgagcgtgatgggagtcgatctggaggcataatgtagtggaggggcttaaatacaaaattctcatcaacgtagatggccacatcaccgtcagagctacatcatctacatttgaaatcttgggtgataaaccaagattaattatctatatgtgtagttcacaaattcaaaaacctagatgacaccctaatctaaatttatgtcctgctcatgtattttactcataatagaaaaagtcccagggttttgcaacccgattgcataaaaattttgagctccaccgagatgaacgaatttcgaaaaatttggacaaagttgatcaaatagtaaccatatgaaccaaatccagacgaaatgggagttaaatgttgtctcggagctcaccgtagttgatgaaattctctgaatttccactattaggaatactatttttagtgacataaatggtcttcgcaggcgaacggccggtctgcctttacacaaagacctgtgaaatcttccatttttgcaggcggccggccggtccatctaggaagatgaatcttcgcaggcggacaacctaagctgtccgcctacgaaaatatttcttgccatgctgacagagtcagaacatatcacctacgaaaatatgattacgctgcttgcaaaaatacgtagttcgggtttcatttgagtaggatggccgccggagaaaatattcgagccaaaatataaattttcatgtcaaatttattaatattaatttttaatcaataatgatgcaattaattaattcatcaatacataaatacatccaacagctaacaaggatataatacacatatgtttgatgcactaattacagtactattggccatcatgtgttggccatacaataatatttacaatactatcatttctaactatattgttaattacacaagcacgtagttccacttccaaatggatttgtattctccgttcatcgctaagctaccttcggggtcgaagaaaaatccatctttatgacaacactcacggtagatgaagtggtagaggtcccactgtatgtttctaatgccttcgtagtgaaagctagttcgacgttcgattgtagacaactgcatacatgaaagcacgagaatataatacaatatcaatttgatatgcgcattccactattagagttatacgttcagtcaagagacttacatcctctttattggtcctatacctcccattaaccctatgaaattcgcatatgtactatccgtaaaggacactgcctttaggttgcttgtaatacttcattataacacacatatagaaggaattagttatacattgcaggaaaaagaatttaaatagagaagtgtgcagagtagtaccggccaatatatatgtatgcacttgcaacttctcactcgtttgcggttgttccctgcactttactttgtagtagttgtacgcactgtacgtataggatttatgattcatattaatgaacagaatgtaataattatgaacattgcattagtacacatgcatagatcagaatcacttacattcttaggaattgttctgtacgtcatatgatcataatcgagggggtgaataactgtaatggtcacataccgttaggtgtcacctagaaagaattatcttcggaggcagaactcttaagtggttcacctggaaatatcctcaatctttcccctgctggacctcttaaagctccgtctataaagatgtatctttccaggtggcaccttatatcgtctgtctaggaagattaatcttcgcagacggacggccatctcaccccacattttcttcacctgggaaaactgtaacacctcgtcggcaatagttttgccagtagtatccagagttcagacatttcaaagcgaatcccaaatccctattctgtaccatactttggagtaggtgtgttggcgttttgcagatatcgatggtaccattgattaatttaactaacgacctgtttgtagcataatttggctaatagtttgttttatttgggtaagccagattatttagtttagctgtcatgatttggagtggttggtttgagagccaattaattgtgtgcgcggctggctagggagggttagcatttatcatggaatggaaatattatggattagctgagcttaaccatagtcaaggaaggtttttgcgttaataagtactatttgcattagcatgcagatagagatcagagaggtgaagactcgtgcagctggttgcaagtggagattaatttgctatagtcgacaagcttctggccgggctgatgatcacatacatgcaggcgagcagaaatttgccgtgctctcgcttggctgttttgtgcggctgcgtatttgcacgaaggttggagcagtggcgttggtttggagatgatgaggcgtgattagcgcgtacggctgttaggaagataagagatagatagattttctattttatcagttagtttccttttcggttggaccatggtatctgtatatatacaggtctacggtcgattgaagaaaccccgatcacaatttatcaatctactatttttctcgttctttacttttcctgttttttctattttgcttttatggctgagttctagcaaccctagaatttggtttatctttgccgttttgcgttgaaaaacggtcgtgcttctccacgaaagcgaggaggttatcctttgctagtttgctcggaaactagtcgttcgtcgtcacgtaagtacgatatttatcttctttactaatttgcttgtaaattagtcgtgtgattccgcgaaagtgaattaatctcgaaatcggtttcactagccgattttgatatatcgattttggcgactctattgtttacaccgcaaatcgttaggtgatcttgtgttggccacgaaaaagcgtcgacatattttggcgactccactggggacgagaatttcgggcatattaatttgacggaaatcaatcctgtaccatcgatctatttggctgtagttcggccgaatattttgatctactatttggtttttgtcgtagaatctttcggccataatctatctgctattcttctcatgcgcgcgctgacggttatctgatcaatctgacgcggttggtcattgccgtgctggagcggtggagccacgccgatctggaattctgctagccgcccagtcaccgcttgagataaagtgtacgctaatctagaaacacaacagcagcacacttgcattaacagaagggaagaaagaagccatcaggtcagtgcttgtctgcgttttattttgataaaatttggttgatgtacagatcaattgcacaaaaaaaaaagacttgctggaaaatacatggagtcatacaggagtgctacaccgctgcctcattacgtcaattgcgaggtacaatctgcaaatactttgcctgttccttcaaattattttgctagtacagtgaattctcatataaatattgctagacctatttttaatggacatattgcatttggtagtgattattcaaataattattcgagctctttgaattacgaaaataatatgtcactgcctatgcaaagtacttcacatactttaaattttagtaatgctagcaatatacaatatgtacacacaccttttaattcatcggcaattatttcaccacctgtcactacaccactaactatgccgatgaatgacatgtatagttatggcaattatcctactaattctattaatacattacatgccatgtcaaatactgctaaatcagagattacttctcatgctcatgttcatgcttatggttcaccttatacagtgtctagtagttataattcggcttcatgtgatgttaatgattatggccgaattagtgaaaattcagcaagcaagcatttacctccatataattccacaacatatagtttgtcccctgcacagccacagagtttcggcatcgagcatattccattgccgaaaccaagtgttaataattttcaacaaaatgggtcatttgtgcagtcgacaacgcataaagccgaagacacgcatagaacaaatgataccaaattagcaagttcggttggggggcaatttgtggatgattttagttccaagatagataaccttattgaagaaatatatagagatgtggaggagaaaatgaatgcatatatcttaagcaagggatcaaaaccaatttttaatcaacaatggaagctgataaatttagatttatcggctaatgaaaaggaggtagctatgcttgatttctctggaaacataggaccttttgttttgccagctgaatttcgtgctaaggaagatgatgaacatcttgacgatggagcacgaaatcatgacgacaaggtgaaaatattggagagccatcaaagaacgaacctagacatcgctcaggtgaaaaaattagaatgcttctccaacaaatcagatcaggtaaagtctgcaggtaatgtagttatttcccaatttgatcatttatctgaaaatcatacctgcatcagtaatatcatcatgaataactccaagggatcgattggggaggttaatgttcttattggcaatagtaaagtgcttagattttccatatcatctttgccaaagtttatgtctacatggtttgcttataataaatctagagctagaagcacaaaactaaaattggaaaatattaatgaggttgatgctaatatagtggatagttctaaatcaatggataagggaaatataagcaattatgtagccgaatgggttgatggaaaatctgaaccatttgtttgcttagctttaaaaccatctccgcagatgtgtcggttaaaggaaaagaagtatacttttgattggactatgtgcgatcatatttttgatgatttgctaaaaaatggttatattaaattgcttgatcactatgtcatgcaaccgcttccagatttaaaagaatgaatttattgtaagtggcacaattcatccgatcattgtactagtgattgtaatatttttcgtcagaaaatacaatcggctattaatgaaggctgattgcgttttgcaactccaagaaagtcatatgccaaggatgaccgttttgataaaagaaatcggtctaggtggtctagtaggaagtcttcggcacaggcggaaggtagttcaacaaggaagcaaatctgggtgccgaagtctagaggtcaagaaaagagcttagctgctggtgcacatgtgagtgtacaaaatgcttcagttcagaaaaaggctattgaacctggggggcatgcgcgtatacaacagttaggaaatgtacaccatatgaatatgaagcgagaggcatcttcggcagagttagtaacaagtcagaatccgccgaagagctcggggggcaatggcagccaactgagacactcacatggcttgtcaaattggcgaaagaagcagctccacaagctaagtgcagaaaagctgagggagagaggtatggcatgggttcttaaagcaagtgttcaggtacagaatgaaacagatgttaaagttggagtgggggcaaaaaatgagaagggagttaagaggtgtgcgccaaatcaacggtttgcatctaatcatcaggttctttcgccaccatattatacatattcttcacctatgccaccgatacctatgtcatggaatcaattctcaggtatgcatgtttatccctcatggttttattcttatccttggatatcatatgggtctttatattatggagggattttaccgtatagttttacacattgactattagttgtaggtgttgttatcacttttagagaccgaaatatttaggtgctagaaataaccgtgattttttataactctttagaaattatttcggtcgtatatagtttgtgtgagttggcaaggagctggtgctgttttaattttactaagtaatattgcttatgacacatcggtccctatcagtccatttagagcatgcttgcactttagaccgagtagatgctctattattcggtttggaaagtttagtcgatgttggtgtgagggatgtagcttttgatgatttacttttaatagtccgatagagtaataggaagttttagtgtttcggtggactgttaaatagttatttcgaccaatgtttagatttaattaaattgctagatgtcttaattgtccatcatatggctgacttgaggtgtgttttatagtggataaaccggctataattagcagtgtttgttcggataataaatctatgcaagccggtttgtttaatggtgaaggtactgtggtgcatcatgtgtgtggtggtagcaatgtgttaatgttatgtttcacggcggcgttcctgatggtctatatttttatttggctggggtcacgcatgctgcagttgatggtagtagtgttcatatacaaactgctggctggtcggttgagcacagaaaaggccgagcagggtttagaagattcggtacggaggtcatcagggacaaccgagtcaataggaaagtttaagccaagtgattggagggatccattcgttgattatgtaaaaacccgagttaaatgagagatagaaaagttcggcgacaagttttaagatatgctttattggatgatgaattatattgccgagctataagatgagttatttttaacagtatcgaagtttagatgtgttatttttaagatattttgaatctaagaaatgttaagaatcaagctaattcggttaggtggacattagggacaaccgaattagtggtgaaatttgtactacatgagaaatatttgaaaggttattatcattatgtactacaggaaacttgattgtctcaaaacgagtacttatttgagtatcgttttaagaggacgactgtggatgggcttagaactgataccatgtgtggagtatcgttttgagaggacaactgtggatgggctcaggaccgataccgtgtgtggagtatcgttctgagatgacggttgtggtttaggttggttagttttatggtgttttcggtaaagcaaaagttacacgttctacttataccgaaaacaggggggcatgtgtttgtagcataatttggctaatagtttgttttatttgggtaagccagattatttagtttagctgtcatgatttggagtggttggtttgagagccgattaaatgtgtgcgcgcggctggctagggagggttagcatttatcatggaatggaaatattatggattagctgatcttaaccatagtcaaggaaggtttttgcgttaataagtactatttgcattagcatgcagatagagatcagagaggtgaagactcatgcagctggttgcaagtggagattaatttgctatagtcgacaagcttctggccgggctgatgatcacatacatgcaggcgagcagaaatttgccgtgctctcgcttggctgttttgtgcggctgcgtatttgcacgaaggttggagcagtggcgttggtttggagatgatgaggcgtgattagcgcgtacggctgttaggaagataagagatagatagattttctattttatcagttagtttccttttcggttggaccatggtatctgtatatatacaggtctacggtcgattgaagaaaccccgatcacaatttatcaatctactatttttcttattctttacttttcctgttcttttctattttgctttcatggctgagttctagcaaccctagaatttggtttatctttgccgttttgcgttgaaaaacggtcgtgcttctccacgaatgcgaggaggttatcatttgctagttttctcggaaactagtcgttcgtcgtcacataagtacgatatttatcctctttgctaatttgcttgtaaattagtcgtgtgattccacgaaagtgaattaatctcgaaatcggtttcactagccgattttgatatatcgattttggcgactctattgtttacaccgtaaatagttaggtgatcttgtgttggccacgaaaaagcgtcgacacgaccatcgagcgttaatctatatccataataatgccgaggttgaaaaaaaaaagtcatgtagtccaaaacagacgtgccacagctagttttgtagttgcgatgctctcacgccttctccctccgctccggcgaggcgttggcgtctgcgggggatgcttcctcgccggcgcctccttatcacagctgtatgccgccacaacgacggaatgcacgcagtgctcctgcatccaccgcctctggtggtggagcctccaactactccggcgatggggttctacccggccgcgacgacgacactgtccacggctgcgcagtgcgttcttgtcgtcggaggcattcttctcgctcgagccacagtccgccaggagcacggtcagaggccgctgcggttgccatcgggaagcggtcgtcgccagctccggttgtcgtctaacgtgcccgccgggaatcagctccggcgacggcagttacgtcgtgaagatcgtgcccgccattacgtctggggtcacggcgattctgcccacttgctcggcggcggcgccattgcaattccagacgtcttcctcgtcggcggccttgatgaaagatgcatcaaaccggcacagtgccatccatcggctagctaagccatcctaaacaagtttgtttaatgctagttttgttcttaatttggctctggtggtactactttggaatacagtagctgtctgtgtcattcaataaaggctgtgtttagttcacgtcaaaattgaaagtttggttgaaattaaaacgatgtgacggaaaagttggaagtttacgtgtgtagaaaagttttgatgtgatggaaaagttcgaagtttgaagaaatattttggaactaaacaaggcgaaaggctagatttcacaaaactacaacagttgtatcaaaactatcattttgctgaaatttgtaggtaggagtttcagtaaattgctacaacaaaaattcattttatcatagaattatagactctatttaccttaaaggtcatatcccacttatcaggcacacatgtaatacattcatccttcggacccatcatttcacttattcatggaataagtcaaacggcatatttgcaaacgaaaataatttataaataaaacttatatatatatatatatatatatatatatatatatatatatgttcttagcgatctaaaagcaaaggctgaaaaataaacttctatgaaaaaaccttaaaatcagctccaaatttaatgttgaaaattcaaagtttagccgataagcataagcataagcaaaaatatgagatcttttatcagttagactcacatgtcaaccaccgctgtgggtgaaaagttacgattttctgactcaattgtttgctattgttctagttttgtgaaaatagtagcacttaacagtgaaatttggtaagcctcgaagtcatcattagtctatagtcagtatcagcttcagagtcctggaattagccgatgggaattatcaaggtgcaaatagtcggattcttaccatatctagaatagaccgagttcaagggagatgcagcatgacagtttatctattaattaggaatagtacattagtttcctgttatctttaggaaagtgtgtttagtgtctgatatgcactttatgttttccatttatccttaggaaagtttctttcttgtataaggacaagtatctatccataggtataaatatgtacatccgaggtcattgaaaattatctctcgatcaatacaactactctcggcgcatcaccaccctctttttcgaggtttttagttatcatcggcggaacatcgcacctgacgcagggctgcattggctttcgatcactacaacaaatctgggcttctatgacgattacctgatgacagaacacatatctgtcataaacagaggctgtttatgacgactgttcacaggatgacaactgtttatgatcaaaccgtgtatctgtcataatcatcgtcacaatatactctgcatgggctctgtgacgatagcacgatgacaatagtggatcgtcataaaatatagaacaattatattttttaaaaacaaaaaaaatcttgttatactacattgctcctagaccataaatcatttgtcctaggtgtactcttcttgtctacttcaattctagtctctcattttaggattttaggattgaagtcatctctagtctcattttatgaatgaaaaaaaatcaaaattatggcgtttcattttatgattgaatgaaaaaactaaaaaaaaacaaactaaaatggctataagttggtttgaacctgcattactacaagaaatatgaccttctgtgaagaattcctcgtaacatcggagttatttgttattagcacattccattttatgacaattaattagtatgagatggggaggcttagtgacaaaaacatttgctttaaaaatcatggccaaaaatatttttttaatattctacgtggtctaaattattctttgaaatttttcgtgaattttcggaggtcaataactaattttaataccacaaagttcatttaacctattaaaataaatggaaaaaaattaaaattcctctctctatccttgggcctttttcggcccaagtattactctccctctctcagcccgcagactccctctccctcctcctccctctatgggccgccggcccagcccttttaatcctccctcgccgagaagtccattttagctccctcctctgaattcaaataactttttgcgtaataaatgatttcagataaaaaagttatcaacaacaaaattgtataaattatcaagatttacaacttttattttgttcattttactatataactttgtttcaataatttgaatttgaatttcaaattatgacaaattcaaacaacattttcaaatactaaatgatttca

SEQ ID NO: 78124 - DNA, 6302 bp, Oryza sativa
ttaaataaaacttttaaaatataaaaaactataaatgttaccctacaaatggtaattgcacataaaaaatagtacaaactaatatgcaaaatgttgagtgcaattgttcatcaatttgcgatatgatcacacatcgccttacataccaccattacataactactaacttcttagatgcttacatgcgactcaacaatcattaccctttaacatttttttcccacaccgtccatgcgcatgtaaggcttcacggtcttctgagtagatgtctcgacattcttaatcttctgtacaaactgactataaagtgtcatactatcgtattgattgtaatcttcgacatcttcaaccccatccactcccaatatcttttgtttcccgggtagcactatatctttcttcaaatttgaagggactttcacataaaacacttgtgccacgcgattggcgagtacccaagggtcatccttgtgacccacactcgccaggtcaacaacaataagaccgaacttatcaacattgaccccgttcgggtatttttgccactggcacttaaatatggggaattgcattgtgtgcccatagtcgatttcccatatttcttcaataaacccgaagtatgattgtttttccctggcttcatcaattgcctccacacggacaccgatgttttgcgtacaggttttattatctcgggctcttgtactaaacgagtatccattaatgtcatatccttgccaagaatttactgtagttgatggaccacaagccaccgtttcatagttatttcatctgtagtttgtcccttaggtaagtctaggtctctcaaccaatctatgaagagacgcttgggttctttcattatccactccggggtgcgacccttattgttagctcgtattagctcgatatgttgatcgatgtaaggctcaacgatagcaaactgatgaaggacactgaagtgagcttcttggaatgatttgtgatcatgggtgacgaatctcttctttcctatcgttcccctaccactcaatctgccctcgtgtcggggcacaggtactccaattgcatatccatctttgaggtaatcgatacagcactcgacaacctctccagtactataaccctcaaccattgatccctctggatgtgcacgatttcggacgtaacccttcaaaaccgccatgtaacgctcgtatgaccacatttgatgtaggtacagtgggccaagcgcaaccatctgcggcactatgtgaacaatgaggtgctccatcatatcaaaaaatgacggagggaaacacatctcaagttggcactgtgtctcatgtgcgaatgtacggagatttcctaactcttcgagactaatgaccttctgtgacactgcgttgaaaagtagcactaccttgtgatagcaacctttaaatactctggttttatggcccttattgtaattgcaagaaacacggtgagcaagacatgacaatcgtgtgaattataaccagataccgacaaatatttcatttaaactagtcgactgatgtttgacaagaaacctatgggcactctgacatcacggagtgacttgcaaaatgacttcttctcctcaggtgtcagtgtgaaacaggccggtggaagatatactttgccattcttctctccttcttgagggtgtaactcttccctgattcccatctcgactatgtccatccttgattgcagaccatctttagtcttcttcggcatgtctaacaatgttccaactatgttatcaaacacattcttctctagatgcatgacgtctatggcatgccgaacctccagatctttccagtacgggaggtacttaaagaatatggaatgctttttgaatggggaagggagtttatcatctgacttcgaactatcatcttgcttcttactatcccacatagtcttctcgggtttcttgcgctttgtcccctttgatggtttcttagtcacatttccaaattcgcaaacaattttctgtcattgcacacactttttcccccgatgtaggttttggtgcaggatcaatctcttcagtgccctcgaactccgccttcatcttgcggtacttgtgatttgtgcgtaggaaccgccggtgccgcatgtacacaagcttgttggaacccgggagataccaatagtatgttccattcaagcagatcacacatcctgttttacctttaatttgacctgaaactgaaaacattgctggataatcgttaatggtcacgaagatgatggccttcatcgtgaagtattcccttaagtactcgtcccacactttcaatccctctttccataaatcagcaatatcttccaacaatggttcaagaaatacgtcaatatcaataccagattgacggggtccctgtatgaggatccagagtagtacgtattttcgcttttgacaaagccaggtaggaagattatacatggtgacagcactggccaagtactatgtgagctgctcatgtctccaaaaggattaactccatcaatactcagggcaaatctaatgttccgtgggtctttagcaaactctctatactgagcatcaaagtttatccactgacgagcatctgccgggtgtcgaatcatcccatccttcttgtgcccttcttcatgccagcacattagttccgcatctcttgggtttgagtatatccgtttaatgcggtctttgacaggaaggtaccacatcacaagctgcgggatttttctctgtcttccctcagttgtgtcagacggttctaggccagtattgctattcgatttgtactggctagcattgcatgttggacattcatcaaaagaagcgtactctttcctgtacagtatgcagtgattaacgcacacatgaatcttttccacaccaagtgaaaggggacatatgagtttcttcgcttgatatgtgctggatggtagtgagttaggcctcaggagcattttctgcagaagttctaacagactgtcgaaactggtatcagaccatccatgtttcgcctttaacctcataagttcaagaactgaccgtagtgttgtgaactcactgtcacagccctttgactcatcgtacaaaacttccttagctgccttctgtaaagctctagccgaccccatcagcacctcgggttctgcatgacgtaacatttcctctaggtcgattttgtcctcaacagaaccatcgtcatgcaccatgtcttcaacttgtgtcggaactacattttcaggcccgtccacttgttcttcgccatgacgtgtccatatttcatacttgtccataaatccacgagttactaagcgctccttcactttaaaagcatcgtcgaagtcccaggctatttcattcttacagtcagcacatggacaaattatcttcctcatattgttcttctcagcgtgtgccttggcaatagcaataaatttagacacttcgtttctatatggagacaaaaacctcggccaatgatacatccattcccgactttccatatctctaaaaaatgaacataaattatttgcacaattaaaaccaaatttgtagggtttattgaaaaaacttatcgctattaaaaactaattaactaaaggttatttgtaaattaataaaaaaacaaagtttatttcaatttttttacacagacatgccaaattagtatattagaaaaatctaacaaaatcatatcatcggcatattactgatggaccctaagttcctctcgacactcaagactgttgttggcccgatctttcggtgagttatgataactacgatttggaagaaacgttgacaatccgactacaaccgtacgagacgttgtgttgcgccttagcgatcgatacacctctccgtgggttattgatcttgtcggtgcagatcaaccctattcctacaagcaaatcgaagaaacaagcaagaacaagataaaagcaatctgatattgcaaataggaattttatacaaatgataagttggggttccgaagaacaagcagacggacggtctagccgacacgcgcgctgcaagcaagtagcaattgctaaactttaatctatcaaaacccgagaaaccctgaaggggtacctagctacttataggatgtgggagaatgatcaagagggtcctagggtcatgctccactagcttggggcgcaccccacatgggccccacttgggccggggtcccaaacaaagttacaagcccataggcccattattcctgtgattctggccacacgagatggaattcggagaagaagctggatccgttggaaagagggttccgagaactttccatcaagtactcacgggccgaaaacggaggtcgtatgcagattcggcggccatttgaagtcagcagtgtagcaggtggccgaatcggattccagcacttggaggacttgatccttatatctccttgttcatccatgatgtgagcaatggttgtatccgtagtagccatggtaacatgcttaaaatcagcgcagttagtattaacaacaggaatagcatgttcattcactagttgtggcatggatataagtgaagcattatcgcacaactattctttatgacaaggaacagcaagtaaatcaacttgtgacaaaggcaactcagcaattgattctactaatggttgctctactatagcatgaaaagtggacaagtgtagctcaccttgagaatactcaccttcatttctctcagcaccatttaatttaccttgcgaactttctttagacatcgcaggtgcttcatcctctttcttctcaagtataccattctccttttcttggatgtgctgatcttcctgcaaaacgttagtaacaggggagacaaaagattgctcctccaatgtttgcacatcatcattacataagtatattggggattcagaaataggagataaatcacattggtcatgcatcctcgcctttgatatgatctgactctcaatgctacgagcaagcatgaataggtgcccaatatgattatatgtcacattatcaagcaaaacctgaatttcagaattaagcccattgaaaaatctacgcattgtattttcattgcactctttgagaccactgtagatgatacagaccttaaattcatgaatgtactccctaacagttctatcaccttgtttcagatgttctaatttctcccgaagagtacatttgtaataagatgtcacagagcgctttctcatcatggttttcaattcatcccaagtttcaggtttattactaacataagtccaccaaaataatgcagaagaggtaaacttattactagcagccttaatcatttgagtatcagaaaaatcatatatatcaaattcattgtctactgctagctcccaatcaatgtatgcaacagaatcgtacttcccatcatagaatggtaacttagatgcaacttgttcaaaattatagtcatgtacctcatatgcatcacgtggagaagtcgtgatatctcgtcgaaggtgtagaagttgatgttctcgtattcccttacgcaatcctgccatggttagtagcaaacaagaaacacacaaaaatatgcacgctcctatcaactactaggtagtggcagctcaaatatcacacacaatcaagcttttaaccaagctcttacaagttcttaccaaagcaagcggaatggtaatgtacaccgactcaaccaagcaccccaatggaggttgggtgtatcgatgccttggcaaacacttgcggtacggccgtaatcaaaactgtgcagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaatgataacaaaatgattttctccttttcttctttctttctttctcttttttttttttgtctttcctgcttttcttttctttttcttttcttttctttttttggtgtggcttttttttcttcttttttttaagcacctttctgccttttttttaacaaaaaccgactcaaggacctcaatataaggtcatagggactcaaatgtaaatataaaaattacagggactcaactgtaaaagtgcaaatccaaaattaaaattatacaaaaatggaatgctaaatttatactggttccgtttttccaaacggatctac

SEQ ID NO: 78125 - DNA, 812 bp, Oryza sativa
aaaaattatttgtccatattgtttaaggtgcgtccatcacataaatgatccgttttactgttcatattttttttgtagcattgtgcttggttattgcagaaaatgcatattgttttcatttttcaatggctttctgtcatttcctattctactagcatctatctagatcatcacatgacaagtagaattttattagtcaaactctttctgaatggttgaccatttacacatcggagattgaaaattgaacctagcacagttggtaggaaatatggtgtgcacacctaccatggtagtttaaattctttagctcaatttagatttctatttcttctcacttaaaaatggcatcaagctcctttttaatacctacttctatcgtattacgaataaagagtgaaaaagagccaccacgtttcctcggtgtagaaattatcatgacatacactattttgatcgcgagatatgacatgcatgacggtgtggattgactgatacaaaacaaaactatatttatgaataatgtatatcaaaatgagattctatttttaaaatctagctacatacatggttgcgtgggaaaatccattaattctcatgcattaacacactagataaaaaaagtatatccaataactttgtctttacccctttaaacgttcccagtggtgatggcggtgagtctacctcaccaccatcaactgatgattgggccccacaatgtcagtaataaaaggtaatccaataactttattactagtataattcgtaaaaccttgatgtatatctcactcttctcactatgcaacata

SEQ ID NO: 78126 - DNA, 10781 bp, Oryza sativa
accttcaattgattccatctcttcaagcatggccttcctccagcagctctcctgctcagcctccaagaaacttgctggttcctctgctgccataaggcattgatcactgtaattaaaatctaggattggggtcaaggtggcaagcgtgttcaccactgttctgtagctcctgggcccttcatcagtcccttcactagcatcagttggaggggaacagaattcaacaccagatggcagagttgttgcagttccggtgcttgatgttggtgatgttgctagcatggttggagtggctgctgcatcctgggcatgtgtctcactcccttggactgggattgtgaaattctccaccgtaaactccacatacgcgtcctgatctccttcttcatcagtgttgctgccccagtcccagaacgtcgtctcataaaaaaacgacgtcgcgtgacacacacacgcgtcgcaccacaaaatcatacatcttgtaggcttttgatccttgctcgtagccgatgaagaccatcctcgtgctacgatcatcaagctttctcaagtttggcttggctgtcttaacatagcccacacactcaaacacacgcaggtgttcgacagtgggtcggcgaccataccacgcttcatacggcgtcaccccatcaagactcttcattggtgatttgctcaagacatagacggctgcaaccaccgcctctccccagaaatatgccagcatgtttgccgccttcagcatggacctagctgctgccaccacagtctgattgcgccgctccacgacactgttctgctgccgtgagtagggtgcagtgatttaacgtttcacccctgtgtccgcgtagtactccatgaactctatagaggtgaattcacccccgcgatcagtgcgcagcgccatgagcttccgattgctatccttctccacgccggcttaatcgctgccgatgcttcgtgtttggcagagaggagtcgtatccacatgtgatgactcatgtcatcgactaggagcaagaaatacttcttgccccctgtcgtcgccggcgtgattggtccgcagaggtcaccgtgcaccagctcgagcgccgtctgcgccctgtactgcgcctcctctgggaacggtgtgcgatgttgtttgcccgcgaggtacccgtcacacaactgatcaatgtgatcaatttgcgggatcctgcggaccacgcctccttttgccaacctccgaagtgccaggaaattcagatggccaaatcgtgcatgccatcgccatgctagctcggagccgctcgctgccatacagattagtgtcgcaaggttcaacttgagaacatacaggtaacttgaatcacgatttaccttagctagctgcatcccttccgggtcacgcaacgtgaaaacaccatgccaaatgtgtgcgtcgtagccgcgcgcatcgaggcgaccaacactaacaatgttttttctcagcttggggatgtagtacactgcctctagtgagcggtgatcaccattcttgctctgaaacaccacagttccgcgcccctagatgtcaaccactgagccatcgctgaatttaaccgtgcccacaacaccagtgtcaagctccgcgaacgctgagcgtgcgcccgtcaagtgattcgtggccccggtgtccaggaaccactctccagtcttctcctccttacgcccatcctcatggtccagcacaaccttcttctctgtgagatgcacttcctgcacacaaggtgttcgaccaacggccgcttcgccggcgagcgacacccccatcacgtgtgccatgagcagagtcggctcttcctcagcctggaccagatttgcatttgcctctccccgacattggcgacgcggcatacggcactgcttcgagtaatgaccgtattcatcacaattgaaacacttcaccttagagatgtcacgacagccatggccgctggtggccatctcctttcccttcggtgaatcgccggccttgcctcgacggttctggttgccagagcccgcccggcccttgttgctgctgccagatccctcctactcccgctgcttgacaccggcctgccactgctccttagtgaggtacaatttgccaccgtcacttgcctcctcatcatcactgtaggagtcgaccgtcgacagccactcgatgagctcctccagggccatggtcttcacgtcgaggagctgctcgagggaaattgccaccggcttgtacttcttggggacaacacgcagcagcttcttgttgatgtgttcgtcttccatgactccgcccatgttgcgcatgtccgcaacgatggcagtgagccgcatcgcaaattcctccggtgtctcaccgtccttgaagcgcatcgcctcgaactgacggcggaatccctgctccctcgcctcgctcacgcggtcgacaccgacccgcatggttttaatggcatcccacgccgccttcgccgtgtcgtgctttgccaagccgcgcaacatctcgcggggcacagcttggagaatcgccgagagcgctgcacgatcctcgcggtactccgcatagcagggatcgatggccgtccagagcccctgcgcctgcaggttgacgcgcatcaacagcgctcagtctatataatttgtcctcgacaggatcaagagacgggcagtgtgccctgcatcgactagcgggagtgatgccgcagccgttgtcgcttcccccgccgccaccgccaccacgacggccaggcggtgtgtatgacattaccggatcgtctcagcaaagctctgataccaaatgtcagaaaaaactcatgcgaactggctctcagtctctctgaaacacacactctgacgcttgtaggtgcagctacagctaactgaagaagttccgaaaaaacagagtcgaacagaacaactgacgaacagagttggcactgcgtaatacagtgcagctttttcgggtttctcttctatttattcatctccagacggagtttgttacatgcataaaagaatcaaatcacgacaatctcggatcaactactgaccgcgccattccacgattcgagccgagttaacgcagcttaagaagggagccaatttgctaaaacagaaaaatgctattctaccggctagaattcagactccaaccgaactctacatgcaacgaaacaaaaaagaatataaatgctctaagattacaatccaatagccttgcaggcaccaagtagtggtgctccggccggcgttctcttcaggcagcaaggcaatgaatgtgaagaagatagcagcgttgatgagggggagcggacgtcgacggcgttgcagagaagaggccgaccagcaaggtgacgacgtccgagcatctcggcgacatctcctcgccatatagaaacatcgtcttcaacatcgccgcgccatatagaaacatcgtcttcaccttgacggagacttgcagacgacgtcaactctggcgactctgacgatggcggtgcatccggcatcttctctgctgaggagcttcataccggcgtgcatgcgctgaaatggagcaaagggatgataagaaaataggctagttacccatggcagtgaactggagcggcatcgtctccctggtgatcgtctcctccttagcgcgcttcctcagcggctcagcgcacgcgcctccttgccggacgccgaggtacggcagccgatgtcgccggccgcagagcacgctcgttcccgcaggacgccgagatactccggccaagacgacgtgcgtgatggttgccgatgagcagcctgtgtccgctctccttgtccttgtgtttctgtgtttctctcctgtgtctctgtgtatgtctctctagggactactgccaaggctgggcatggcggcagcggcggcgtgaactgcaggccctcggctcgtgcctctgtactctctctgctgcctccccccgccgtgaaggaaatggcctgttttatagtggcgatccggccgtatcagagatccattgatgtgcgatcactttccaatcgactgtggcgcaaagagagcatttccttgtatttgtatgcacacgcgcgtcccagccgcgcggacatatatagcaaggatctttggccaaaacaatattatccaccgtatttattttaattccatgcaaatgcatattcgaaatctactgttgattccaaatgagttagagcccgataactatccaactaaagaggattttttttagataatggaatagatcatcccggcctttgctcaaaagagctacaaccaattattacaaactaacactctaaaacaagtaaagttcaaaaaaaaaaataggacaccaatttaagaagtaaaataaccaaaataggataaggagtacacatttattgaagcctatttgtgaatctccatccatagttggtaaaaagttgtataaccgtcgtctcaagtttacgacatgcaacctttagaagatctccgtcttcatcacacctttataattgtgcccaaaatcagagccaatatgttgctctgaaaattatctgcatatatgtaaaagatgatgatttgttaaaaaccatatcattcctgctcaaccacagcgcccaacatattgtagaagctccaaccaatagaagtttactctttttcttgtccacccctaagagccacccatcaaaaatatgagaaatgctagtaggaaggtataaaccaaaagagaattgaactgctctctatataaactttgcatgatgacaattcataaatagatgttaaatagactcatttttcatacagaaacagcatcttaaactgtcattccaattttgtttagtcaaattatctttagttagcactaccactttaagcaagtaccacataaagatcttgatcttaagcagcatcttaagctttcaaattatcttgtttctctcaatgttgccattattaatcaaggctagatgcatcgacctaaccgagaatcgtccactctgattaaatttccaaataaaacaatcaaaagattgattcaactgaacatgtacaatagaagcacacaaatcatgccaagatacaagattatgaccaaccaatgctctcctgaacgaaacattaagcggaacagagcccataacactagcaattgaagaatttttccttctgataatagcatataaggatggatgcttatcttgaaaagcaagttccctaaccatttatctggccaaaatcttacttgttccccattattcacattccaggaacccatattcaagaaagtactcttaactttcatgtggtctaaccaaaaatgagaatcaccttgtttcctatcaacttgggttatagactgattataaagatattttctcttcaataagtcctatcaaaccccttgctcatttattaacttaaacaaccattttctcaaaagacatttattttgtatttcccaattatgacccctcatgccgccctgatctttgggctggcatataatatcccatctagcaagcctttactttttcttatgatcatccccttgccaaaagaagcgtgatctataataatcatttttttaagaaccccttttggtatctcaaaaaaggatatcataaacatagctaaacttgaaagtacataattaatcaaaaccaatctacctccgacagacatatgtttacctttccaactactaagtttcttttcaattctttgtgcaataactttccaatccttgttactaagctttttaaaatgcattggaataccgagatatttgacagggaagttacctaacttacaaccgaagatattataatactgatcataataatcctttgcgtgaccaaaacaaaataattcacttttgtgaaaattaattttcaggctagatagctcaatttcagcttttcaaagaggatattgtgatggaatgcttccattccaaaattttctagcatggaatgggatcgtgtgtgtttccattttgctttatatacacattgtattgaccagcagagagcatgcatagctgccgatcgattgtcccatatatattgccattcatcatcaggctgacctgtgaacccaggtgatcaagtatagatgcatatggcactgataaagatgtcagacaagcaacccctattactttctggtgcatttgtgcgtccttgtcagtaatcacttcagttaagactaattaccgtgtttaactaatcatggaatttacgcatatagtgaaaacttgtgggaaatgcacacagcttgtttgtttgttccttcgattggcacattcatgatttttagttttacttaaaaaaaatgcacaaaatctcgtccaacacaaggtaaagggttcttgcacctgagatgtgtgcataaccgaagcactcgcttgagttggcgtgatcaaagtgccttccttcaccacaacccgcatcaagacggaggagagatcgacaatcacatgtgatcatgctaccgctccagagatttcaacatatgcatcatgccggcggtaaggtatacaaaagacagcaaatgattcaccatttcttttacacatacttgtctttagatgagtttggcttgatcatacctggttatgcgtcctcagtccattttcgtatgctatggtttgggtggtcgtcgacattcataggctttttaaaattaagcatgatgcttaggataaatagccttctttaattaaagttgacgtggtgtcaagtttgcttaaatgaaccgtaggtccagtactttcatggacttcggatgtatatccttcgtgaactaacccctgcagggaatttttcaaattgacgagcgagtcctcaagcacgagtcacactggaggtaagacagagctaggagaaaaatcagttgctaacataaaaaggagaaacatatcacctatcaaggtgtacggtgcgcatatttctaattgctcctttagcatgttcatgcaaatttaccttagccctgtatgagttttgcttaaatgaaaatttggtgaacaataaaaaaaattgaaagaaagaaagagaaaaaaaagaaaattttgttttcaaagaataaaagaagcgtctctcgattaaaaaaatttgtctctggagtaaaaagaaaaaaagatgatgacaaaataaaattatggcaaatttgtgggatccatgcttattaagaatccaattccttgttagcatggatgtgaacaattaatcttcaggctatgataaaatcttttcaattttttgttgtccctcgggtatttgttatccactaaccttttgcaggaaataaaaaagacaatagaggagtagtgtaaaataactccaacattcataccacgctccttagtctatgagaagacagatgcttaggaaaccaagcagaacaaatgcaaagttgtgctgtattcttgcatccaaatcaaagcttggtaagacctatctggtaataattcgaaacacctcgtgcatcctcgcctcacatatgtccaccctgctaagttacccatcacctcaattgatgccataataaaaataaaaataaaactataaaaattataaaatgaaaataaaaataaaaacaaaataaaagtgaaataaaataaaagtaaatttaggcacttcatgcgcctagagttacttaaataaaatttggctcaccgatattttaccccggtagaagcctattttgctttccatcctttttgttgaataaagacaagccacaacacaagtgtgggggagtcttttcgaactctcgacgcgcaacagcatcgactcaacatgacactgtgatgaacaccagcctatggccgcgcacaaaattcagcagtcatatatgattctcattgcaaggcaatactcctcagcgactatattattaactaccaaggccatatatgattctcattgcaaaacattacatgtataggctgactgacattacattgagctttctcaaattattgtgacccatgtgagatgctttttgatactttcattatcaagatcacgtacactaaacttacaagcacgtaagctaaatttctacactggaagctagcatccattgtccatcatttattttatccattatccacaaaataaatactccatgtcatttatgcctcatcctccaaaattctttcaaaaaaaaaagagagagagaggcatggctacccaaaataaagaaaaataaatttttgctcatagaaaaatggagcattgaaaagaaaaaaaggagagagaaaatcttgctcatataaagtttggggaatgaaaaaaaaaagaggaaaaaaacggatggccatgccctttcttaatatggacaatgagagaaaattggaggaggaggtatatcaaaggagttgtaatcatttatttttcctttttccacccccaaaacaaccatacacatatcacacacatgcacattcttgatcagagagtatgacttgcgatctccttaggtctggtcttttggcttggtgaaatatgtgatgcaggtatgccccgattgatccctaccaagctccacatatacaaccttgtagaattgggacaattcagcaaaatatgccttggtgagaatccacaaatcaaaccacacgagagacttgagagaaagtcattcgaggagtatatctactttgaaaaaatatatgaaaacccaagagattgacaggaggaacaagaaggacttgagccacgacagttccattcatcaattacccaagatggatagttagacactggaaagttcacaagtacttgtatggcttagaataaattgtatacctgtattatatcttggaaagttttattccacattcatccttaaccattactcggaacgagtaaagagctaagtgtgggaggttttgttgatggctgttaaatacaaaatatatgccgtcaatacctgcataaaaccataaatgtaaaacatcaaccatagtggtagggtttatttctaatgatttccactagtgctagtgtatatttgtatgcaggtgacaaattaccagagttgagaaaaaataaacatgtaggcagggggattatacttcccgttggagtccatggagtgatgagcccacaaaccatattaaatcattatttattgggccaacgctggaagaataataaagagggacccaaatgtcaggagatagaagaaggccggaggcagttgggccagcccatggttcggctgaaccgccatgaagcccaattcatcccagccttccatgtgggcgtccaggattgctccctaatgatggttggatggtgtttgggacatttcccataatgtaactatcatatgaagcctataaatagagctcctctccctcattccaacacacaccaagacgtagagctgaattacaagaggctctaagtatactttaggttcattatatgttctatagtacacttagaatagggatagagtaaagtagaagaagtcggaggaatcccagagttgtcgataatcctctctttattcttgtactttgttaattactctggttcaatagaaatatcattctgagtaattaagatttgcttagcgagaattattcttcgttagttcctaattagcatatgggattattgttcactatagtccattaattatatagtgattgctttagtctttagctagcactagagtagttattaattgcgtagacacggtgtctggataattaatttccagtacttgctgcgtatcccacaatacgttagacgtgggtgtagaggtggtgatagccctcaagagcacttaagtcctccctgtgcgggtacatagtagagcgacatctaggaacagcgagttgctagtgcctgaagtatcgcgttaggattaaaattaagctttccttggacactttttctcactaagaaatcctctctgccctgtgcccatatttatcttatgtccttgatgaaccggaggaagagataatcacacacgttcccttggattcgatacccttgaaatactccgtagggaaagtcctacatcggtatatccatgcgcttgcggattctatctgtgatcgtaagaaataccaacaactggcatcccgccatgcctcttgaacgatgctgacctcgatcttgtcggtgatcaggagatgcaagcctactacatgctaaaggatcagatatttgctcacacgcgggcatacgatccggagctactaaaaaagataggtatggatgttaattctcataccatttggaaagttgttggatggcagagatttgcggtggcagatgagcctggttctcgtttgcttactttacaatttcggtacactttgaaagaaatagaagatggaatttcctttcgctttttccgtaaagaatttacacttacatggaaatgattaagtacacttctttgttttcacgatgactataaaaccgttcttcggaatttctgggttcgagaaaaacagattttgggaaaatatttctggtggtccaatttgcaagaaacctagaacgaatgacatccataatcctacacttaggcttatgcacaaatggattgttatgactttgtttcctagaggtgatcttaggcctataagagaggataaattgattatcatgtttgtcacagttaggaagattaaagttgctcctgtgaaatgtgcaatggttagagagtataaagtttactgctcctgttgagtgcacttccctaattactagcatagcatacagacttggggttatttctaatgatcagattg

SEQ ID NO: 78127 - DNA, 8770 bp, Oryza sativa
catcttcgtactgccagggtggatggaataaggactttcgtgagcttcctgaagtatcagcatacccgaaatgtctaggtacatcttccttaagttctctgttatctggaacgcatacccgatttccgttccatagggttccatgttcatcctctgtgaaaccagcggctttaccctgtttcatattcttgaggagcccatgcatatccgggtcattcttctgagccttgcagatttgatcgagcaaggtgggcttggcttccagcgcagccaagaatccgcgactaactatgcttaggttcagggcttccatctgttgattaagttcgggtggaatgccacggacgttaagagtgttgcaatggctctttcgacttagagcgtcggcaaccacgttggccttaccaggatgatagtgaattcccacatcataatccttgatgagttctaaccatctcctttgccgaagattcagatccgactgagtgaagatgtatttcaaactcttatgatcagtatatatttcacagcgattcccaatgagatagtgccaccagatttttagggcatgaaccaccgcggctaactccaaatcatgagtagggtagttgccttcatgaggccgaagctggcgtgaggcataggccaccacataaccatcctgcatgagcacgcacccctatccttggcgcgaagcgtcacaatacaccatgaagtccttgtgagtatctggcaagattaacaccggcgaggaaaccagcttttctttgagagtttgaaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactgtcttgggttgcttccaatcagtgacggcgatcactgtttcggggtccacagcaactcctttagcagatatcacgtgccctaagaatttgacttcggacaaccagaactcacacttgctaagtttggcatacaattgatgttcccgcaactttcccaataccaggcggagatggtgctgatggtcttcctcggattgtgagtatatcagaatgtcatcaatgaaaaccacaacaaacttatccaagtattccatgaacactttgttcattaagttcatgaagaaggcaggtgcattggttaaaccgaatgacatcaccgtgaattcatacagtccgtatcgcgtggtgaatgcggtcttcggaaaatcttcttcccgaatacgcaattggtgatatccggaacgaagatcaatcttggagaatacagtggcacctttaagctgatcgaacagatcatcgatccggggaagagggtacttgttttttatggtgacttcattgagagctctatagtcaacgcacatcctcttcgtcttgtctttcttctccacaaaaatcacaggagcaccccagggggaagtgctcggacgtatgtaccccttttctttcaactcttccagctgtttcttgacttcggccagttcatttgctgccatacggtagggtcgcttgcacagaggagtggttcctggagcaagatctatctggaactcaatctctcgcttgggcggcataccaggtagttcttccggaaacacgtctccgaactctctgactatggggatttctgacagacctatctgatgcagttctgaactactgacagaggttgggggtgcaaagaaaacaaccggttgtcccggccctcggtacagagtgacggtgcgtctcgcacaatccactactccttggaattgagccaaccaattcatcccaaggatcacatccaagttcttggtgtctagcagaatcagatccgagggaaaaggaatcccctgaatttctataggaaccgcagggctataatactttgctgtcataacccctccaggggtggtgatgagcagagggtttctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacatggttcacacgaccccgaatgacgtccttaccaccgttgttggagcggggaggcgcttggccttgctgacgcctcggctttgggcatttatccgcaaagtgcccgggctcgaagcagttgaagcacagacgctgcggacctgaagcgtccctgcggccttggccaggctgcacagttggcgtaggaggacgaggcgcacgggtcccttgctgactctgctgttgctgcggctgtgggacgcgcaccacgaattgagggcggggcgcggagcgaggttgctgctgctgttgttgctgctgcgaggaggatccccctggatagggattggtgtagcggaccctttggttagctccctgttgattgcggaaattcgccaagcggcgcttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattcccttttcttaagggccacgactccggcgggcacatgggttctccggaaagcggcggtgaaacgggcccaagtaataggctgtccctctggctgcgtagcctggaaatggtcccaccatagagatgcgggcccctgcagctgatgggcggcgaagatgactttctcctcatcgctgcactgcacagtgtctagctttttccccacggcatgcaaccaatccaacgcatccacggggttgttggagctagagaaggtaggtggacggatgcggaggaactcggcgagtttagagtgttggggaggtggtggtggagcattatgttgtggcggattttggaggtggtggagaaaagcagtcatcatgttggcctgctgggcgaggatttgggtgagaatggcgttggtatctggtggtggtggtggaggcggaggaggaggtggaggtgggctgccatggttgttgtggttgctgccttcgggttggttgccatcactggtggcagcatttctcctggtcatcaccatctgaaaaccccacacagaaccagcaaacagagagagctgacaattaaagctaaccacccacgactaccataattcttgaatttattactgctattaaattggttcattaaagttcaagttgcttaaacaaataaaataaagacaggctccgacaaagttacaccacacaccggcataaccgtgccccacacaacccaacaagaagacaaacgagaaagaacacacgcgcaagcctactaactgctcgtctactgctgtgacgggccaggacggaaggtgagcaacagcgcatcctccgtgctaccaacgccggaggcttccccctcctggggaaccacgggcgcgggctcggcacgaggggtctccacgaagcaagtccacgccagggactgacgaacaagctcgggcctggaggtgctcttgcgggcggtgatcttctggctgcggtagacgcggcgatgcttggggcggcagatctctccctgggcgatcttgagctgatgcagctgcgcctccaccgcatctaggtccttcttgagctgcaggttctcctgacgcagctccaggatcttcatgttgttctcgaccatcccacgacgcaccatctgatggaagtcgatacgagccgcgtcgtacgcctccaccatgcgcgccaggtgcacgatggtagcgtcatcctccgagctagcgtcccggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggaatccccacccgcggtgactgtcagcgaagtccgctcgggagagccagcgaggatcactgcagtgacctcccaagcagcgtggggctccgcatcgtcaccctcctgctccggaagcggcctggcctggtagtccactccatgtggataccccaggaccacgcacatgccccgcagctccaagacgaagccagtcatgtccaaaccacgacggctgacgctgccggccatctacaaacaaaaacaaaaagaaaagcaacattttaaaggtcagattttggcgataaatgaagcagcaggacagagagagaatagaggattttcacaaataagaagggatttttattttgaaaatattgctaaggcttgggatctaaggctcgtcctagggtcaagggggctctgataccaacttgtcacgaccggaactgacccaacgggcgttccttgcgtgcgtgcattaacccttgtcccaggaggcaaggtacaccaaaagttgatacaattcagagtttaacaagcggaagcgtaaatagataatttattacaggggcagcgaaggcccagcacacacaaagacaaacgagaaatagcggaagactagggcgacgaccacaggcgcttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttatactataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacacccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaagccaattccacgataatccaacagttccaaagtgtccaggtgatatgaatattcccaaagtctagagttgtaaaaccacctaatgttacctaattaaacagcgaagcatctacctaaaatcatgctagtggtaccatgagtagagtgtccactagttggggttttgtttaatctagggtgaacaaggaaatactaacaataacaataataataaggtcataacaaaggtaaataggcatggctagataaaacagtgataacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggtcaagttatggccatttgaagtttatatgctctttaaatgaatatttgcgaatttcttcatttaaattttaatttaaaatcggatttattgcgtcagctgaggggaggggcgcgcggaccgggtccacgggagtggggcccacgcggcagcctcacggtccacggtggaccgggtgcacacggcttgcgccggccggcgccgtgggtcccacgcgtcagccgcacccgagggcgcgggcggctgacagccgggccccacatggcagccgcggggcgcgcccgatggcggcctcgccggcacggccgacgggaggcggcgcgcccgcgccccgatggtcaccggcggcgacctccggcgcgacggagcggcgcccgagagaggggagggaagggggaagcgagatggcagtcctcggctcaccccgggtcgacggcgatgacgggaacggcgaccgaagcggagagaggcggcggcgcggctcgggtcgacgaggacggcggcgttccggcggtcggcgggcgaaacgaaggggtggacgaggtcgacgaggacgcggcgaagccgaaggaggcgatgccgaagcgggaggaggtccggggcgacgacggcggcgaaccgaagctcggcggcaacggcggagagagaggacgacggcgcgagctcgattccgacggggagagaaagcggcaagggtcggaaacggaggagggaggcacggggagtgcttaaatagtgttgggagtgagagagggcggccggaggggaaggaaaccggcgcggcgatctcggctccatcaatgacgccggcgaagtttgcgggaggatttccaaacgaatccgagagagagagagggaaaagtggggggaaagagggagggaatcacggggagtgatttcccccctctttattgcgcgcgggggcggcgggatgcggcggaatccgcggcggcggcggcgctagggcacgggcgaggcggcgggcgcggcacgaggtaggggatgacgggtgggccccacccgtcagcgagggtggcgggcgggcccgcccgtcagtgacgcgcgcgcgggggaaggccgatgggccgcgggggagaggagagagagggagggagctgggccgagccggcccaagagaggaagggggaaaaaggacttttagggatttttctttttataaaaccactttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttactaattctatgcacaatttcgaggatgtattttagagtcgatttgggacgcgacaaacctacccccttaaacggaatctcgaccccgagattcagaaggactggcgaagagatcgggatgggctgccttcagctcgtcttcacgctcccaagtagcttcttcctcggcgtggttgctccactggaccttgcaaaaacggattacccggctcctggtcctgcgctccatggcgtccaggattttaactggcctctccacgtaggtcaagtcttcgcgaacttcaatttgctctgagtcggcctgctcggatggcactcgaaggcatttcttgagttgcgacacatggaacacatcatgcacgttgcccaaggaggcgggcagttccagctggtaagcgacttctccgcgccgagcaatgatacggaaaggacccacgaaccgaggtgcgagcttcccttttgtccgaaagctgtgtacagctcgcaatggtgtgacccgaaggtacacaaagtcatccactgcgaattccaggtcacggcgatggttatctgcataacttttctgccgggactgtgccacctttagattatcccgaatggttctgaccttcgcttcagcttgtctcaggatatcagtcccgaacacttggctttccccaacttggtcccacaatagcggtgtccggcacttgcgtccatacaacgcttcataaggtgccatttgtatactggcttggtagctgttattgtaggagaactcggcataggggagactcttatcccaggtcttcccgaaatccaggacacatgcgcgaagcatatcttctaggatctgatttagacgctcggtctgcccatctgtctgcgggtgatacgcggtgctgaaatttaatcgggtacccagctcttcttggagcttcttccaaaagtgagaggtgaactggcttccccgatcagatacaattttcttggggacgccatgcagactgacgatcctagcgaagtagagttcagctagtttgttccctccataggtggtctttacgggaatgaaccgtgctaccttggttagtcgatccacgactacccatatagaatcatatccgccttgggtttttggaagtccggtgat

SEQ ID NO: 78128 - DNA, 44379 bp, Oryza sativa
  unsure (1)..(44379): unsure at all n locations
tgtatgtacatgatatttattaattattttttcattccgaattgtaattacattcctataggaaatctagactcttcttctaatatttatttttttttatttcgaggtttcactatttatatatttctatatgaactctgaactcttcttttaatatttcttatctttttaatcctgaattttagttatttttaagttgtatttctacaaggactcttgacttttctttcatttgttattatttttaatttcaaatttcagttattttaaaattatatttctatatggactatagactattctttcactattcctactttttaattctgaagagatgagctggctgcctggttgattaagcaagcttatgatgtactcaaagcttgagatgattagtatgtttctggacacatgcaaacgtgtgaaaggtcaaaggctcaaagcatgttatgttccgaactgttgataagctcgatatttaattaagatatactcatgtaagagccaagacatctgcaaaggtaccattaaaatagcatagcaaatgcaaaggtcaaaggtaagcttgtgtggattctgacattattgttttatggttggtataaatgtattctttttcagttaaacgattttttttagcacgggaaaaaaagaacgccatgtctcatgttaattatcatgagggtttctgtgcataagcatgcatgtaccactagtggaacagtataatttggaaaatcttttttacaatctttaacaagatagtttaatgtgttacttgtaactacaattacaaatcatctataactatcatgttctatattttaagcggattatttgctccacacttgaaaaaaaggtttgcaaaagaaaactttcatctaatagaccacttattttacaatatttatcaattatgtttctcataatatttaatttatccatataatcaagtagataatctataccaataattggctcgataataaaaatcaatagtagactttttcatgaaaaaaatcaatagcagacagcgtactcgctgataacaaggcgtatgtattgatttgctcgattttaaaatataacagtacagtctctcggaagtacttatatggatgaagaagtatgcgtgattgagataagtatacgctcgtgtatgtaaatgtttgcctttataccactctctctaaaataaataaatactagtagatcaatggctggatttcatgatcagaatctgacaaggtttcatggctgctttcggagaatgaaatgggcttttgtgctagcctgctaggtgtgcatccacctgtccatttgaccgtttcctgccactctggcaaggccccctttgaccaacaacagcttgcttcccctctctattattggataactgtggtttgcttcccttcccactacaggtccagaggagcttacctgctaatcacgacgccatgatttctaacagtccccattattgtgttgtgtttctttttcttttttttttgtgggtgtgatgaggaactgtctccgttattgtcatggacaatacagctcggtaatgatgatagtattatcagactaattaacatgtcaccagtgacaattactagctgagtttctgtgttgggggggtcctgtgtgctgtgattatgccaagagttgtcgtttgcctcctgccctcccaggctcccactggaaagtctattcgtctttggagacgacgtcttcttatttttatattttgctaaaagaatatttaaaagatggatcgatatatgatatagtattcgaatgtttaaattcaacttatatataagcagaaataagaataataattttgactctaaatgaaatcgaattcaaacttatatgtttatgacgtgatatattataatgtatcttctccgtttcaaaatataagatattttgaacggtagaagtgttacatctatttaaaatcccttatatttttggatcgattggagtattaatttaccttactaattttattaaaagaatttagtattatttttaaacgtcatgcataagacaagtgacaaaaacccacctctgtttcagacaacctgttaaaaatccagacgaccagacgtgattgagcaattcgcatcacatcactcgtcgagtcatagcagcctgatgatccaggacgccacagggaagaacccaagaagccaacgtggtagcaaaggcggccggacacgtggccgtgcacggcacgagggcacagggcaaacggcacagcgaccgggctggcacgcggcgtgaggagaggcgttagcatgcgtgttcgtcgccggcggccggggaaaacgtcggcgacaggtcactcacactcacaggtgactgctgctgatacgagtgatcaccgtctctgggagatttggacttgggtaaagtcagggcatgaattgtcggcccatcgtttccggagaatgggccgtttagttcgggaaatgaaaatttttagatgtcacatcggatatttgaccgaatattgaaaggggttttcgaacacaaatgaaaaaactaattttataactcgcatgaaaaccgcgagacgaaccttttgagcataattcatccgtcattagcacatgtgggttattatagcacttatggctaatcatggattaattacgctcaaaagattcgtcttgcgatttcccccttaactgtgtaattagtttttattttaatctatatttaatactccatgcatacatctaaaaaatcgatgtgatgtttttgggaaaaacttttgggaactaaacgggaccttatgggcccaaacttttttgatatcatcgttttaggcgagacaaatttattaaacctaattaattcattattagcaaatatttactgtaataccacattgtcaaatcattcagcaattaggcttaaaagattcatctagcaaattagtcgcaatttgtgcaattagttatttttttagcctatatttcatacttcatgcaggtgttcaaacgttcgatgtgacatagtgaaaaattttggagtgggatctaaatagggcctatatctaacattgtggttaaggatgtaaagggggtgtttagattcaggggtgtaaagttttggtgtgtcacatcaggtattatatagggtgtcgcatggggtgttcgggcactaataaaaatactaattatagaatctgtcagtaaacagtgagataaatttattaagcctaattattccgtcattagcaaatgtttactgtaatcgcatgctgtcaaatcatagagcaattaggtttaaaatattcgtctcgcaaattagttgcaatctgtgtactccctccgtcccataatattataatctaggactggatgggatgtttcatagttcaatgaatctggatatgcatctgtccagattcgttgtactataaaacgtcctatccagtcctaggttttaatattatgggacggagggagtaattagttatttgagtaaagtgtacgggcgatccttaaacttgtagaggtgtgtcatctaggtccctaaactctcaaaatgcatatccaagtcccagaacttgtcataatgtgtcatctaggtctcaaatcgccacaaccccttcaggatgctacgtggcgttgatgtggcatgccacacggatatgacgtggtattattttgactgacagataggatcaatttaattttttttccttttttcttctctttttccctttcttctctttctctctttctttgtgatccgtgcagaagaaatggaaaaaaagaagaatgaaaagaaaatgaaaaagaaaaagaaaagaagaaaaaaaagagaaaagtacacgtcacgtccatgtggtattgccacatcagcgccacgtagtattctagaggggatgtgtcaatttaggaccaaaataatacactttgacaagttctggtacctgaatatgcattttgaaagtttagggacttatatgacacaatcctacaagtttaaggatcaccaatgcactttactctagttattttttttagcctatatttaatactttacgtaggtgttcaaattttagggtggaatctaaaccgatgctaattcaaactcaacgtcaacagctaagaatcgtgttctgaacacacagcaggctcacgtaggccacgccacctcaccctgttgaccgagtcaaaccaagcggaagcttccaccgcaaggagccgcggcccacttatagcccacggataaaatcccccgcaactcgcgcacagcccgcccggcctgtctagcgcctcgactccattcaactcgcgcaaaaccgcggcccgccttggccttgtgcggcggcgaccatggccgccgccgcctcctcctcctcgccgccggggaccgcctccccggtgctcagcgtgcggatcgtctccctcgactactacatggcgccgcccctccccggattcgacttctcctacagccacttccacggtgcatttcccttcccccctctcttctccacccgcctctctcgacctccggctcgcccccctttgttccgtctctgtaccgcgcgcatgtcgagtggctgatgagttttgggtgtgtgtgtgtgtgtggatgtaggcggagaggtggaggaggtgccggtgatcaggatctacggctccacccccgcggggcagaagacttgcctccacatccatcgggtgcgtatgaccagcttctctgatgattttttgtttgtttgttcattcgtacttggaattagctaatttcgctcgtcatttttgattcaagacttcaaccgagtctgcgtgtgtttgatgctttgagcgtgagtgtgagtgacgctgtgaggctgtaacacatttgtgtaattgtgtttgcgggttggtagccatccgcagcaagtagtcctcctcatgtattatacagtattcgtgtacaacaattgatgctcgtggcctttgctgtctggattcaaatttgaaaatttggagggaaatgtgtcaatgtgcttatcctcactgtacgcgcaccaaattcgaagtttggagctccaatttcacttttgaagtcctcttatcctggatgagcttaaccttagttctctactccatatatttgatgtttgcttgtattatatgcaatatttaatactgtgtgcaatcattttttcttttgagtttggatatacacacgatgattagctctatcatatttcgaatttgtgttgttgaatgaatacagatatacttgattttctcatcttgcttttccccagaaagttattcagactattccattcatccttagttgttccaactagttgtttttcttttctgtatctaggtccttccatttctgtatgtaccttgcaaagaggaccttcttcataacgtcgaaaaaggtgattcattctttgtaatgcatcatgtacatgctattactgttgcttgtgcaatttgttacatggattattctatttggaattgtaccaatgattttctatccacattacctgaaactttttttctgatgattttcatatccacattagtacatcaccagaaactttaaattgcttgttatttatttatttatttattcatcttctaactgagtcttactgctatgtcacaaactttttagacactaattcctcttatccaccattgcaatttttatgaacttgatttatgatttgaaaggttacttcatatgtccaaagcttggccttgtatgcatctgcaacacatttagataatttagacagtatgctgaatcctttgtatgtgtctgtgccttggtgagcatctcttagattttattctggccaaaagggcagctgtgtctagaaatcaaacaggccttactttttctaaccaaatagcctaaatgtgttatttgctttaaatgttggtattgatgctccctgattaactgttgcttttaatgtcaagaacatcgcttgatgacaaggatgaattgttgactcttttgtgccctttctctaggtaattcatttatatctggtctattgagtgatcttgagaaagctttgcaggtattttgaagtccaattatttttttatggtatgaataccctgttgtattttttgatatcatcgtttttcttacagattcgcagctcatcaaaaaagaagcatgtgcatggatgtacccttgttcgagcaaaaaagttgtatggctatcatacatctgaggaactttttgtgaagatttatttgtatccataatttaattattttttaagaaaatatatttgctgctatggatgtttgaaccagttctagattatttgttctttccttctcacctagtctttccatgaacatattccatatatttatttataaatcaaaactaaacaaaatatttactgaaaacttggaagaagtgatactgagttcagttgtggaacaatttctattcagttgtgatactatgttattgcatccactgtttcttttgctgcacaatttctgtctatctgtgttcatcctgaaagattatattaggtgcatataaatcagttgatgctgtactttaagcgttgcttgccatacacatagatttgagattttataataaatgcatgccagtattttgtttccttctataagacttctccgtacaactgattgccttgatataatctgaagatattatcctcatgaagtttctcgagctgcagcccatctattggtatgttgaccccttctgcttaatttacgaccctagtattttccagtagctaaacatgtctgacaggaggaatatagctgtgatacctacttctagatttttgtttctttaatctcactacttttttggcaatggtactttgttttgttactcgctctattcctttttcattgttattgtttatttttcactgtctccgagttacaatttgggcattctctttcatagttttacatcaaagtatatcaataacattataatattacagcagtgcattgattctcactgttgcatatgcgtgttgctttattttcatgatttgaagctgtaaattcattttcccaagcaacctgaaacttggctactaaacagttattccatctgggatataatctgtcctttatacagattgtcactgttttaatttgaaattgtgcagttcatcttgtgaccttccttgtaaatacactttattcttctcaaatgggagtattttaaactatttcctgtggtcctgattttgagctgcttggtttcaggatggtgctgttcttaatagagtattccaaccttatgagtcccacattccatatcttcttcactttttggtgagagcaatgctttcttttttgttttacaatatttcattttgtctctttcgcacaatcatagagtcttaatataataaataccacagtcttgcttttatgatactccctctgtccacaaatataagtgtttttggttggatgtgacacatcctaatacatcgaatctggacagagagtgtccagattcgttgtactaggatacgtcacatccgggcaaagcccttatatttgtggacagagggagtatgtagtatattgatatttgagcggctggagatgaccatttctgttgaacttatattttagattgactacaacttgtatggaatgggctatgtacatgttacagacttcaagttccgccctccattgccagatgattttcatccaaagtcatctcttcacagcaaggtggactgctccactgaatcagggcataaggtaagtattatttccattagtctttgttggttgatactttggtccactgcttctacttaatatatcctgcctcttttccttaaaaatgataggtacatccggataatgtcgcaattagaaaaccgacaatctggatatcttcaacagtaccacattctttaatactggctagttcagccacttcccattgcatggaaggaacaaattggaacgtcactaatcgacatagttctttgatgcttgaagctgactcgagaatagaaggtccaatggcacaatgacactaacagcttttttttattgtgtatctatgtgttgcactaacaatttcattggcatgtctaggcatcctaaatgaaaagtataagatgtacacttccctttcacaagctacagcagatagcaaaatagttcggtcacttttatcaatttgggaggtatctttcctgctttgtctatatgcatatatgctagaaaatgtgctaattgcctaacctctgcaatatctgttttgttcaggaactcgagcacttaagattgttggaggaagcaaaacctgttgatatgggcagacctttgcgggattctgttcttagaagttttcttcatggaattaaatatgagactgccctttctatgctatgtccaaaggaggaagtgtcctatcacagagttccaaccatggaagaatctgaaaagctcgaagaatgcttaaaatcattgaatgatattattgggactatcacattttcacagaatgactactgttctattattgatagtgatatttctgcgggcactcaacaggagaaccagatcacaaatgttctgtgtttagagccatcggaagagggaaacactcagtgcccagtgtcatcatctgctgctcaaagaacatcatctcaattatttgaagaacatgaaaaggtaatatatataccatatatcttagttatttggttagtacttgcttcaaataaaagcaattttgctcaaagtacttactattgagtccatttgtaatttaacttgaggtgtatcaattacaaatatggttaaatcaattttcctttataccataaagtgtatttaaaatagtttcaagctgaagacctgcatggtttagttgctgaatcttggtcactgataaaatacatgatgaacaccctgattacatcaaacaaaaccattacatagccacacttgagatggtggcacgaagatatcactgggtctgaaagggcacagatagatgcttcaggatatgacgatccatagacatattctctgatcctgtcaatcattttacatgctgatctttgattggctggagatttccattctggtattaggtatatgtcatctttctgcattgcataatatttttttttctatttgggtgcaattattacctattcttgattaattcagatcctctaatctcctgtaattttttcgtttgtagcttgtggatgctgaagctcttggccttctaagctggctggcctcctcacaagctgcagaagaaccaacaactgatgatgagttggtcaatgaagccattcttagccctttattttccaagaagtccattgcagttgccttagagtctgcacagctggattttgatggtgcttctcagcaggagtgccaggatattcttgattcaattggacctgtgattggagaagaacaaccaaatgatcaaatgtcctaccgcagttctgtaaggctcggtgagagtagttccctgagcaatagtattccgcagattgatgggtcatctgatgaaaacaaggaagttccacaagaagatggtaagtataaaatcgacaggaaaagggctggattgcctagttattcatctcctcaaagtagttcaaaagccagtaagcgtggaggaaatgaacttctctggggctctttgccactttccattaaaaagagatcagatttgaatgctgatggtcattcaggtggtgcgatgcctactgagaaggtgctaagtgcttctttcatgagtggaactggaaagaactcccatgctaacccagataacactgagaggggatcttctagtccaacaggtgaacatgacccattgtgtgattctgtgagagatttgatgaggaggaggaggagatcttttcggtctgaacaatcagaagttggtaattctggagatgcagcatacatcgttcgtaaagagaatgaaattgtgaattctgagcgactagaattgcatgatatatccagtgacctttcaaattcagaaatgtattattctggcagtgaatatttgcagatgacctttgcacggaagcctccaatgaagaatgaagtattatgtttggagggctcttcagcaggtagtgagctgcctcaatgtaagttccacaagtgatatttattttatcatggtcaatgtaagttccataagtgatctttattttatcatggtgaatgcaattcatttgatgcatatagtcgttgcttgtgtgatattagctttgatgttgtttttacccatccaatatataaataattgtgttagtgcctacggtatgattatgtaacagatgttcattgttttctttcagtttttctagcattaggcttttaggtccattgccatttgcatagctcattattgtttcccctctggaacagtttggactaccaaccattataccagcatgaaatatttgcgtgtatgcaaaagaccattattcatgtaaccctataccaataatgaattatatttttatctgttgatattcacactattactcatcagggttcagtaaagatgttggtttatcatgtctcaaagcatcatttctttttcctggttttagttcctcactgcggatcttgtgcctttgagagccttgcaggaaaataggagttatgggttgtcatactcatatgtgtctcagtgaaacaaaattgccggaaatctgtagttctgtgaaataggttaccaaatctgtagttccttgatagttatgaaatttttttaggggaatatgacttatgacactagttatatgcgtgtagctactcaggaagtgtaggatattagcatggcatgggttttagggaccgtcctacttaatacaagacatattatgttgccttactataggtacaatgctattctgttaaaacttaaatctttcttggattttctggtatcattatttacttaatatcatttaaagcacattgtattttttttttgttaatccacattcgttctgctatttttcagcttccaaactgggatttgccgatatccctccgttttttaatcagaccgctgaagagaataagcagaatgaatcatttcaacgcatgggaagttcatgggatacattgggtgttccaactcatttccaaaatgatggatcagccttatatttgctgacacatgcattttcgccaccatccactgtagccgtgggccagtggctaacccaacaatcttgttctgttagtgtctctggtataggtaagttcctgtgcaaatcaatttaacaactatgtattgatgtcctcatactctctgttattttaggtcattccaactatggcgagaaagtgtctgttgatcaggaaggagcaaacaattctactctttcaccatatatgggaggtcctgctttgatggatgattctcctgcatctaaaatggctttggagcatagcattacgacatttcctgatgatacagttatgatagaaccagatctttccaaccaagaaattaaaaatctggctgattggcatgacttttcccagatctctggtggagatgagaaggataaacttacacctctcagtcaaattggattctgtgatcctgctagtattggtggcggacagcaactgactataattagcatagaggttgtaccacattcttttttcttttgttcccgacgtatatgtttctttttgttcactcttcatacaatgtaggtgctaatttacttttcttttttagaaatatctatgtctgcaaccagtaggagtttttttttttttggttattaatcatgccagtttgacttgctctatccagtgaaaagaaatatgcaaagttggattaccacataacatttctttcatagctacaggtaataacagaaagcagaggagagctgcgtcctgatccacgatttgatgccatcaatgctgtatcgctggccgttgaggatgatgctgacaatactattgaagttcatgtgcttatacgtggaaacaatgacagttcacacaggaggaggttgtgcgaaatcactcgatcttggaattgtttgttgttttacttttccatttcatcttgttttggcactaatcagtcccttcttaatttttgtttttgtcaatcaacaccactatctcttaataagtctacagaatctcaagaaattgaactgtcctaatcagaagagttgtgtacttgtgttaaacgtgaaatccagtacattagtatgtcagtcgtaatcctagttcaacaagagaggtttgcaagaacactgagtgactatggtggtgactgccacagtggcagtggcaactgatgtcatatttgatgagggtacactgatttggatcactatcttatttatgagtgttaaggatttgatataatgccatcagaaacacatttgttgcttccatgtgatgggcctatcatatgtgctgaccatatcctatgcttctggacttcaagaacaccatactactttgggttcttttgtttaggattttttcgatcgtaaaccacatgcactttcactgttttagagttacaccctcatgtaaccataattgtttgctttcagctaaggaacttgtttgattcttttttgagggctgtaagagtttagcttgttcaattgagatgtctttagtgtcctttttttcttgtaactgcagaaacctggatggagtttccggttgtgacgtaaatgtatttcctggagagagggaacttttgaaccatcttattaatgcaatatgttcaattgatccagatattatagttggatgggagattcagttaggatctttaggattccttgctgaaagagctgctcatctgggtataggcttactgaaaagaatttcaaggacaccaccgcatcagatgaaacatccacctatgaacccagtggacgaatctagtcaggagcttcctggagcatcttcagctgatgatgttattgatgatgccagtgaaaacaattggagtcatgctcatgctagtggtatacatgttgatggacgaatcatactgaacttatggcgtctcatgcgtgcagaagttaaacttaataattactccctcgaggctgtagctaatgaagtcttgaggaggaaggtaccattagtaccaactaagatattgaatcgatggtttgcaacaggttctggacgaggaagatatcgatgcatagaatatgttaataagagatcttctctcaaccttgaaatattaaatcaacttgacctggtaaatggaatccccacatttatcttgctggtacatcgtcaagatagagctatttgagattctttgtattttagttgaaatcttttatcaattttgcaacttctccttaacaagctcctagccatgatttatcattacagaaatggagttggttttgttgaaatttcttgcacaagctactgctaaatgttcttctatagccagtttttctcaacaaatattacttgaccatgcaggtaaaccggacatctgaacttgcccgtgtatttggtattgatttcttctctgttctttctcgaggttctcagtttcgtgttgaatctatgctcttgagattggttcatacacaaaactaccttgcaatttcccctggaaatcaacaggtgaaatcactccctccttaccatgctaagatctctctatctgcttcagatatatagtttctcatttgcatttaccacaaattatgtaacatgtactagagatggtgttatggattctactggcaagtgacaagcttgtatatcactacatgatatctctgtgccaaagatggccattttgctctgtggtcagcagggatccaaagaagttacattttgtgtgtaacaaggaaaaaaaagataattaggacatcttttaagattttgatgggactgctcttttaagcaccatgaaaatttaatttccatgtcgggctccttgttttataaatctgtttatcttctggttagttactcacataaagttagaaaattggattttttttttctttgctaaaaaataattaaatatgaatgcataaaatattgatgccagtattttaagtgttcttatgtgcaacttcgcaggttgcttctcagccagccatggaatgcttgccacttgtaatggaaccagagtcagctttctactctgacccagttgttgtattggattttcaatccctttatccctccatgataatagcatataacttatgttattccacatgcttgggtaaagttttcccgtcaaagtcaagtgtacttggtgtcagctcatattcagcagatccacagaaaattgctgacctgaaaaatcagctgctgctgactccaaatggtgtcctgtacgtgcaacctgaggtaatgttcttcttgggtgagctatactgttaccaagcattacggttacaggttttctttatagttgttgtagtacatgcctagcatcattgttgataattgtatcaggtctcatttggatggaccgaaatcccagcctatccacattgggattgtccttttgttctatcagctggattatcagctgtattctggaaagtattgcttagagttgcacttaactgcgatttgatgccctccatttttctgcatatacagcatcccttcgttttgttaggtcttatgctgaactgtccttttgaacacatttttaatgtcattttacaggtcaggaaaggtgtgcttcctcgccttctcgaagagatactatcaacaagaattatggtgaagaaagcaatgaaaaagctgtctgcatctcagaaggttctgcagcgggtattcacttctaaactattttttaagacctctatccatataatattaaagcgtcttattagaagttgatttaatatgtgtattctatatagtgcagtaagctctttcattttaatgcactgtgcttagacagcaatcatgtttctttccctttcatgtccctccttttggggtaaaagaacctttactggctttatcatgttacaaaatgaatagtcttcttttttcagatttttaatgcacgccaacttgctctgaagctgatagctaatgtaacatatggttacacagctgctggattcagtggtcgtatgccctgtgcagagattgcagacagcattgttcagtgtggccgtagaacacttgaaacagctatatcattcgttaaccagcaccctttgtggaaagctagagttgtatatggtgatactgacaggtatacttgtgtctttatcttctatcttcaaatcgttatgtagccatacttacaaacccacctgtttcctatagcatgtttgttcttctaaaagggcgctctagggaagaagcatttcgaataggaaaggagatcgcctcttcaataactgcaatgaatccggatccagtcacattgaagtttgagaaagtctatcacccatgttttcttcttacgaaaaaaagatatgttgggtatagctacgagagtcctgaacagaaagagcccatctttgatgcaaagggaattgaaacagtgcggagagatacatgcccagcagttgcaaagattttagagcaatctattagaataatgtttgaagaacaagacttagccaaagtaaggcgtgcttcttgatcttctctttgcaaggactactttctttggattgtcaaatttggccttcccgccatctgtcaggctatggcttgatagccttttatcttgcaggttaggtcatatttggagcgtcaatggacacggatactatcagggaaaatttctattcaagatttcgtttttgctaaggaggttcgcctaggtacttatagtgcaagggcttcctcgctgccacccgcagcaattgttgcaacaaaagcaattctatctgatcctagggcagaacctcgctatggggagagagtgccatatgttgtaatccatggagaaccaggtgctcggcttgtagatatggttattgatccttatggcctgctagaagttggatctccatatagattaaatgcactatattacataaccaaacagataatccctgcattgcaacgtgtttttggactcgttggtgctgacctgaataagtggtttaatgagatgcctcgcccaataagggaaacacttgctaaacgacagtcagcatctggtcatggtagctttagccgattaggattgaataagaaaggggttggcaaaggaagcaggatagatacttactatatgtcaagccactgtataatttgtggtgaaataattcaaggatcagacacattttgcaacaactgcttgagaaatgaagctgttgtcggcacaatagttgctggcagaacttccaaattggagcgggaaattcagcatcttgctgctgtaagttcatatttctttgataattgtgccaaacaaatgcttgtggtataccctcctacctagttccacaaacataatagcatcttaacttttgtttacataactgtttacctgattacacatacattcggggaggatgaaatcattgcaggaaaaactaaaattcatttatgttctcacttttatgcacaccaatatatgttggttcttaatagattcattcatgaagtttctgtgtaacaacctcacaagaattgaacatcagaaataatgaaattcctccactttcttttggaatatacttactctattttaactgctgcagacttgcacaatttttttatctttactgttcatagagcagatagccttgagataagctgtttcagatgaactgacagtaaaactcgttaacattgcccagatatgtggtcactgcggaggggcagattggattgttgaaagtgggatcaagtgcatttcccttgcatgcccagtgttctttgagcggagaaagattcaaagggagttgaggggtgtttcagaatcagcaatagaagctgggtattatcccttctgttgtccagaactcttctgaatttgcttttttttttgttcatatccctgtatatgctgtaaatttgtaacatgtacaatcaagtgtatttattttgttgtaacattgtacaattgtataacatgtgttgagcaaagaaatttaatgtataataatgcaaatcctcgagggaatttggacagagtccttcgctgtttgttggtgcttcagtctggaccatccccccccccctatgtccctatgctcttcctcgtcacgcagctttattcagcaggtaataattaattatagttgttattcagcagttctctaggaagtccggttttctgatatcattattcagcaggtaataattaattatagttgttattcaacagttctctaagaagtccggtttcattttgacaggcagagatagaaaatcggttggcttgtttgtgttatctttctgatatcattttactggtttcattttggcaggcagagatagaaaatcggttggcttgtttgtgttatctttctgatatcattattcagaaggtaataattaattatagttgttattcaacagttctctaggaagtccggtttcattttgacaggcagagatagaaaatcggttggcttgtttgtgttatctttctgatatcattttactggtttcattttggcaggcagagatagaaaatcggttggcttgtttgtgttatctttctgatatcattttactgaattgtggatggtcaggtcatagggatcaagggccagaggctccagattgtttgtgtaatcgtgttatctttctgacatttttaccgaagtatggatggttaggttgcctttacataatacaggaccagaagctccagctcttacagagcaaggcgcaaccagccatgcaccactggaacgtcgtctatgggggccaaggcactcgatattggtaaagaatcgaatgagctctcattgaacggtaggggatttactgaatcattgatgctcagatcaggaacagaagctgcagatcgtgtagagcaatgtgcagaacagtcatgcaatactggaactactacattggtaagaatcgagtgagttctccttgaacgggcaaatgaccagataaactttgacaaacattgacggcaactgttatgcaatgtgaaatgcagcaggagaaacgctccaaggaggttcagtttgattccatgacataacagtggagcttaattcataaaggtaccgactcttttatttcagtttagaaaggcacaactcatcattatttaagttccatgctgtagtgtacaaaagttcattgcatggaaggctaataactaaactataactagattattgctcgtagtagacaatgatagaatgcacattccgtttccaaaggcgtgctaggctttattcctagaactatgaacagcaccacggcaccatctatagagcagcttggaacagaatctcagccagttcctgtattgagaaatcacatgaaagcaaagttaaaaatgagcaatcatcaacccaaagatatttctattatactatgaagttaaatgcgtatattataattccagttacctgcttgccagatggaacaatgggttcaccccactccagaaccttcttctctagtgtctcgaagtctcctttcccagcctatttgaaaccatgagccaattgttactgtttcaattcaatcatccaagtgtaagaaagcaagagctctaaagtagttgaacattgtacctcaatcaaggcaccgatctcactatcaaaactctggtagcgcttgcgaacaagctcatccagggaaccatcctaacagcagaaagagataaaaagattacatctagatccctgaataaaaactttagaaggctgtaatgttccagttacctcgatcagcttgacaacattccgaaggccgcgggctagggtgtccattcccgatatatgagccagaaacatgtcctcaacatcagtactctccctcctcctgttgacataatagaattccaagtcaattgaaattcagttgaatcagagaccaatttacacacacacaaaaaaaaaaaacaatgtcagcgggaaccaacaatttggcatcaaagttgaatccaccaggtgcaagcccaccctacaaccatatcaaaacattacaactcatgaatagtatcatattgataattacctgaatatatcaaggcaacatattattaattcaactcacattcttaaccacacttgacataaccaaagtagcctctgaaatatctgtaaggaactgatcggtgtcccaacctgtccatatatataagcattgaaatgttatatcctatgtatgtcacaaatcgaaatcaaacaagaatttcaggcataatgtgactttcaggagctaaaggcatgcgcacataccgatctggggatcaccagtgttggcatcaatattcccaagcagaccattaattcttgcagtctcaagctcatggtggcagctgcaaattttccatggagttatgacactgccactgtaagctaccttgaatgacgttagggaagcaagaaactaacctatgtccagatagagtagcgtggttgcattcaacatttatcttgaattctcctgtatatggtgaaaaagaatgtactttagattatttcacaatacacggttaactccagacagacagcagtaaataaaattgttcaaaacactaatggtgttaatacatgaattcctgaaatccaaataacagttcaactttcgaaatcactgtaaacccaataacaaactacatatgtacctgttagaccatatttctgtaggaaagagaatgtggttgcaacatcccaatcgtacctgggagaggacaaacaagggttaggattgtttaatcctgtggacattttgttaatgtaaactaataagcatactggtgttttgtgggttcttgtggtttaggctctatcaagagtgttcctgaaaaataaaaacaaaattcagtattatatccatgtcatacatggaaaaatgtgatatagcagtgacatgtgagtaccattaaatccaatcttcttcttgtagtcaactgcagcttgaagaaaactagcctggatgacaacacggcaaaatgataaatcaaaatggagataaagtgagtggtagtaagtgtaacagaaacagaggaacagtaacaatatgtcaagactcataccaaatggtcaagttctctcttcatgtcagtattaagaagagtttggtaaccctctcttcctccccagaaaacatagttttcaccgcctaggtagtgggtgaccttcaagtggtaaaagccaaatcaagaattgacttatggaaaacctatcacaatgttcagagttcaaagataacccacctctaaagctttcttaacttgagcagcaccataagcatacactttaacctctgggctgcagtaccaatgaaggcttctattagcttcagaacatactccaaatttacatgcaaaatgcagcaaaactgatctacctagtagcagcaccgtgcatgtagcgcgggtgcatgaaaagctgtgcagtcccccacagtggttttatattggtctcctcctgcatgaagttcagatcatatctgagcaaagagcagaaccaatgcatttcgacaaaatgctaacaattttaaggttgcagaaatgtaacctggagtttctttgccagttcaactatctcatccaaatttttatttgtttcctgcaatgtgaaacaagaagcttataaaataccagaccttccactggtggccagagctacatcacacagaaacccagaaattccaaaaatttaacagaaatattccacaggagtaaaacacatcttcaaaagtaaataagaccaaataaaattccaaaaatttaacagaaatattccacaggagtaaagcacatcttgaaaagtacataagaccaaatattatgtgttgttctgaaggtatattcagatataaaggattggagcttttccaatatctaaaatagttttaattaaatagatgattaaaatagttactctgttaaccaagggtaggcatgataaatagctatagcctcgagcttcacaagttcaaaccacattcgaagacaaataataagactattatgcatgaaggcataccgtgagtgttttgccatcaggggcaatatccctgtcatggaagcaccacctgtcaactccaagcttctccatgaactcaaagtgagctctcactgcaataacaattcagacagaagttgttgattaagcaaacgtgcaaattcataatgaactgaacctaaacatgaaaccaggtaatagccatacttcttctcttagccatgtccaacgaatttgtgccatcctcccaaggccaagactttgtaggggcaccaaaaggatctcctccagtaccacggaacgtatgccaaaaggccacgctgaaccgcatccaatcctaaacgcaagcagataaaatacaaaactcagatgtattccatgacgcaaaagggaataaaaggatctgttcaacaagacataattcataaaccctaccttcatcttcttcccaagaatcacttcctcagcattgtaccacttgtaagcaagcgggttcttgctgcttggaccctgcagtgcaattgtgcaacaaagtcttagctcacaagtcacagcagttttagtccaatatataacaatctaaaaatttctaagctttatcaagtaatctaatcaaagagtcacagcagttatagtccaatacaataatataaatttccaagctttatccaataatctaatcaaagctgtaagctttcatggcctccctcacctcatacttgatcttggggatgccagggaagaactccccttcccaatcccctgaagcagcatcaccacacttgctatcgaggtcggccggacaggtttgctgcgtagcgatctgcaaccacaacacagaactgaattacaaccacaaccagaccacatttccaccgtagaaatcaaacatcactaactagtcaggatcacttaccgcagcagatagacatagagatgaggccaccagtaagagcaaaagctttgcccccatcatggcagcagcaggaccagcagcggagcggcgggcctgaagagcagcaaacaaatcagtaaccacagtgaattgacgagtgagagagaaataaataaaagaccagccagaaagtttccgatttgattgcgcacagtaaataaataaaagatcaaagattgaagaactcccaaactaatccaaaccaggtggagtcagtccatcgcccacacaaaaatcaatcgaaatccacaagaaatctccaatctgcgaggagaggatacctgcagcggcggcggcggagggggacgatgaatgggggaggagaggagaggagaggtaatcgcgagggggatgaggaggaggaggagaggaggagggcttaaggagggcgatgtggctggtggtagttgtcgtccctactccggcggtgggtgacgtcactttatttggatttatcctatccatggaccaatgatatactggtatatagtactattatttcattatctttttcgttagattaggacgagactatcgcgcgtgaaaccattatataggccgaagggcaagagattctcgtgaaatcacttgacgcaccgacgaaacgaaacggcagcgactccatatctaatctgtttttgttctgttctggtgtatctaatctgctagtaagaaaattttaatacgtgtagcattgctcccggtaatgtatttcggcgaggctaagcatggcgccatagcgtggtgtactggactctctctctctcttgataagaatcacaactgaaacgtactcctacctttcaactttcatccctcccagataaagcagataaacttctcttcagataaagatttactaccgtgtcaaatttcactaaaactgaattttaaattttaaaacttaaatttaggatttttatgttgcagtttgtttttcttttaacattagcctttgaactgtgaattatacgtatataaaagtttaatctaatttatttttggttgctcatgtgtcgttttatggcttattgtaaaccaaacgatgattctgcaattaatttctagtactatcaatttggattttttttctcaccgtaccattattgttgctacaggtgtcagtcgacacaagaagaacggaactctcaagctgatgacgcatcgcctgccgcacgatctggaaatggacggtccagatcgcacgccactcatcttatccgctcggctcaaggagaaccaaaaaagaaaaaaaaaaagaaaaatctcgctcagctcaaacagccacgaaatggcgccggccgtcgccgtcgtcgccgccgccgccgccttccccttccgcctcttctccgccgaggctcgccgaaacaccaagggctcccggagcaagcgaggctcagccaggcccctcaagccatcccctcctccccgcccatccgcgtcgtcgtccgccgctggcggcggcggcgccaccaccttcaccaggctgccgctccgcaacgcccccgcgtccgtggaggtgacgctggaccgcttccccaccgccaatcccgagcccagagcttccacttttactcgccggaatggcgagcggttgggcgacgacgaggaggatgaggaggaggaggaggatgaggtggagctcggactccgtggggccaccacgtttgctcggctccctctgcgggactcgccggacggcggtgacctcaccattgggcacccccangngggggggcccctcaagagggcntgaggagtcgcgccatttctggtcaattggtcgaacaccttgccaccgtaaagnagaagaagtaggagcaggtgggtttcccccaaancccccagcttggacatcttcgagggagcaaagggcagggaagctcgggctttcttacccgacgaggacgacgaggacgacgacgtcgtggtgttcgacccagagtacgacggctacagcgacgacgaggagttcgtcgctactgctgtcgagcagagtccacgaggcgacgccatcgcagttgcggagcttgaaaagctcaaatacgacaatgacgacgacgacgacgacgacgacgaggttgtcgtgttccacccagacgacgacgaggaagtcgacgtgttcgaggactacgacgacgacgaggaggaggagacgaaggagaagggtgtccccgccgtgatgcggtgcttcgacacggcgaagatatacgccaaggccggcgacggcgggaacggcgtggtggcattccggcgagagaagtacgtgccgctgggagggccctcgggcggcgacggcggccgcggcgggaacgtgttcgtggaggtggacggcgacatgaactcgctgctgccgttccgcaagtcggtgcacttccgcgccggccgcggcgcgcacggccagggcaggcagcaggccggagccaagggcgacgacgtcgtcgtgaaggtgccgccggggacggtggtgcggtccgccgccggcgacgtggagctgctcgagctgatgaggcccgggcagcgcgcgctgcttctccccggcggccgcggcggccgcggcaatgccgcattcaagtccggcacaaataaggcgccaaggattgcagagaaaggggagaaaggtccagaaatgtatgctctcttcttcactccattgaaaagattgttcatgctttttttttttagttagctatggagtgagcttttgacatgatttcccatgttaaattagccatttagcttacacaaatgttagttcaggtttagattgtattgcttgatatacaagttttctttctttgacttacattagctgcattttgggatgattggtggttgttaggtggatagatttggagctgaagctggttgctgatgtggggattgtaggcgccccaaatgctggaaagagcacccttctgactgctattagtgcagcaaagccaactatagccaattacccttttacgacattattaccaaatcttggagtggtctcattggattttgatgctacaatggtagtcgcagaccttcctggattgctggaaggtgctcaccgtggatatggcttggggcatgagtttttaaggcatagtgagagatgttcagtgttggtatgttccttctctctttctctcctttctttaggatctactatgttttaagtccacatctcttatgtcatggttatcttatttctcctcgaatatatgatattagaaatgtatgtgcgatttattggttattgtttatttttctggtttgggtcttaggttcatgttgtcgacggctcaggagaacaacctgaatatgagtttgaggctgttcgtttagaactggagctatttagcccatcattggttgacaaaccttatatagtggtgtacaataagatggatcttccagaggcatcggaaagatggaataagtttcaggagaagctacaggctgaaggaattgagccctattgcatcagtgcaatgaataggcaaggaacagaggatgttgttcttgctgcatacaaggttctacagaaagataggcaaagaatgaaagatgacgaaggtatttctatagcctaaatttttctgtcaaattatagtgtactagtagctaataactgcctaactggtgctcaagcatggaagtgcactttaactgactatagctgttcgcaattttagattaaatgcatatgtgctactttcaccatctatgctaaagtagtgttcttactagcattcgttttacattatcgtggttaacacttacgcataacatttttgcgttttaagatgtttatcttactactgcatgtttctgcagaatggaatggccctgaaaatctgaatcatgtggctgatgcaataaaaagggaaaggagagctcccatgaacgaatttgagatttttcatgataagggcacgaatacatggaacgttgttggagctggaattgaacgttttgttcagatgactaattggcagtaagtagtttctttgtacagtgctcactcgttacactttggaagatcagtctcagaaagcgattttaagactgcattactggtcgtttatctaaattgacctcttttaagattactaattaagtaattgtaatatctgatctctttccaaatgcaggtattcagaatccttgaaacgatttcagcatgctttagaggcatgtggtgtcaacaaaactctaatcaaacgtggagttaaagagggagacacggtagttgttggtgaggtatatattcctatgtcataaacaaaacattggacagtcatcacacaaataaaattatcagatttctaagttaataatttctgcagatggaaatggtttggacagatgagcctagtaagaccaggtcatcaaagacaatgaactcaaaagatgactctgtcagatggcctgaatttggctagatcaaggctcaagcaatggttctgtgtcgcagcagaggcgattttcactgaaatgtttgcacatgcttacaataaaatgctgcactatgacaacaaaaaaactactagtcatcacaacagctagttacacccagcccaaataaaaggaatactattttgtgttaccttcagaatagtgatgtatcacacagcttcgcctacatgctttgaaagttggattatgcaggagtgctatgtactaccttttgtgatagtagatatttgtagatgagatttaggtattctaaaatgatgtacgaaatagtttcttcagcaagattgtataaatgttcacattgattattaatggcttatacgaccgaagaaagacaattgccgttgcatcgaaatctccaaaaagatttgatgtttgagtgaaccttgttcaacactttatactagcattacgaattcaaagattatgcatcaactatctctctcttacgatgcaaaagtaatttgttcccctcaattttctagtggagatagttttcgtccgtttctgatatgttttatttgctagctatgtgggtgtcccctatgcagttgtgctagcatgccatatagggccttaatttgagcttgcttgagtgtgttgagagagtgaatgagctcctccttttatagggctggtataacggttatcctaatgcgtaatgtcagttttgcccttgtaaccgtcgttgagaagtgatcctggatgtccacgtggagcgccgagctgagccgtagcagccagggtacctaggccggcccagcaggcctccagcatcggcagggtcactcacatgtgggtcctctaggcggttgtggcagttaatgtggtttccggacagttacacctgacttgtgggccctcttattcataagcttgctatgtgggtcctttaggcggttgtggcagttaaagcggtttacagacggttacacttgacttgtgggccctcttatccataaaattgcttaggagtgagtttttcttcattttctccttattttatttgataaattcctacaacatattattctccaagtacaagtggaattatattattctggaataaatatgcattgcaagcatagctaattctctattattttagttatattgacaatcgaagtttgtctgtaacgactgtcaacagtcaacaggagggattgacgacgtaggaaaggtggttcagttcgaaagtggattgaactagttagagttgttttaggtttagttttggaaataataattgttatatttaggccggtgcgtaattttcgttttctttttaggagataaatctctgggcggtcgaatcatgtttgaatcggactcagctagattagggatatatattacacggaccttataaggtatcttttgtatacaatttttcacgtgttgccacccttttcggcgagttcttagttttcgaacgaggctagatcggtttaatctccggtgaggaagtaagtttcttcaacttcgcttgtatcaacttaattaggattttctcagtctagtccaatattctaattaagttgctacaatcgtagcccatctaatatatcgactttttattggattgcatttcgaatttatttaaattttttgagcaaatataaaaagaattaagtcatgcttaaaaaatatttgatgatacatcaagccacaataaaacaaataataattatatatttttttaaataagatgaattgtcaaatttataaaaaaattacggagggagtattatatttgcccggtagttagaagcgacacaacgaccgcacgaaatgcatgttattgcgatgtacaggatggattttgttgcgcctcacgcgtacgtacgtacgtatgtgcatgtgtcggataggatcacaagctagcggcgattcggactatttcagcaagcagcgttggaacgataaatccgattccaaaaagaactccggccgactggacataaactactaatccgagtcggatatatctggctagatgagttataataaatagcttactatcagtcactaactctctgagtctgcaattgcaacagtacattgtttcgatcgtggccgacaagctacttgatcgccactttctgcaattggaacagtacattgttctcgatcgtgtccaacaatctgctcgatcgccatggccaccacgctgcagagctgtctcttttcgtgttcgccggcgacggcattgtcgatcaggaggagtccgcttacctcgccggccatctcgccggcggcgagccaacgtaattgctgcctcccaagactgaagacgacgacgcagtcctgcaggataacgacggccgcccgaccgcctctgacggcggtgcagtgccagaaaggcgacggcggcggcgcaccgccggcgccgccgcgacgaccatccgattatctgcaagaggagaaggagaaagtcttgaagcactaccgtgaaatcatctccatagatgatggttgtctggtaagtacatgtacacgtgcaataaatagttcaccattttaaatttctatgtgttatgagcaataaattaattgtgcagtaattttgatgatcttttggtgggaattaattaaatgcagtacgctgaggccacggagaagtcggcgggggtatgcctggcagcaaaggatgctctcgtcatggcttctcgtgtcatggtaactagtatggtggttcgtacagattgcgcggctagcatcattatattttctctcatataataacatatatgtcttctcaacatattatttaaatatattaaaatgacaacataattttaaattttgtactaactttacgaaactactaatgtgtaatattcatattgtattttatatacgtgttagttactaattatttttaatatcaaattttagttatttgtaaattatattcctatatgaactctagactcgtctttcaatatatttattttaattccgaattttcgttatctgtatttgtatatagactctaggctcttcttccaatattatttatttttaactttgaagttttattatttctaattgtttttttatgtagactctaaactcatctttcgatattctttaatttttaatttcgaatttcagttacttataaattatattcctgtattgactttagattcttcttctcatgtttttttttaaattccgaattttagttatttgtaaattgtatttttatacgaaccctaaactctacttttaattttattatatttattctgaattttagttagttttaaattttaaattcctatatggactctatactctacttctaatattccttatttttaattccgaatttctatcgtttctcaattgtatttctatatggactctagtctcctcttccaatattccttattttttaattccgaatttctattgtttctcaattgtatttctatatggactctagtctcctcttccaatattccttattttttaattccgaatttctattgtttcttaattgtatttctatatggactctatactctacttctaatattccttatttttaattccgaatttctattctttcttaattgtatttctatatggaatctatactctacttctaatattccttattttaaattccgaatttctattgtttctccattgtatttctatatggactctagtctcctcttctaatatttcctatttttttaattccgaattttacctatttctaaattgtatttctatgtgggctatgtttttatttttctccgattaatatgggaatttctaggccgtgagtgcgaacgtggagatttctttttctattcctttaataagttaatagagtaaccatctaattaaatattctactgtacctctcactaattactagtactagtattcttcttgattatgcaacacaactcttactctaattaacgtattgctttttccgaaaatttcagcatactgcggagctcaatctcgctgcgccaaacgaaacatctacagaaacagtccacagggtacgtaacgctcctactctagaattttttttttgttttgttgctacttccaccatttcttaatagattacattgttaacttttaaacataagaattaccatccattcaaaacaattatgtagatataaaaagtatatataaattatgtttaaattccctttaatcatgaaacaaattacaacaaaataattgataattatcttttttaaaagaataataaaatacatctaaaagtcaacgactttaattatatcttaaaatgatcgcaaaagcaggattaatatagctagcaaggtttagtcatgatcaattgactaggtggtgttcttttcttctgaagatgaagattaagtttttatgcaaaacgaggtggtattaacatataattgattgagttttaattattacaaacttgaaaaatagactaatatgatattttagagcaactttcatatagaaaattttagcacgaaacgcaccgtttagcagtttaaaaaacgtgccacgaaaatcttcatctaactcttagtttgagaaaagaacgggacctaagattctttttaactcttgtatataatgaacagactgtgaggatgtacgtgaacatcgtgatggcggccgcggacgactcgtacgatcggaaggtgagcaagaagacggtggagtcgtacctgcgagcgctgcgaggcctcgcggcggtgacccacgtcttgctggacgacgccctggaagccgtcagccacagggcgcccatggatagcctcgccgagtacgccttcaactccgacgtcaagcccttgtacgacgacttccaggccgagatgaacacgctcgtccacaagatcgacaaggccttggatccacacatatgcagggtatgtatatatgtaatgtacaacttggatttgttattatcgttgtgttttttttcgtcgataggttaacaattaattaacattttattattgttggtgctttggcagattgcagtgtgggtaatggcgagggcaacgcagattactgggacaattattggactcatggtgtctcgtcggaagagggcactagagaacgcacggagcaaaatggttgcagattcggcgacaatttgagatagctgatagtcatgggggattaagatagtagcctgaaatttttgttattttagtgcagatagtacggactattggcccatggcacaacagtcatcaaatgttttagtgttcgttttgtaattaaggcatgatgaaatctccgccttcaccaccgggttatgtgggctgtacgtgcctaattgtattcatcaaatgcatgatgttcctctatctagctcctttctagtgttgttgtgctaatcctgctgcccttcacctgatcaatgcagcatatttttatactaattagggcctttgaataccgtgaatagaataacagagaagtagaataaacacatgattatgttagaaatgcaatccagctaacaacagccctaacctaaccgatccgtttttctcttttttgaaatttttttatcctcgaaaaaaattgtacgtggttagctattttgtaaaaagctcctcacgtttacaccaaatattgtatacgtcctcaaaccgacagacatccggttatcacttatccataaaacatctcgtcttccaaaaaaaataaaacgtgaataagagaaaattttgcttctaggggtagcgttgtaaaaaaacataggggtttttctaaaaatacatcctaatctcaccccacaatactcaaaccctaccccattccctccccgtctccttcacctcagcgccattgccgcgctaccccgccatccgccatcccccgttgccgtcagtcgttcccccattgctgccgccacctccacctatcgtcacactactaggcgccgccgtcctcgccggcaaatccaaccacctgggggaaggagagggtcgcaagccattccctcatcctccgggagctccctagagcgctcctaggcacccatccgcgtgtacctccacgcgccgttgggcgccctctgctcgccaccgcacatggccccgtccccgcccaccacgcatgcgccatcgctaggagccatcatcgcctcctgcccaaggaggtgctgttgctcgatgcggttcagagcaaggcctacaggggcaggctcgccacggccgagtccgtgatgggtgtaagttcaagtgtcttaatttggttttggtgattaatgacaaatctaactatatgagactaatcatttttatgagcctttctttgactagtctcatttggatatgaaagtaaaaatgatgagcggtatgtattaaacttcaccatattctaacttggtctctcttgtggatccaaaatatagcgtgagcttcctatttgatctttattgattatgtgcatatgcgttccttcatatccatatgtatgcacatcttgagggggagtttattctatattttgtttattataagatttctatcttgatttgaaatcatttttcatctcatatctctatattgtttatatcgggttattatccatcaccaaagagagaaaagattgaaagatcttggattaaacaatttgtgtaattgttactttggtgatagatgataaaccgatgtttatgggattaacctctcttttgcataagttgtctactaggttatttcccgataataagatgtggaagacatgcattcttttgtgatggaccttaatcatgacaaggatgaaatgcatggagataaaacgatatgtaccacttcttatctcctactttttgataggttcatatatatgatttccatgctattgatatataagtgtgagactaatgtttactcgaatgttatcttatttagtctcatttacattgagaacatggagatcatgaaggtatatgttttatgttggtctacatcattactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatattggatatttgcacttgagcttgcatacgagtatatgacacttgtgatgttaatgaatactcaacaaacatatccatatctttcatatgcaaccggttggtcatcaagtgaaggatggcaaccgatttgttgagactaatgttctcctttgatgtgtgaaaaggaataggtcccactacgatgaggctaatgaatgacaccatgggttagtggtcaccaagccaaggacatcgtcatgttggcaataatgaagtcaagcttgtgatgagaataaagtcttgacaaaggatggacaagacctcggcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagaccggatttgctagataggcgccgtactatcaaaaggagtctatgaagcgagcttgtgaatgatcttgtgccatattagttcatatgcatgtaggtgtatttggtgggcttgtctagccaagtgtgatgagttttctcaagtcctaaaccaagagagaagtgggcatgtccaataggagtgagtgacatcttgtgggtatgtccggtggatgtcctttggagtgtgagccctttatccttgacttaagttgtgtttcttggatggtttttttcatgggttggatggccctttgaataatctttccatagagtccaagaacgccaaattccgagacccgagtcaagagatatcaccgttttactaacggtcggttaagctgaaaagtgacctgcggtctgaccatgggccttaggccggtctgaccgggcctgttagccggtctgaccggcatgataaggcttgtctgaccggccccactggtctgttgtactggtctggtttttggtggcgatacagagtcgccagagccacaaccggtcagaccgagccgatggcggtctgaccggctactacactgcggtcagaccagccaggttgagtgggctcaatgattgccctgtaacggctagttttctagccgttacaaagtagtccggtctgaccggccactctatggcggtctgaccggcagagcacagagttggggatttcgactccaacggctagttttggtggttgggggtatatatacccactccccagcagcaagggcaaggttttggcactccattgcattatcttgaacccttgcaagagctctcacacccttgtgcacttagcttatctagtgaggtgttagagagtgagttaagccaatccaagtgcattgctttattgttttagctagtatggcacttgatcatcctcggcaagcatcctagacttgttactcttggaggttgccgcctcctagacagcttgtataggtgttgcccggtgacctctccgaggagattgtggaggaggcctggcgccgtttgtgagtggtttggagttcaccaccttcagagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggattaggaaaccggcgagtttccgaacctcggtgaaaaattccttgtctcttgtctcatttatttgttgcatttacatttttgctatttacattcatagagacatatttgagcccatatcacctaggtttgcaaaacttaacttagttgcttagttaaccttgcactttaccttgcctagcaacttaggttagttttgtttaagtgccattaagttttaaaatcgcctattcaccccccctctagtcggcctccttgatcctacaatgggtaggatcgggagagaaaagatgagcaagggtggatgcggcgttcgagtcgtcattctcggtggcggcagcgtccaagttatcgttcccgatggtggcggagttgatgtccaggaggtgacggcggagttgacgtccaggcagcggcggcgttgatggcgtcgatccaggcggcggttggcggaggaccacgaagttgtgccacaatcgatctcgccggaggaggaacacggcggcgccggggggaggggggagagaaacgcggcggcagcgcagaaaaggatggaaagtgtgagaaattccacctgtggcccgtatattcctcccatctattacacttgaaggtatatttttgccctcccacctctcgtctacgcgaggtactgcaacatggacatatttgatacctcgcggtaccaaacactaccagctattggatcgggccagatccaacggccaggatttggtaccgcacggtaccgttagaccataaaaaatctccttatattatgggacgaggaaggaaagtaccaaaaggaaaacaaagagcaggagtaccttgaagcgatgatcatggccgcacacgttgcggcggcggctcctcgactgcttgcttgtagatggaaccgtgtggctcctctacccacttcgccgtcgcgacggcctctccaggcgcaggcggcggcgcgcatggaccgcccgcgccacgccgtcgtcgttcgctgcaagaagaagaagaagggcgccgccgatgagccagccggcgagcccggcctagaggagggtggtgatccccatcaggtatatatatcaaaactaaccgcttccttaatctgtcattagtaattagattagatctaaattgacagcacattaagggcccctttgaatcttagggcccctttgaataaatgatttatttaggaatttcgtaggattcaaatcctatacgaaattttcctatttggccctttgattcaaaggattgaagttttccaaatcctataaaattcctatggaatggcacattgcatgtggattttggaggaaatttggcaagagctccaacctcttggaaaatttcctttgagtctatctctctcatccgattcctgcgtttttcctgcgctctaatcaaacgaccattcctatatttttcctgtgtttttcaatcctttgtttgtcaaaatcctgtgttttcctattcctctgttttttctaccctgcgattcaaaagggcccttagtaatgagaaaacataggaataggaaaaacgcgggattttgataggaatgtaagtgtaaaacagaggattgcaaaacataggaaaaacacagtaatgatcatttgattggaccgcaggaaaaacacaggaattagaggagagataaagactcaaaggaaagtttctaagaggttttaccgcatgttagaattcctccaaaacttgcatggcattagacaatctataggaattttataggattccataagatccatttctttgattcaaatggctacgtaggaaaaatttctataggaataaaatcctttaaaattcctataaatttcctttaaatcacagggggcctaattgttttttcttctattttagtctccatcgtaccagcaatatcgtaagtttcaagacgtaattgaccagctccagcagtgtgcggccgaattaagagctcgtcgatcactcaaaaaggacaatatggtttgttctaagggatgtgcttctgtgctcagcaaaaaaaaaacttgcacgaaagttaaagctaatcagcggctgtgattaaaagggagattagcacttaattatcattagcgaggggtaatttcgtccaaagatttttgagcccatatccagcccagtccatctgaagcgatccctacattctaccagtccaccacggcgccgctcctcaaccgcaccgccgcgccgattttcgccttgccgtcattgctctgccctcttcttcagttaaaaggatacctgagcaggtatggcctgagtgacagtaaattcagtttcagacttaacttgtctcctcaaagatttgccttcaagttacagaacagagtcaatgccttattgctgcaactcgacttgcaaatttggttgtacatatacacatctggcacaagcttcatatttacaagcaccatgaaaacctgatatgcagtctcagcgctgccacttttcaatagaatcgagagaatggcattcgcaataggtgacaatggttgggcggcgccgccgacgcgcgggttgtggaggagcgatggcagtgccgacggtggcggagggaggcaggaagcggcgtggggagggaaccgggcggcaaggcggagttgcaaggggaagaagaaggcagagcagcggcggcaaggcgaaaatcggcgcggcggtgcggttgaggagcggcaccgtggtggactggtgggggtggggatcggactgggctggatatgggctcgaaaatatttggacgaaattacccctcgctaatggtaattaagtgctaatctcccttttaatcacagccactgattagctttaactttcgtgcaagtttttttttttcggagtacagaagcacatctctctattgttctaatcattgtcaccactcaccatctgcctattgctttatctccaatagagaacagcaaccagtcactcacatcgggattgtagttaatgttgactaatcgaaattttgtatatttgtatatagagtatttgtcccaaatagaaacgcctagcacgtacagtacatcatctaagttcaattaacgacaagtgaattatttaaacaaagacaatttagtgaaagacatcttctgaatttagtgcaaatggtaaacaaacacaacgacgaaagcatgcattagtaatgtcaggaatcaagaaacctaagtgatgaaagagaaaatttcaccagattgttcaacaacggaagcagtagtaatgtcaagaaaccaaattgaaaggagcaagctagctaaatattatatagctaatgcaaggcttgcctcgcttgctattgatataatgtaacgtcaaaactgttgcactgttgatttcattgtttctgatgccccttttgttttgcaagcaggacgatacaccattcaattatgagataaacaaaattagagggtactggacggagatacattcagcgaagataagttatttggtcagtactgttcataatatgctggggtttttattttgtttagcactaaaacaggtgaacagtgtccacctattattttgattagaccattggtttttgtagcggcaatcagcaaaaggaagaatcattatatagtcaaaggatacatgtttgttgattctagcaattcctaagtgtgtgttctgtagcgtgggttaggaactaatccccacgcatgggaaatagagtgatagactagcgtataattatttaagtattagctaaaaacttttaaaatatgaattaatgtgattttttaaagcaatttttctatataatttttttcgtaaaagccatattgttttacagttttagaagcgcgcgcacggaaaatgagtgtgtagagggttcggaacctcaacaaacgaaatcagtgtaaggagatgtataggggcttcgaataaacacatcatggttcaataaaaaatgctaatagtagtaatacaaaggaattatgagatggttatgaattgaagctgtttcagtaacactacaatcagaattaaacatgcatttaattatcagcgcatatctaatacaacattggaagtggcatttccactccaagacaaaattctaatcttcagaaatatgctgcaataagcaatttcgtagcggttatataatttaatttagcgcctcaaccttcaactttaggacttgtgaatatgaacgtaaaagttagttgcgttagtgcaaaatcaaaagttttaatcgagataaacaagttcaataataatactacgaactttctttcaaaataaaatatcatatataagacattggagatggatgtgtgagctcttgacattgtggctatgtgctataacttcaaatgtactccctccgtcctaaaaaaaaacccaatcctaggtttgaacttggacaggattgggttttttttatggagggagtataatataaatataaattagtttgttgcaaacttcatccatatataataagcaccgtgaattttactgaaatttaaaattgtaggattatgtcgtaatgttactatgaactttttgtcttgcctgttgcaaaagctgatcatgttttatttggtgagtactgtaggatggacaaggcaggatgttaacaatgactcttctcttaagagctaaagatgctatcgagttggcttctagaattatggtaaatatgctatcttttaatatataatatgttagctgttagatttaattgggtaattgatccatttaaatcaattaaattaaataaattccaaggctcgttatgctaggaatttatgtgaattcattcttttatgggatatcaatgggatgaagagttttgagaattaatccatttgattaaggaattggtaacttatatcaattagtcttaattgatggatggttgatggttgtgtagtggaggatggttcatggctagttgatgacaattagttgctctattcctcttgctattccattggtgatggttgtgtagtggaggatggttgatggctaattgatgagaattagttactctattcctcttcctattccatgactcttactcttcatcttccatttcctcttataaaatgagaatggatttgatctcccgcgaaagaggaagacacactttcatccattttccaaagctgttgctgctacggtaatcccatctcgacgagtgtgtgcacacccgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatatcaacattgtgtcattatgtgattgttgatgcttattcaacgttaagcatgctcatgttgattacattcaccactatcactggatcaaatcccattgtaaatatcatgtttattatcttgttattttggattaaaatataccgaattattaccaaatttccaacattagcaattttactgaactttgtttaaccaacttctccactcttgtgaaaaacagactgaagctcatttgagagctcaaacgccaagtgaaatttcgctgcatacggtagatcaggtaactcggttatgcttttatttggatgctcttctttgaccgaatcttgaaatcacataattttggaacgtactataaatttctctgaacatgcagaccgtcaggatgtatgtatcgacctttgttaagactgccgaggacacttaccataggaaggttgatagagcaaccattctttcattcctctgtgctcttcaaggtttggctgcagttagccatatcttgtttgaagatgctttggcttttgttcgtagcagtcaaccggattacagtccaaatcatgatgtcgaggtaattaaccgttactatcagcaggagataaaacgtttgataaataactttagggaggcttcaacaaccgaagcacttgaggtatgccactggacagagtctccccttcttttccgataatgttgatcaaattttgatcagatcagatgttgataaaattttgatcttgtatctgcttgacttgcagattcttttttttttgaacggaaaatagcactagagtgtcttttcattgaatagggcaggagaaaatacaacccctaggtgcaacaggaaaaaatcgaggagctgtagctatacactatacataatgcgggattaacttgcgcagccgcttagcccctgctaaagcccaaaggctagcctcttctttgatttttgacaagaggaaactcgttgccacctctttgtggtcaaagattcgccgatttctctccttccagatttcccatacaactagaaggatgagtgatcggagtcctttcttcggaacatttggcgtgtttgcgatgttctcccaccactgttgtactgattgtgcctcctcccattgagccggctcaatttgctgatatcccacccatccagcaacaaggccccacatccttttagtgtatctacaagtggcaacgaggtgcagcgccgtctcagcctcacagcggcacataggacaacatccgttgttttgccaacccctggtcgcaagtcgatctaaggtccaaactctattttggatgatgagccaagcatgaaatttacatttccctggtgcccagactttccagattaaggagttgaagcttgtgctcggcgttccttggcattgcgcatggtaggccgaggaggccgtgtagcgtccactacttgtgaatttccaggtaatctggtctggttctccagtgtctaagtgaacattccggaccgcttcccataagcgactagttgttcgacgaggtgtactgtaataggagagtgggattccaaagccaaatcctaaacccaggcgtcgtcctcctttccatttcgaagatatctccctctattcttagagatcgcgtagaccagcggcataaggtctttaggtctttgcccctcgatccaggcggagtcccagaagcgagtcgtgttcccatctccaattgttatctttgttgaagcggcgaatagactcctgtcaatttcatcacagggcgtttccagtcccacctatggcttggtcaggtccttccattcgtgccataaccatcgtagctgcaaggccctcgtgaatttctccagatttaggactcccaatcctccctgactggttggcaagcacgtctttgtccagttgactttacatttccctccggtaatgtctcccgtgccggcccatagaaagcgacggcgctgcttatctagctgctcgagggattctttcgtggttttcaaggcagtcaggagataaataggctgcgccgtaagcactgatttgatgagcgtggttcttcagctaccgccatgtttttccccatccaatttggacttgcagattcttcatagtacggttaatgatttaacgcagaaagtagcatcttatgttaccaaaatgactactcttcgcaagagcacactagcccatgtccctggtaaatctgttgttcttgtgccagtcctatttgcaccaaaataatattttcactttagcaagttagaattacattgattgttgctatatatggtttgtgtaggccgctccattgcatactgtgatgctgccccaccagatgacaggcaaaatgagtagctgattgattaagttgatgcttcagttgagatgtatcatcctgtctggatgaatccattatccatagcaggcaacgaaaacatgtgcaaaattaagctttcggtcaacaatatgtgtccttttcattggtcttgaatatatataacgttattattcagttattatatatggaaggactactatttgtttcaaaaaaaaaaaaagaagtactaggtttcttttgagcaaaaaaaaactactccccctatattttaatgtatgacaccgttgactttttaaccagcatttgatcattcatcttgttcaattttttttgtataaatataaaaatatttatgttatacttaaagaacatttgatgataaatcaagtcacaataaaataaatgataattacatatatttcttaacaaaacgaatggttaaatgtgataaaaaaatcagattacatatattgtcataacttgatttacatatattgtcataacttctagtccaaaataagggccaatatttgcgctaccgagtagcgacccaatgcatggagccatatgtaaagggattactgattcccaaattatgaaaatggtcaaaaatagagaggaggtgattttctgggaaaaagaaaacctcaccatacgggcctacattagcacggcaagtaaggggttagttttaagtgggtcgagatgggctgggccttacgttccttcccacaatatggcccgtgtattagcacggaaagtacggctagttttaattgggctgacatgggttgggccaaatgttcccacggactccgaagtaaagcccttcttcttcggcgccggccaacttcgctcgccgccgcacaatccatttccataccctcggccgtcgtgagaaacacccttaatctacactgggatcaactcaaccaactctgaagtatacacgactttcgatccagccctaattcgatcgtgtgccgtcgctgatcctttttacttaacaattttttttaacagctgatcgccaccgtaaatcctctttgtctctgttcggctaggcgattcagttgattaacaatgcagccacgaacagagcagcagaagcttcctcatcatgggtaccgagctcgaattcgccctata

SEQ ID NO: 78129 - DNA, 7684 bp, Oryza sativa
tactgcctatagggggtccttggaggttaagcagccgatccatcatcagagttgatgagatttctcctcggcactgaatcttgtcggcaaagaataagtcgattgggagttggccaaatccaagttgtctagccgagctcatcaggtggtaaaattcataagagacttggatgtttctgccctgatgaatgccaacaggaaggatgcatgggctgattgtagctgtaagaacttttcatgattgatgtcttcaaatctgaagtctgatgggagttcaagatctgctgagtcctcgtaaggaaaccaaacccgggcatctttctgaaagccttcataaaagctgcaaaactaatccttaagcagctcagccgacagctttgctctagcatcagttggcatagatgcatattctccatatgacatgcatctacgatgagtgcgttcttctccatcatcttccacaatcggctccaaccttggaaattcagcttctgtcacagatggccgattgacaactttcataactaccaggtttaaccaagtctgcagcaaccaccatggtccacctgccccaaccactgagccgacggctatcttggccgatgcattgttcaacatttggtatagatagcgggcggagatctaaccgggggtgaaatcgcctggggatcgccttgtgcatcggaggaatcgccggagagagagagggcaaagttaacttcggcggtgaaaacggaagaaaacggtgtgagtttctcgggtgcaacggttagtatttaaagcactggaataacggtcgggaaatggcaaaatgcgaaacttgctcggagtcgatacacggcaaatctgaaacattaccaaatattccggactaggggggcatgtgttaacaaccaaatttggtaatatcaccatcggaaaagaggattagattgaagcggagtcaaaggcgaagatcgattcgggaacagagtaaaaatcggctggagtccagatcggctacgattgggatcggctaagtcctagtcagactaggataaatgatacagccgattccgacaatacgacttgtgtacgacatcgggttgagttgatatgcttcaagatgattgccacgcatggatagagtcctgagaaggcaattgtatctattaattaggatattttatataatttccttagagatatgtttgggcaaaaatctgccgtaaagacttatgttatcttagagtttgttagagataagagtcgtgtccgatatggacatagtttgtaattctcgggtataaatagaccccgaaccccatgtaattacaaaaaacacacacgttcaatacaatctcggcgcatcgccaccctttttgtttttgttttatttcgacgagttcttgcttttgggttgagctgcatcggtttcgatcttcaacaagaggtaaaacttgttatgacggcttgcgttcttaggattagtgcttccatctttatgacactctaatcttgtttatgtaattcgttgagttatcatatatcttacataatctctggcattattgttatttaatctacaatcggctaacatatgtcggtagagagcagccgattaggttagatatcaatattgacctagattatataggatatccaccactatatgaaacttccagcggcttgattgtctagatattgttcttctttttatacttaatgctgcatcagttgagtttgatctactaagtcgtgtttagaatatcaatctctagcctgccctctggttgccgattagagtagcgtcggggtttcagccgatcttatctgatttaactacatttgctttatgtgtttcattgacatgttaaatctaccgtttatgtcaagatcttattgcatctaagtatattaagcttctgtttggtatattctgcttgttttaatatcttaacatagagttgtatcagagtattagccaatacatgctagatctatctgatcggctacgctatgaacatatgtagtcttgttgttaatatatatttcgatctaagtgatttatactgtctcggcatggcgaccgatctatcccaatcagttgattcaagtatatatcgacagcaggattatatattgttaatatgtacagccgatcgagtagatttagttctttattatctatttacaaccgccgatcgatttaaacatgacattggctcaaagataaatgatacgtcatcggcatctagccgatcggctatcatttatggatttaactacggtttctttgtctttatttcttgttgattgcatgaccaaatcaactggcatgctagcatacccaaaggcaagttttagacctgcactggagttaagcagatctcctaggcctcatgtttttcatcaacacgcttttggcacgcctggtgggaccgattagaagtcagaagtcctctcatggacggcaaaccgccagcatcatcgtcctcggctagtccgggttctgttaaagagaaggtccagcaattagaccaatctgacgttaatgagggcaacgtcatgaccattactctagacaaattgacacctgatcagaagaaggagtttgaagcaatgatgcagtaagcacggaaccagttcttgaactcctttatgcagacccgcaaggggacagtggtgcaaaagtatcaggtgacagtagtggctgatgtccccgggaccagttcttctaaggatgggggagtgaaacaagctccaaatggctcggctcaaccgagcaacaaaggtgctgcagatgattatcaaggaaatcaaggtgacaactctcagggagctcaaggagttcaaggtgatggtttccaaggagttcaaggtgacggccctaatcaagacagcgatgcaacacagtctagatcagggtgcgccaacctcacgcacgcgaggacgtggcacgccccgatgaagatcccgttggacgtctcctcgccgatcctggccgcgtgcttggaggggatcgcccccatcgctgtggccagctccgcgagcgaccacgtcagcgagaactcgtccgggttcgctgggatggttatcgtgacgccatactcctggcgagttggtgcagaccagtgtacgagacccacaacgaacctcggatctccgacatgttgttctcgagctccgacatccggtggtcgagcccctgcagctgtctctcattgccggccaccagctccctcatctggtttgctgacgcgtggcagctgctcggcgcgctggtttgctgatgccgccgccgccctggtctcctcaatctcatggcctacgccgtgagcaccatcctggaggatgcgctccagctccgcttggagctcccccgaggtgagggcatcggcaggcgggccccgagcaggcacaaggccgacggcggggctactcggcgtcacctcccggtccctagtagcgaccacgacgtctgtcgaggccgtcgcaggggacgcgctggtagttgcaccggtcccaccttgcgtcgccttcgcccgcgccgccctgcgaagagttttctctttctcataaagctaggtgatcaagaattcgtgaataaaaaaacttcaagaacgtctacttacttctcgccgattgtcacatgcctttgcctccgttgaggaggagttgacgcgtccgagggctaagtgagatacgacggtgtgaggtccagtcatttcgacaacgtgttaaaaaacaagagagacttaccgccgggcttggtgccttccgactggtcctgagtacggaggagaatttcctccccttcttcgaaacgtagtttccactcgtggtagcagcagcagcagcgtcggacgcctctttggtgacgccctccttcaacgacgtcgccgtctggtggtccacaagtggcccgatgacgtccgtcagagggagagcctgcataacatgaagtcacaatgcgatcttggggagaaagatgtaaaggagtcatcgagtacactcacgttgatcgcagcctcgcgttcagccggacccttctcccaaagggggacggggacgtcgctcgctgtcgctggggcgctgatcatcacctggccgacgcggcgtgccacggtgtcgctgtccaaacctgtagatcgagaacaggaactcgataagtcaggagaaacaggcattcccagaatgaaatctgaaatacaaggaaaaataccccgaggagagacccgagtcgtgtcctctggcccataatcgaaggccggatggatgcgggcttggagcggttggatccgcctacctacgaagtcggcagcgactttgtaccccgacaacccccgtattcggaggtcatcgatgatgtcgatgaaagactggagggagggagtcagggcgggtttggtggtccactctgggatcttgtctggttgttcttcagggacaacaaggacaagatctgagttctcttgtcagggttacggataaggtataccctatatccttggacatatgttgtatactgatacggtagacccgtgcatatatgaataatttctgtatacgttaaggaaatctatcacgtaatagaaacaggatccacaaatagagggagtcctactcggacaagactgggtctttaccatatcgtgaggggtccgatatctctgagtcctatttggagatcaactgacccgctgtcacgcccagaaattcacgaaccagaatttctaagctgaatgtgcattaatcccctgtccaggaccagccagggtacacaaacgacaattgttgatatacagatccacgtcttacaaaaatatattagattacaaatgtagcggaaaaggtaaaagcgcggcgactccactccacagccaatccttgacagcagcaacgaaaccaacctcaacgagacagctccaactaggaagatcttcagctctggtgtgggggaaaagagagcaagactgagtactacccactatactcagcaagtcataccggaagagaaggtatgatgcaagatataaccaaaggaggctagaggttcatttgcaataaagcaggcatttaaaagaagtagttgaaagctgtaaaaaagttgcagtaattaattaatattaacaaatcactactcaacgctacaccacgttgagacaggcccaaaccaccacttgaactaaccagttccattagctaactaggagtgagactaatcacggtgaatctgattgaccgcccataaccacgggcacggctattcaaatagttttactctgatcagaggtgtacgactctacccacaaaacatagccccatgacatgtttccgtgtgccaacatgccaccatgacatactggaaagaggccgtgacaggacccttcgcataaccccctctaaccgatcgcaccacacctcagggttcgcccccgtccccagcaggcaacgggcagcccgcctctcgtgccacagtgaatctggaagctgatcaaccgaacacccccgaccgacccaactccatcacgcccacccttggctaggtacgtcatctagaggaaagctacactacaagcccagccgttgcccacgctggcttgtggtaagtacgatgaattcttccagggtttcccgcaaaccggtccttaatcgccataggcacgactagcaaaaccatgcacccacagcccaccatgtagtgtattttaattaactaacaccattgcggtggcactaatccaaagctatgccaataatcaaagtctatgcattagtgtgattcccccattgtgtactagttgaactaagcacggctaagcattccctaaaccaacatctagtcattttaaaacccaagttatcaatggcgtaaggtaaacaacatatggctgagtaataggaaccatcccacatgatattgtaaaataatgcaacatttaatagaaatgcgggacatttgtaaattgggtacaatatgatcaattgtaatacatgacttgccttgctctcgcgctgatgagaccacaacaacgtcttcgagaaaccgcggatcgacaaaacgaccgaaatctatgcgacaaacaaagcacacaagcaaaacatgctataagtctactgaaacaggaaacaaatccatttttaatagactctttgcatttttatgaatttactaagacttgaatggacttaaacggagctcgaatgaattagttatgatttttagaagattctctgtgtttttactaataaagaaaaggccttaattgatttattgcgctataatgcccagggctgacgtcatccaagaggggggcggcaagcaggcttatagagcgccggttcaccgtggatcgggaccacgcgggtggtccaccgccagtccacgggaccaacggtccggatcggccgggagccgatcggacggcgcggcggcggccaggcacggctcgccctggcacaaagccgaccggccggccatggcaaggcagcagcggcgcgcggccaccggcggtgcgggagatggcggcgactggcgcgaggacgacggcgtgcacaggaggcggcgacacgcaccggtgaaggagaggaggagaggggggtttctcaccgaggttggccggcgcgagaggagacaacggcgaacgacgccggcaagcagtggacggcgagtcgagcgggtggacgacatccggagtgacctaggaaagcaaaaaaaaaaaggatttagagggagagaggtggttcgcggcaagtggcaacgccggccgaaggcggggaaaatggaggggctcaccggcggcgggggaagacgatttccggtgggatttcagcaacgggaggcggcggccgaggtagcttccgcggcggcgaagctatcagcggcggtggtgcggcgcggcgagggcgctagtggcgacgtcgtgcgaccggagatgggcggcggcggcagagctcagggagagcggcacggcggcggtagagagcacgggaggacgcggcgagagcggaaaaagagagagggggctcgggggaatttttataggcgaagcgggaggctgacgtgaccggggaggggcccaattcgccggcgacgtggggaggtggagagagagagagagttgggggatttcaaatcccccgccatttgcgggctagcgcgcttgcaggagtcgtggggaaggtgggcggcgacgtggagggtgtggagtggagtgcggaaggcggaggaggtgggcggcatcggcggttggggtaggcagcggcggttgccggccggctagaggaggaagaaggggccgacaggtgggccccacctatcggtgaccctgagaggagcggaaggcggcacggactgggccatggccacgggccggcctaagaaggagggggtccgcgcgcgggaggagagttgggccgacggcccaacaaaggaaaaaggaaaaaggaaaagaggaaaaaggaaaaagattttcctggatttaaatattgcacatgttcatttttaattgattaaaattatctccaaggctctgaaaattccactaaaaatcatgttagcatattttgacatgtagaacccaagaaaaattccacatgccatttctgattattatttgcatttattaattaaggaattagctctaggttaattcaacaatttcttcagaccatttatttaacaaattttaaagctagaaag

SEQ ID NO: 78130 - DNA, 9588 bp, Oryza sativa
cggtctgaatcatcgtaggccttgggttaaggtaggtttgtgtgggttcacggccttgataaataatattgtatagttctagaatcgtgtttaccaaatagctttgagcaactaaatatctttaaatgctgtttaccgcaaccctaaccctttatattgtaactcctttgttctcccttgcatttattatgcacttgtgggtgtgtcttgttgagtacggtggttgtactcagtcttgctcaatttttcctaacccagaagaggatccccttgaagatgaaggctttggtgtctagctcgtgcctgccgtcaagcgcctgtggtggtcgccctagtcttccgttgcttctcgtttgtctttgtgtgtgctgggccttcgtcgcccatgtaataaattaactatttacgcttccgcttgttaaactctgaattgtatcaacctttggtgtaccttgcctcctgggacaaggattaatgcacgcacatcaggaacgcccgttgggttatttccggtcgtgacaatggggaccgtatcgatggtattccggccttctctcctccggcaacttgaaggtgacgtgttgtttagggaagccatgagtggtgatggcacacttcgctgcttccctcccctcccctctctggccacaccccgcacaaccctacctcgctgtcacaccctcccctcactaagggaacgggttagggacaagggtagctatgaaggaggttaaaatgcacatttgttgaaacggtgggtcagctagggaggtggccaaagttggtttggatcatgagtgctacattgaaccaagattatgaatctaaatttacgatttacaatatcaccaacataaatgacatcactgtccgtgtttaagaaccgtccatgtttttttttctgttttttagattaaatttcacaaaacttttaaatgtcgtatgaaaactatcaatttgcaagaataagtactggagggaaattctgtgttggttccaacctggatattgcctaatttggaaccggtactacgttagtgctactaaggcctagtttttttcgacttcctcattttccgttagcacacttttgaaactattaaatggtatgtttcttgcaaatagtttctacataaaagttgtttaaaaaataaaataaatttatttttcaagtttataataattaatatttaattaatcatgtgctaatgatctttcttgtttctcgtgcggtaaacgcgagaacattgataaatataaccacaatgaatagatcaagaagtaatgcatcggatcaactgtaattatcatcaaaactcaaggcaatgacattatttcctcacaaaacggatctagaagaaaagaccgacgagagcggatgtagatgtgggtgatgcaagtgagccaccccggcactgctgaagaggagggagccaccactgtatcggtgaaggggaaaaggccatgttgttgaatggggaaacaaaccgtggccatggttgggtcgggggagagaaccgccacagtcaaacagggtacactggctagatccggtcacccccaagctcattgcaaccagatctgactactcacgacctcttggtggctagatctggcagtccctaagctctagattgcttccacaacatgggagtggataggaggtgccaccaaagttgatatcgcgatgaggatgtggggggtggtgaggatgatggccggcggagccacaatggtaggagggggactagtggttgttgactgtcgttaagtaccaaattcgaacgtcaattaccttaataaatagaagagaactagcatttcttatgcgcatattagttacaaataatgtagttccacttatccttggagaatacattgaatgcagggattatacaataaagtgtaggagaatatgtgccagcatgcaacacctccggtgaatcacgtgaaagcacatggactgaagggcccaaaagcgagaccaaaccaacatattttgggtgaacccaacgtgcaccatcataaggacccatgatgaggacacaactagctcggatataaccatgactaccctatgtattaatcaaccaaagatgcatatgttctacattagatttacttgttatatatttgaacaaacgttactacataatgagttttgtgtgtttgtttgcagaggtacttgcttggacgaaggaaaagaggccgagcataacgaatgcttggatgatcaaagaagttgattgaggaccaaaccaagaccttctccatgtcttttgtatctcaccacgtcacttttggtccatagaagacaagagataaagttctacacgttttggattcggattcgggcctcctgatagcatcaacttcaaacggacctagccgctgatctagaaagaatttcgaggcccatgagtacttgttggaaagcttatgtagctgactttcagatggttttattactacatcaaaattcctactgagtttccaggaatctgaaaaacaagccacgtatctcatccagtccgaatctgatttgggtttgggccttgtaattgtgtcgtgggcttagcccatcagggtgtgcaccctagggcaaccataggatgtccctaataatacttaaccaatagccgtcatcgcttagagtcgggttttgcttagattactctgtcaagaacagtttcgctgctagatcggtttgtggaacccaaattcgagtgcttaatcattcataagcaatttggttgcaatctatcttgttcttgcatgtgttcttcgattcgcatgcagggattagccttctcggcgaggtcaaccgggtttcagcacggttgataaccagaggagacgtggtgctgcaattgcggggcttagtagcgtgttcgtttataagccggatcgagttgtgtcgcgactctgcccaaatcgtctgtttatcaatacctatcggaagatcggaacctagcatccctcatcagttggtatcaaagcgtggttgcccgttaggtaagttatcttcccataaccagaaaattgccacacaaaaatatttattctttacctagacaatttgagccgttgcgttgttctattagattttgctttgttgaattctggattgcatcatcgtgtcgagtgctggtttagttttagatttcatttttagttttgagtattgcatctgttcatcacttaggtctaggactcatcactcaagtctgtgagttgtacgtcagttttgaatttagtttttcatcccgtcggttgttgccgggaccttgaagaattgaatcgtctcgatggttggtttccgttttcgtagtttggagaagttaatatccaacggttttggagttgctcgatttttagagttactgtgttggggagttagtgcgcatgtgaggggagaggacgagccccaactcttccgtaagtagtttctctccatcgagtattgaaagtgttaaagttccagatttgagagatatttttgtaaaaacggaacctacatgatacattccatttttgaggagatctaatttagttttacactttgcatttgagtccctgtaattttcatatttacatttgagtccctattcgaggccagcgatcagtttttgttaaaaaatagtaaaaaataaaaaagaaagaaaaggcagaaaggtgcaaagaaaaagaaagaaaaagttgcacctaaaaaaagaaaaaaaaaagggcagaaaaggtgcttaaaaaacccgcaccaagaaagaaaaaaaaatcattcattctttgagtatgttttcataatgcagagttgtgcattgattcatatctagtccttagtgttgtcaggtgcttgcttgagctagagttgagtctaggctaggccagcacattgactagtacttttaactattattcaactttgcattttctgattagcacaattgcgttcctttgctaatatatatcatgcctcccaagctgcacgtatatacttctggtcagcatcgctttgatccttgcaatcgccacatcacgtccttcaaggtgacatgaactagccaccggttgtaccgtccttagcattgctgataagacacttgtaagagcttgataaggtgctccatttgcctaagttgttgagaggcaccactacaccgtgtagcagagtttttatgtttgcaatgataggtatgagtggcgctcaaaatcagcgataccaacaaggtgacataatcgtgtgcccgaagatccttatgctaaggttaagtttaaaataccatctttttcaggttattatgatgctgagaaatattttgattgggagatgatagtagagaaaaaaattagtacccaccttgtgcccgagcaacatagagttcgacaagctactagtgagtttaaagagtttgcttatatttggtggactaggttagatgtatggagacctttacctactactaggaaagaacttaatgtagctatgcgtgatacatttgttcctccatcttatcttagagatttaaacaagaaactgaagcgtttagaacaaggggataaatctgtacatgattactatggtgagctacaaaagggattgaagcgatgtagcgatggagcgattgcaatctatcttgttcttgcttgtgttcttcgattcgcatgcagggattagccttctcggcgaggtcaaccgggtttctgcacggttgataactagaggagacgtggtgcttcgattgcggggctcagtagcgtgttcgttcagaagccggatcgagttgtgtcacgactccgcccaaattgactgtttatcaatacctatcggaagatcgagacctaacatccctcatcaacccacatgtcagcctataggggaaagccagtggagaagggtggtgcccctggttgggccggaacaaggtttggcaaaacagactgaccatacgtcatctccaccttccacgtggtgactcatcaaccctccctgccgatggtcacagataaaccgaccttcgcaaccgccattggatgatttaaaatggagggtgcattctccctttacaacacacactcaagaagcaatctctctattttatacttatatactctctagattagttagtttaggctttgaatagttctttgtttcctagtcgtgttggagatgcgggtatgtcttcattaatttgctctctttgtaagactatgagcttagtaatgaaattatcttctttatttaattgtgttcgttgttcatactttgtcaattgtatgacctatcattagtttatagttctttcatgaaatataaatgtttaggctagtcgatctatgccaaggcatcggtccaacaaacttaacggattgtactagttctaacttgtccatctgaagggtaggagtcagggggaattattgatattattaagcaatataaacatggtgcttagattcattaaatgccattagataccggtatgccccacggaatgtgaattagatgacaggtggtgattgccatgtccgtcttttgtattccaccacgttcggatatgacgtaagagttcgtaaaatgccttaaccacactggcaaactaacaggaagtagtatctcggtagtacttgggtgtctacaattaagttctagccatgtatatgtatatgattattgtaacgattaagcatgataaatatataagtacatattaaatcgtagctttcctttgtctttctccacttgctagtttatttatagattttaattttctgggtgccacactacccaagtatcattatttttatcacttttctctgttagactatggcatattaattatagcgtaattagaatatatcggtctatattttacactgtcgccttccatgtagaaaaacaaataaagacacccatggaatactcttaaatgaaatgctacagtgctatccacgtgcttgcagatttatctattaccgtatcaaatagcaatatgggtggaggttccgctggtgaggaggatgacaggcagtggtgtagcagggagggagagagagggagacgtaggaaggatcaagagagatgaaagagagccatggaaggacactccgtaaaaaggaaagagatgagagacaaccgagagggaccatgagagcgagccagcccgattaggtattcttaatgggcatcagtgctctttttaagaaaaagtagcattgaaatttgaccagcgtgggcctaagaaggcaagaaatggctcatagatgaacaacacatatgaggtttcacatatttggggttttgttgtagtcaacgtggtgatgaaaaatcggcgctcggccgatagtgccggaactgtgttggtacaaactaagttgacaatagcaatagcctgggatatctgcttagctccaatgtaggtcctagaattgatgagatgggggcgtgcctgtcagtttgatcctgcaactgacaagatatgtaaacaacagatcaaataaccaattggctgacaagcttatggagcaattccagctgatgccgatagggttataagcaatcaactatatttccaatgtatattatgatacttgagtaaataatgatatatagacaatcggctgataataatgtaattaagcaacaatataatctagtagaaatcaatcggctaataacgatatgatagaataagcaacgatccgaatgttaaagcatacatcggctgaaggtccgatgtcattaaatccaaacgattagataagtaatgaaacctttgttgcaatcggctaaacccaacttgtatataatctctataagccgatacaacgtccatataactcatcggctaaaaccccgatgaaacccttattggcaatcaatggcatgttagtttttatggttataagcacgactaaggtcaatgcaactaggagtttgcaaacaaacataaagtctaaacaatcaagcctttgactgatttttaagagtggtagataccttagctaatctaatctagtaaagtgatttagtcgataccgacaaaaaccctaaagtagatcccagccaatacaagtaaatcgagcaatcaaactagattaactaagatacatgataggcaggtcggcaaatatatcaatcaaaccagagcgatccaagaggtcgaagcgatgcagccttaaacagcaccaatatagttgacataattgccaggcccggtggaatgtaggacttaccccttcgccggagatccactacaggaattctgggcttctgtgacgattacattatgacgataacagcctgtttctcgtcactgcctggctgcaataacgaaatggctgtcatcacagaaggtgggtcactatccagcttctgtgaccaccagaggacatcgtcattgatactgtgacgatagttctcctgtcattgatgaatgacgagacaaattcgtcataacaaattgaaccgaataacgccacgtgtatgatgacatctaatgttactgatgacaaggcggatgatgtggcaaatgacatggcaattcacattcagcccatatagcgtgggcttttttattttcaattacaatcagcccaattggcccaaatatgtttttgacccagctacaaatttgcttttacgtttttttcactatagcccaacaatacaattctagcccatattatgggccagcccaattaaaaagcaatcacaaaatataaaccacaaccatttgcataattatattataatcacattccagccataattaattttctagcccatacaaaagcaagttccaaaatacagtttccaacatatttccatacaaaagcacaaaacatgaatacaaaatgatccatccaccatccaactacacaagtcccagctgactacaaagttcctacaggtagtgccaagttcctgcaccaaaaaattccacctagcagccactaagtttcggcggcgtgcatcttgccagtagccagcaaaaaaattccaccaagcagccgctgcacttccggcctgcatcctgccagcagtcagcaactagtgccaaaaaatcctgcgttccagcaaccaacgcaaaaaaaaatactctggccactaaaagtgccaacctgcaagcaaccaacagatatcacatttggtttttggcacatttgtcctgcacatgacgcagttacatagcataagtaatagaaccactatgcatctgtcatttccttgcaacgccattttcatttgttttcagtggtcactattacattaaaaatgcaaatagagctgatccaaacagagctataaactggattatggaataattattttaccacctgagaatatcaaatttatgttgatgtatcttaggaagctatgtggttaaataactcaggaagattacatgaattatcttatagtcaatctgaaaactgctataataaatctagaattatcagatgtagctggcatgttccaattcctcctgacagaatcaaaagatctcaaatgtacctcatatccaatatgtatatacctagccaaacatgaatttgtgctcgaatcaaagtaataagctcacacaaaatgaaatctgctaaacatcacctgcctcacctactaaacttttttaagataatggatcaagttagtggcacaaggttttgtgaacattttgattacatcactgtaggtttaaaggtaatcaagcccaatatatcattaaccaacaattcccaattacccaacaaggcagctgaaactgtgaaatacaaccataaaaaacaatatagaaacattgtgatagtctcatgatagcttaacttattcagaatgcaatcactctactgtactctggaatccaaggatatgcaacaggccgagaggctcaccacgcataactgatgctccgggaagcggatgcattcgccgcagacaggaaccttgtgcacgaagcaataaacccttgtcgcctgcaaagcaaacaaatacagccataagcatgaaattcagctggcacactcataattttgaactataactaatctttctacttgttagataaatcaaaatatttatatcctattagttacacatgttctacagctgaaattattatatggtccttttactaattcagagatgctcttgttcatattctaatggatgagaatgcaactcccaactcctacacatactagtatatgcatcacacaagaatcatgccaggatatgatttcaatttcattttaatctcctgattacctaccatgattttagagtggctgatatatggttactttctctggtcctgcagccgctcctctggacttagtttcaaggattctcctgatgagacagcttcagcctaaatcaatttgaatgtatcagtattttctgcagagtttttaagtactaatagagaacacgatactattttatcttagtcaatgcttacttaggttttcatatagtaatacgctacagcatacaggagcaaaccacccacacattgcaagaacaagtgtgcacaacatatgcatctgcagacccaaaaaaaattcttgtggaaccaatgtagagagaacacg

SEQ ID NO: 78131 - DNA, 502 bp, Oryza sativa
cctcctcctcctcctcctcctcctcccgctctactatattttctagcatcgattcgagatgcggatcgccccgctgtgttctgatcctgatgcggtggtttttggccggcgtcgagctgcagggttgacgagctcgatcgtgctgcggaatggccggctatctgacgtgttggcggagcttcaggtcggtggattgcctgatgtttcttgagtagagtagttggattctgggcatctaattctgttgattgcttcgcgttatcgatcgtaagttgccaatacgctaatataggcgcgtcagtgttgcccgtgtgtgtttcaagcgatgttgtgatttatatatctgtttgtgggactccaatttatcaaatgcattacagctacatttcaccgatcaaacgttgggcgtgcacatgggcataactttttgtcgcttaatttcaatgtcgaatcatttcgatgcaccaattggaatgtcatgcctaagttaatcacccaatgg

SEQ ID NO: 78132 - DNA, 8916 bp, Oryza sativa
tgcataggataacaaaggatggcatagtatagcttatgtgcataaacaacatttaataaacatttgaaagaatagtaaaacagttgagtaattaagcaatattaaataaacactatacaacacacccgtgttgcataggcccaaccttatctgaacaaccaaccccggtgtacaaatcaaacctcataccaagaatataccattccaaaccaggagtcaaattaattatcacagtattatcattaatgagtagtgtgagactaatcacgaaaaacaatcttagacctacccataaccgcgggcatggctattcgaatagttttactctggccagatatgtacaagtaccactgtacccacaagacacagctccacgacatgtaaccatgcgcctcaataccaccacgttacctcggaaaggaactgtgacaatacccctcgcacaacacaactcaccacagtgcaccatacctggatcacaatcaccccctctacaaccagaggcatggactccccagcgacccccacggacttctcaccgcttctcagtctggcacactgtaatgaaccatgctatacaaaagataaagccgtagcccacgctatacaaaagataaagccgtagcccacgctggcttgtggttggcatggtaaatgtttcacaatagtagctcgcgaaccggtccttaattgtcatgagcacgaccatcaaaaccatgtgctgacaacccacctttaatcaggttttaattattaattaattatcataacacgattaaccatcgtgagctaccattaaatctaaccataagtaactagtaatttgcccgtgctaacgctacggagaatgcaaattaaacaaccaaaaagatgatattatttgtgatcattggtttacataaattttgtgttgaagcataaatttgtagatacaaatattgaaacatccgccatcagcttgctgatcttcacatgattctatagatttttccacatcgttatgaattctgtagattccgagatgaatcatattgtaagattcaaacaactttgcataagaaaacagcacaaaattgtatagttatcaatctccatttttattaatctggcattaaacatgtacatgctgcaaaatgttctgctcattcaggtataacttagcaagtagaaacaattagttcacattacttatcagattatttccagaacaattgcaagcaagcagcaagccgcaacatcattgaagtgcatggcatccctgcagctccacttccatcttgtcctgaaagttaaatatgatgtcatcagaaatagcaaaagcacattctttagcacatctatatttaacattttagactgatatgtccggagcggtaaggaaatgatatataggaataatttgctgtatgaaataggcttcattgctacagaaacaccagaattaaattccattcaacagtgcgtatatgtaaatttgagcatggagaaatgcataacttgtccctataatgcacaagtaacaagaatcacctcagaaatgtagaactggcctctatcgtgaaggcttccgcagcctcccctattcagtaaaattaagcattttagtattgatcaatcgcctaactaacacaattcataagcccaatctatttttagatacctattatacttgccaaatttcataaatcagtataacgtagtcagataaaaaaaatgcaaatagacatggtacataccatttaccacataaacatactggagcgaagttactatacactgcaacaactacatgtatctcaatcccatgatacgaccactgatcagcaccttaatcttggaataccgccaatttgagtgtagatgtatgtcaacctagttttcccaaattgatccgtacttatatattgtccatgcttatcttacatgtggaatatttctgtaagaaacaatcaaaatctgccatatatataatccctctaacatgaatgaaaataacagaatgacaataaaaagcactatttagcctagtattaactacagaaagcaacagcctagtgaatacaaacctgaaagtcattaagctccacatcactgtgtgcttccctgtcatggtcacatagactaaatatctgctacaaagccctcacaaaccgtcgctttagagattgtgcctcttataaaacaatggagctattgggttaagcataaccttttcagcatagtagaagacctccggaacctgcaaatatccataaattatattatatagttaatccaagccttgcacaatatctggaattctatctcagggaaggcactggttaaaattatcaagtgcatagtacagtagatgtttgatcaggttacacaaaaaattatcaaggcagatatgggcaatacacgtagtacattgttagagatggacagcactgtgttctcaaactgagcatcaggaaaattagtgatccaaatttattactaaagccctgaaaatcaagtattaattccataagactacagagcatttcatcaagctgtagcaatcaagttgtgtacatcaaaatagcaggcaatgcaattaaccatgcataaatgcaacagtgggatttagcttgcacaacaacatgtatcttccatcacagtatcaacacagagtcaggaatgaaaaaaatgggatttaacttgcacaaccaaatcattatagcttcatgtgccaactctttccccttagccttctatgtaacacatgattggaaatatgtgtaaatagaaaaaaaaaatgtcttataccaaggaattttagtgcaagtattttttttacaaaaatgtggagtaggaagcattcctttccttccaaatcacagaaaaaatatacactctcctgctgaggattttatacatgaaggaatacaaaggaatgttagaaatattaacaaatataatgccgagttgatgccaggagtgtatcgatcttagaactgctttgatatatcgggttcccacccacctagtacgcgacaactgtttagaaattagaagagtatcaaggtttgacatccaccgagaattttgaaaacaaattacaattacagttgatagaaaatattagcctacaggatatcaattattaactattcactcttgagagtagttcaaaaaatatttgcttaatctcctgtcttagcactttgtcgagcacttggccggcagaatgtactcaagcaattcatcaagtcctgcaaggaagaatcaagcaattcgtgaagcacgtaccaataatcaaggcggcccggcccgttgccgatcacgatcatgtcctgcacgatgtcatcccattggtcccgtggccgcccgtcaccaccaaccaatgacctgggcgaagcaactgagggcgtcgagcagcaggtgttcggggacgaacgccgccaccaccaagcacgccgccgcagcacggccgccccgggtcttcgcccgacaccgcccaagcacacgggcgtccgacggcgcccagccagccgccagcctcaccgctagccacgccggctcttcggccggtgtcatcaaccgctgccacccgcgtcccaccagccagccacgccatcgcccgcgtctcccgtcggccgtctctcccgccaaacgccgccgtcctcacgacacctgccgccgtcgtccgctccgtcagctcaccggccagatccggtggtgacgggccggatccagccacggaagggccggatccgacagcggcggcggcggatccgcagccacgcgccgcgccgctgcgaggccttcccggcgcactgtgccgcctcctcgcgccggagacgggccgtcgccgccatcccagcgtccacgcggtttccggcggcggcgaggcggtgagaggaggggagggtggcggcggccgggggctcgcccgcacgtggacgaccgaaggcgcgtgaagcaaaatttcagtgttccttcatacaagaatgtctcggtcgtcttctttgcctgcaggcgtcggcgtcggcctccttgttcttcttattcctccttcgcgtcagcagtagggtctcgacagtcgacggcggggcgaggagatcatggcgaaactggggtgggggtgaggtaggcgcggatgcggtgcggggagaggcggatctgggagggaggtgagagaggcgcagatgcgcaaatccagtggtgccgtcggatgtaatttgtcgtatgattttgcaccgttggatatgtgatatgataaatgatgaatgagtaaaaccatttgttgaactatatggtagataatgtaatatgattcatcccattaatgagctaatgtttctaagcatggctaagcaattatatataaagcatttagttgaaccaaaccaatatataaagttcaagctaatcaatttattacccataggaaaataaagtcatctttggccattaattaattgggaaaggcccaccacccgatgacattcaaaattaatgcataagttgaaataaaacattaactttaaacaagttcaacatgctcaaagggttgtttgggatctgtgtgactttccttgagcttcttcaaatgcttttgaaccttcctcaacgtaaacgctctcctccggaacgtcggaaactaaagcaaataaacaaaatcaacaaaacagtaaaaaacaagcataaacagtatatgtggatatttttaacatgtagatctcgattttagatgaatttagcaactcgaaccacttgaatctgagttacgatgatttagttatgaatttctgaagtttaatcagattttcatctaatacagaaaattattactatttaaataaaggatttatgatgtcaggatgacatcatcgtagccatggcactggaccacgactccgccagcgatagagagctcgggcgactaaaccgaaggcacctacacaaagaggacgacgagacgaactcaccgaagcaaagaactacgacaaacgacggcgaacgaagaccgacgacgaacttgacggcggcacggctcggctcgatgttgacggcgacgctccggcgaattgcagcagcggcgaaggagcggacgggacgctcctccacctggcgaacctgacggtggcgacggaaagcggcagcgacgaccacagcggcaacgcggcgcggccgaagcggctacggcggcgacggcactagggtttacgcggtggcagcggcgctataggcgacggctgcagcttggacttgaggcaaacggaagaggacgactaggggatgctttaaataggcatggttgagggagatcggactccaatcgagaggatttgagccggaaaaatccgatggttagtttggagagataaactcgaaaacgaatccaaattcgcatcgaactcaaagggataagatcggatttttgggggaagggagagaagaggataagggaaacaaatccactcaactaattttagaaatgcacgagaggaaaggccagatttggaggggaaaaaccgagccaattcggcctcaggtcggctgcctgaggtttgaagaagaacagtgcacagggaagcaaagtaaactttcagtcttgggccggctgaaaataaaatagagaaagaaagagaagggggaagctcggctgtgctaactgggctgcacaaccgtgctcccaaaggagggagatgggctagaatcagtccaacggcttaggggaagattaaaaactttttcaattaaaataattcgtaaaatgatgtttcatttattaaaaatactttccttgctcaaataattcacagaaaaatctagaaaatagataaacaagcaaagtatttaatgaaattttatctaactcagttttatgttgctatttttcctagattattagagtttaacttgtaagcctttaaaataatttctaaaaatgtgttacagaatgaattattaaattaggcgattttcagggcgtgacaagcctacccctcttaaacggaatctcgtcctcgagattcagaagaactagcaaaaagatgagaatgagctgacttcaattcatcttctcgctcccaagtggcttcttcttctgaatgattgctccactgaaccttacagaaccgtatgatgcgattcctggtgtttctcttattcaccacaagaattcggactggcttctcaacataagttaaatctttttgaagctctatatgctcaggatctgcttcctccgtaggtacacgcaaacatttcttcaactgcgacacatggaacacgtcatgtattcccgccattgacggaggcaactctagttgataagctacttcacctctccgactcacaatcttaaaaggtcccacaaatcgcggtgccaatttccctttggtctgaaaacgatgaactccccgcagcagcgtaacccgtaggtatacataatctccttcttcgaaagtcaaatccctacgacgattgtctgcatagctcttctaacgtgactgggcaatacgcaacctttcttggataatcttcactttttcttctgcctctcgcaatatatctgtcccaaaaacttgacgctcaccggtttgatcccaaatggagcggtgtacgacactttcgaccatacaatgcttcatatggagccatttgaagactagcttgataactgttgatataaccgaattcggcgtacggcatattcttatcccaacttccaccgaaatctagaacacaggctctcaacatgtcttctaaaatttgattcactctttttgtctggccatcagtttgagggtgataagtagtactgaaattcaaacgagtacgcatctcttcttgtagtttccgccaaaacatcgaagtaaactgactacctctgtctgacactattttcttgggaacaccatgtaaacatacaactcttgccatatataactctgcaagcttatttcccgagtaggttgttttgacaggtataaaatgagcaactttagtaagcctatcaaccactacccaaatagaatcttgtcctgccgacgttctgggtagaccggtgatataatccattcctatttcctcccatttccactctagaatcttcaacggttgcagctgacaggctggcttctgatgctccgccttgactcgctgacacacatcacatagagccacatattccgctatctctcatcgcatgctagcccaccagaattgttgcttcaggtcttgatacatcttagtgctcccaggatgaatggaatacaaagtttcatgagcttctttcatgatagttgttaacagtgaaatttggtaatcgcaaagacgtcatcggcttagaatcattatcggttgtagcatctcggaatcagccgatgggagttatcaagtcgccaataatcggattcctgctatattggttaaggaaatcaatctactaaaggaagcttatccctaagtgaccgagtttagagaggatgcggcatggcagtttatatattaattaggaatagtttgttagtttccttttatctttaggaaagtgtgtttagtgtccgataaggacttcatattttccttttatctttaggtgagtttctttcttgtccgacaaggacttgtatcaacccatggttataaatatgtacacccggggtctatgtaatctatctctacgatcaatacaattcggctcatcgccaccctttttacttctacttttgttttttacgttccggcggaacttggcacccgacgcggggctgcatcgtcttcgatctccggcgaagggataagtccaatgttccgtcggcccaggcaattgtctcatctacgtcggcgtcgttcaaggctgcatcagtatattcgacctcttggattgctctggtttgaatgatatatttgtctacctatttattatatgtctctgttaatctagtcttagcatatcaatttagctctatcggctgcttctcgttttagggtttctgccggtatcggctaaatcgcgttgctagattagattagcttagatatctaccaccctgaaaatcagtcaacggcttgattgtctagatattgtgtttcttttcatacttagtgctgcatcagttaagtttgatctactaagtcgtgcttagaaccataatctctagcctgcttcttgattgccaataggggttgggtttcagccgatgagttatctggatgttgcatcggctcataaggatttcatatacatataagttggatttagccgatgacaacaaaagtttcattgtttaatctaatcttgtggatttcatggcatcggaccaccagccgatgtgtgctttaaccttcggatcgatgcttatctatcatataaatgctagccgattggtttatactggactatattattgttatattttattatcagtagccgattgcctttatatcatcatctacattggacatatagccgattgcttaaaccctatcgctatcggctggtatcggcatcggctattatcggctatcggctggaactactccatcggcttgtcagccgatcggcttgtcagccgatcggctgttttgatctactatttgcatatcttgtcagttgcaggatcaaactgactagcacgcccgcatctcatcaatctttggacttgcactggagctaagcagatctcccaggccggtgtgttcgattttttttcgtcaacaatagtatccttcaactccttattatcgggcacgcaaattctttctcctagccacacagttccttgctcatcttctatataaccgatggtttttcctcttctcatgttcttttcaatttcttagatatcaagatcattcacttgagcctctctaacttgatcaaaaagagtaggttgagcttctaaagcggcaacaaaacctttattgactattcccaag

SEQ ID NO: 78133 - DNA, 656 bp, Oryza sativa
gaaggaaatataatccagttctgttttttcaatcggtgaacccaatagacccttaccataccgcacttgtctttgacgtgcattacgacctaatttgattttgatttttcgaatatgattttttataagtaattttaggtagattaacaagcaacgaaaatgaacgaaaattactaagtaaaccactgaaatcaatctgaaataaaattttaaaacttatatgaagatttgcctagcaacaccttagtttgatgctgatggcattaaacgggtatgcagatgcccatgctccagagtccagagggctattagtgcgtttaatttccatacctctctgttcgtgcgaatatgatagttgtggtgtagatatttttaaataatgaaataggcgtcatgtgtagtgtagagatatggcatatgtgaaaaatgtgtcaagccgtgctcttggaagtataatcctaatcaataaaaacagaaacttgcacgactgtacgatctccagttctcctttgggagtaactagttggtttgagttttgttttttaatgggtttgatttgattcattgattgtgatgccctttaatcattgtagtcttataatgtcgtcgtactcacccgtgtttcatattagacgggtaccgagctcgaattcgcc

SEQ ID NO: 78134 - DNA, 15211 bp, Oryza sativa
ctgacatatggcagtagcttttcctgctgagagcatctgctacaacatttgctttacctggatgataatgaatttccatgtcataatccttgatcaactctaaccatcttcgttgacgcatgttcagattaggttgagtgaaaatgtactttaaacatttatgatccgtatacatctccgtacggttatcaaaaaggtaatgacgccaaatcttcaattcatgaaccacagctgccaactctacatcatgtgttggatagttattctcatgagggcgtaactgcctagatgtataggcaaccaccttcccatcttgcatcaaaacacaacccaaaccatgtctagatgcatcacaatacacctgaaaacctttccttggatcaggcaagactaacattggcgcagtcactagccttttcttcaattcttgaaaactctgctcacactcttccgtccacttatacttcacatccttctgaagcagtcgagacattggtctagcgatctttgagaagttctcaataaacctgcggtagtaccccgcagaccaaggaaactacgaatctctgagaccatcttaggttgcttccaatttagcactcactccacattgcttggatccacgacaactcctccagctgagatgacatgactaaggaacttcacttcgggcaaccaaattcacatttactaaacttggcatagagctgatgctcacgtagtttctctaaagcaagacgaagatgctcttcatgctcttcttttgtcttggagtaaataaggatgtcatcaataaacaccacgacaaacttatctagatattccataaacacgttgttcatcaagttcatgaaataggccggggcattagtgagtccaaacgacataacggtactttcaaacaaaccataccgtgttgtaaaggcgatctttggtatatcctcctcacggattcaaagttggtgatatccggaacaaagatctttcttggagaagactgtagcaccttccaattgatcaaacaagtcatcaatcctaggtagaggatacttattcttgatagtgacctcattcaacgctcgataatccacacacattctttgggtatgatctttcttctccacaaagatgactggtgctccccacggcgaagtactgggtctgatatatcctttctgaagcaaatcatccacctgtctctttacctctgctaactcaatagctgccattctgtaaggtctcttatggatagggttggttccaggtactaagtttatccggaactctatgtctctcttaggtggcatacctggcaaatcctctgggaacacatctggatagtcttgtactattgggatctcttgcaaagcaacttgatttaatgtcaaaccatgagatctaggggaggacacaaagaaagacactgtttacccattgctacttgttaaagtcaccttacggttagcacaatctataactcctctgtgatgggttagccaatccacccctaagataacatcaagatctttggattctagcaagataagtgtgatgggaaaggaatttcttgtatttctgtagtaatggaaggacagtactgcgttgaggatacttgattgcctggggtattaactagtaaaggcctcccaagactaataacttccattccatgattgctcgcaaaacttttagacaaaaaggaatgtgtagcaccgaaatcaaaaagcacagttgcgggtatagagttaacaggaaacgtacccaaaaccacatcaggtgcattctaggcttctgcagctgcaacgtgattaacacgagccttcggtgctggagcattggagttgttctggacaggagcattcttcacacgccgaggctttggacacttatcagcataatgtcctggatcaccacaattgaagcacacccctggcttgattccctgttccttcctgacaggctgattttgagttggagctgctacaggacgagtgaccacattacgattgtcgttgctgtgattaccagtgttgttgttgtagaactggcgttgagggcgagcaactgaagaggatcctccctatgggtatggtgcagcttgaggtcccaaagcaatgcgcggcctctggctattaccctattgagccttgaaataagcagccctacgcttcttctgttccatcctattgtacttgtcttcttggcgaatcgccttgtccaccaactgctggaaattccggtattctatagccatcaatgcataagacaactcatcattcagtccctctaaaaacttctcctgacgttcttcatcagtgcgaacatcatctgggacataatgagctaggcgattaaagtcatggaggtactctgtgacagaacaggatccctgattgagtgctctgaaatctctcttcttaagtgccacaacacctgatggtatatgtgtcttcttgaaagtagcagtaaactcccgccaagtgataggctctcccgcagctctgtgtttgacaaaagtgatcccaccactcagcagcaggaccatgcaactgatgcaaagcaaaggaaaccttctcctactcggtgcgcagaatcaaatctaacttcttttcaacagcatgcagccaatcacctgcctctactgggttagtggtgcttgagaaggtaggtggtctcacacgtagaaaatctgccaacttgttctttggaggtggtggttgattgttgttatttgcctgctggttctgcgcttgctgcactagtagattaatcaactgagtttgctgagccgaaacttgggcaagtgtgggatctccttcattgtgaccacttccacttccagtgccggtgttcaccatctgaagaaaagcacgggcaaaaggaaagattacatttaagtatgattacatttaagttgaattaacactatctcactagctaacttactctttgacaagcaaaagaactaaactcatgtagttacatcccaccaatgatgtaagcaacacgcaaaacccacacacgcacaagcaaactaacacatcgaactatggcaacggtctaactaggcaactaatcccgccttgcatcggaacgaagagatggatcttcttcctctggagtagctggctctctttcttctgggtcttcctcctcttcatcattacttaagacatggatgataggttcagcatgatcaggcacaacatctcccaccacacgagtcttcgaagccaactggatacgaggtggtggacgggttctcttccttgcggtgaggcgaagtttgggtgctggcggtggtgcttctcccttaagctcggccagttccttctgcagacggtacaccttgctctccaacttgcaaatcctgccacggttccagttttccctgtcatcagctgttttctcccgctccacgcctactgcatccatggcgctaagcatatacacagcatgcttcagagtggtgctatcttcatcttcagggcagtggtaaactccatagtcttgaccatgaggcttgtgtggatgatactggaaagctgatgactctaactcctcatcaaagcgatgacgtagctctccaatggccaccaaggctacctcctgacaagcatgactatactttcttcccccagcttcaaactttatcgacagaaggtcttctcgatcactagtcaacgtcacgcgaacacgacacttctcctcgttggggtcatagggaatctggcgatactcaggggcaacgtcgtagcctacttcaaatgccatcattctcagctccctgacgaatcctaccgcattgatcaagctttccggcggatggggcggcgtctaaaggagcacagaaagaaggaattaatgcatatatttaagttagctgcacaaactagacttaattaatttgacccaaaaagaaaaataaaagaaaaggagcaaacagaactaatttttttatttttttaattaaatttcgaatttttcttatctggccgaaacataaatttttagaaaccaattcgttttattttttcagaatttttttcgaaaatttttatttatacaggggcatagactttggaactaaacaaaaagaagcaaatatattttcttcctgtacagtactcgtgggaacagaattaaacaaagttttgtttggaaaatgaaatcaactttggacagacacaaattgctttacacaaatgaataaaataaaactaaaatacttagtatctaccataagaacggtacagtgtcaccattatatattttcttcctgtacagtactcgtgggaacagaattaaacaaagttttatttggaaaatgaaatcaattttggacagagacaaattgctttagacaaatgaagaaaataaaactaaaatacttagtatctaccataagaacggtacagtctcaccattaacaaggatgagtagtactggtgctatcttgattgaatcgataccataatagatgataatagatgtacagtgccggctaaccaatgaaattcataaaatcaaactacttaacaccatgaacagtaaagttttttttttaaaaaagaaaagaacaggtttctgttttggtaaagtaggatttagtaaattttgtacataaccttgcatgtgctgcaaacttaattaatttataagagaatagagaaaagcagtcctatttttcaaaaaattttgaaggctacttaaggtttaccatttggcttgtcctaaggtcaaggtggctctggtaccaacttgtcacgcccgaaatttctatccaaaattccaaacgcttacatgtgcttaaatcctcgtccaggaatcagccgaggcacacaataacaaattgataatagagtactatcaaactactaattaatattcgcaaaataataaattattacagagatggatagttcctctcaaaagaataaaattctacgcagcgaaaaaacacaataacaaattgataatagagtactatcaaactactaattaatatttgcaaaataataaattattacagaggtggatagttcctctcaaaagaataaaattctacgcagcgaaaaaaaaacaaaagactaaacagctatggcgactccactccgcaagcaacttgacccaaacaaagcctactcctcctgatcatcaccttcactgaagtactcctcctctgaagaatgaatattgcaagaatgagcatatgacatactcaacaagccacacagcaaatatgcaactgcacaggatagcaaaggatggcataataaagctcatttgcacaaacaacacttaacaaatatttgagagaatagtcaaacagttaaataattaagcaatattaaataaacactatacaacacacccgtgttgcataggcccaacctcatctgaacaaccaaccccggttgtacaaatccaacctccataccaggaatataccattccaaaccaggagtcaatttaattatcacaggttatcaccaataatgagtaatgtgagactaatcacgaaaaacattgttagacccgcccataaccgccggcacggctattcgaatagttttactctggctagagatgtaccactgtacccacaaggcacagctccacaacatgtcaccatgcgcctcaataccatcacggtacctcggaaaggaactgtgataataccccttgcacaacacaactcaccatagtgcaccatacctggatcatcatcaacccctctacaaccagaggcatggactccctagcgaccccatggacttctcgccgcttctcagtctggcaccccgtaatgaaccatgctatacaaaaggtaaagccgttgcccacgctggcttgtggttggcacggtaaatgtttcacaatagtagctcgcgaaccggtccttaattgtcatgagcacgaccatccaaaccatgtgctcacaacccacctttaatcaggttttaattatcaagtaattattgtcgcgtcccaaaacgactctaaaatacatcctcaaaattgtgccgagaataattaaaatccatgtgaaagcctccaacaattaaaatgtgcaaatttaaaagtcaaataaggcttggaggatttttgtatatttcctaaaagcctaaaatgtgtaaataaattttagtggaattttcagagcacaaataataattgagaagaaataaacaaagttaaaaaggttttataaaaagaaaaaccctaaaagtcttcttttcccccccttcccttcttgggccggctcggcccagttctctccccccctctcctctcccccgcggcccatcggctctcccccgcgcgcgcgccgctgacgggcgggcccgcccgccaccctcgctgacaggtggggcccacccgtcatcccctacctcgcgccgcagccgccgccccgcccgtgccctagcgccgccgccgccgcggattccgccgcatcccgccgtccccgcgcgccataaagagggggaaatcactccccgtgattccctccctcttttccccctctttcccctctctctctccctcggattcgtccggattcactcccgcgatcttcgccgacgcatcaatggcggccgagatttccgcggccgattccttcccctccggccgctctctccctctcccggcgctatataatcgttccccgtgcttcgctcctccgtttccgccactcgccgcctctcctccccgtcggaatcgagcccgcgccgtcgcaccttctctccgccgtcgccgccgagctccggtcagccgccgtcgtcgctccggaccgtctcccgccccgacgccgcccccttcggcttcgccgcgtcctcgccgacctcgtccgctcctccgtttcgcccgccgaccgccggagcgccgtcgtcctcgtcgacccgagccgcgccgccgccttcctccgctccggtcgtcgtttccgccgccctcgtcgtcccggggtgagccgtggaccgcccctttcgcttcccccttccctcctctctctcgggtgccgctccgccgcgccgttggtcgccggcggcgaccatcggggcgcgggtgcgccgcctcctgtcggccgtgccggcgaggccgccttcgggcgcgccccgcggctgccaggtgggcccggccgtcagccgcccgcgcccgcgggtgcggctgacgcgtgggacccacggcgccgaccggcgccagccgcgtgcacccggtccaccgtggaccgttcggctgacgcaataaatccgatttttaattaaaatttaaatgaagaaattcgcaaatatccatttaaagagcatataaacttcaaatggccataacttggccatttgaactcggaattggaccgttcaagtctctaatttttccttataaagccaagaacccatttttgtgctttgtttctgctgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccctatgattgttattgttattattaccttgttcaccctagaataaacaaaacctcaactagtggacactctactcatggcatcactagtttaattttaggtagatgcttcgcaatttaattaggtaacattaggtggtttttcaattttagactttgggaaatattcatatcacctggatactctggaatggtctggttattgtggaattggcttcacaccgctccctcttttcaaaacccccaaaatggttttaggctgggctcggggtgcatggttttgatagtagcacctcggccatataaggaccggtcttcgggcctctgttgcaaagcactaccgtacttccacatgtctagtgggtaaggcttagtttatggctcagtctggttataaacaaaagtacacagattggagatggatgaagtcgggggtcgatggacattctccagggcaaatgaaggctacacgagctgcggcccggtagtcgagatgtcatggcacagggccggtgtcctgttgctgggggctcagtcctgcctgcctatcccgggggttccggccgtaggtgggattgggtcggtactcttgtctatggctaggatgggttggaaactatgtcacgtcttccgtctgtataccgtggtggtatgtggcacgtggctacacgtgaggaagatgtgtcttgtgggtaaagatgtacacctctgatcagagtataatctattcgaatagccgcgccctcggttatgggcaagccgagcaatgtacccaagttagtgttttaattcttaaaacttgcttatcaactaaaatgtggaatggttggcctcggttggcttgggacgagctgggacccagggtcgggttgccagttcggtctgaatcatcgtaggccttgggttaaggcaggtccgtgtgggttcacggccttgattaataacattgtatagttctagaatcgtgtttacaaaatagctttggagcaactaaatatctttaaatgctgtttactgcaaccctaaccctctatagtataattcccttgtactcccttgcatttattctgcacttgcgggtgtgtcttgttgagtacggtggttgtactcagtcttgctcaatttttcccaaccccagaagaggagttccttgaagatgaaggctttggtgtctagctcgtgcctgccgtcaagcgcctgtggtcgtcgccctagtcttccgctgtttcccgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtcaggaacgcccgttgggttatttccggtcgtgacaattatcatagtacgattaaccatcatgagctaccagtaaaaataaccataaataataatgtagtatgattcatcccattaatgagctaatgtttctaagcatggctaagcaattatatataaagcatttagctgaaccaagtcaatatataaggtccaagctaatcaatttattacccataggaaaataaagtcatcttcggccattaattaattgggaacggctcaccacccgatgacattcgaaaataatgcataagttgaaataaaacattagatttaaacgggttcaacatgcaaaaatggttgtttgggatctgtgtgacttgccttgagcttcttcaaatgcttctaaaccttcctcaacgtaaacgctctacttcagaacgtcggaaactaaagcaaatgaacaaaatcaacaaaacagtacaaaacaagcttaaacagtacatgaggatatttttaacatgtagatctcgactttagatgaatttagcaacttgaaccacttgaatccgacttacgatgatttagatatggatttccgaagtttaatcagattttcatctaatacagaaaattattacaatttaaataaaggatttatgatgtctggataacatcatcgcagccatggcactgaaccacaactccgccggtgatagagagctcgggcgacgaaaccgaaggcacctacacgaagaggacgacgagacgaactcaccgaagacaagaactacgacgaatgacggcgaacgaagaccgacgacgaacttgacgacggcacggctcggctctatgtcgacggcgattctccggcggattgcagcagcagcgaaggggcggacgggatgctcctccacctggcgaacccggcggtggtgacggaaggcagcggcgacgaccacagcggtggcgcaaagcggctgaagcgtctacggcggcgacggcgctagggtttacgcggcggcggcgccataggcgacggctgtggcttggacttgaggcaaatggaagaggacgactagggaatgctatatataggcatgggtgagggagatcggtctccaaacgaaaggatttgagccggaaaatccgatggttagtttggagagataaactcgaaaacgaatccaaattcgcatcgaactcaaagggataaaatcggatttttgggggaagggatagaagaggataagggaaacaaatcccctcaactaattctagaaatgcacgagacgaaaggccggatttggagggggaaaaccgagccaattcggtctcaggtcggctggcagagcttgaagaagtacagtgcacagggaagcaaagtagactttcagcaataggccggactgagaaaaggcagctcagctgggctgactgggctgcacagccgtgcacacaaagaagggagatttaaaaactttttcagttaaaataatttgtgaaatgatgtttcatttattaaaaatacttcccttgctcaaataattcccagaaaattccaggaaacagataaacaagcaaagtatttaatgaaattttatctagcttaattttatgttgcactttttcctagattattacagtttaacttgtaagcttttaaaataatttctaaaaaagtattaaagaatgaattattaaattaagcgactttcagggcgtgacaaactcggatatgccaaacacaacatactgtgaggctagcaccagggtctgaccagctggagggtaagactccaaaagagattgctaaatacaagaagggcttgcacaaggagaaattgattattgtcgcacagaacattggacgaggcttcttgcactttcaaaacaagagagtcgtcatggctgcttataattttaagtaagtctggtacatttatcttgtacacatatatcttattttagctggtactaactaactatactgttgttaatatgtagcgatcaattatatctgtttactcatccaccctaaagacggaaccgtggtagtcttggaccctctcgattacggtcacaagcaatacaaagaatttctagcaatcttacggtagtaagtgattatgactcttgcatttttatatgaatgtattataaataaatatcctccttaatgtgaaacggtacgacatccatacaatgcgtaccaatactacaagttcaagggtggagaatagacccgaacaagggagaagctgctagcacgtaccttttggccggtaatactccactcacttaatgttttccaattgttttactaattgcaaattttaactattcttttctatgatatgtcctgaagagtcacaagtaaccgcgaggaatggtcctttgcgggtattatgtgtgtgaatttcttagggttaatgggaggtacaagattaacgcggaggatgtaagtctctatactatgtactagacagcttcacatatttatgatactaatatattgattaacttcaatgcatgcagttgccaagattagaacgtcgaacaagctttgacgatacagacatcacaaatgtccagcgtgatctgtgccatttcatccaccatgagtgctgtcatgtgaaaggagatttcttcgacccagagggtgccctagcgacaagtgacgaattcaaggatctttgggagtggaacactgctatgccataatgtaactagacggcgttatttgaagtgacaatgtaaaaaaatattgtaatatatatatatatatatatatatatatatattggcaacactttagatttctcagtactataccaaatgctcgataatcttctaatatatgtacataataatctacctagaagaatttctattaatgggcaaattattattaaattttaatattttctacctattttcgcaggcggattttttttttgcaggcggccgattcctattttcacaggcggaccggacaagccaacgtccacctgcgaaaattatcttcgcaggtggacggccgccctgtctgcgaatatcggcgatcttcttcacagtcgttggcttataggcggacggctgccccacctgcgaagaccgttttggcccgcttgcgataatgcttttcctagtagtgggcagccccatgcacggccaccttgaagttgtcgtgctcatctaagctgtcgatgtgctcctgcgccgtcttcacaaaatcgctcaccacgccgcctccaaagtgcctagccaatacatcctcgtgtggcgcgcacaatgctctcgccgcgaacgccgccttgttctttgactgggaggagctgctgcgctgctgcccggcatggtcacgaagagctcccgatacacaatctcgaaggagccctcggcgctgactgcctccaccacctcctctgagcaaggctcgtaaatgggcagattgaacatctcgagcttctccttgtcaaccattccctgattagacatgtatcgtaccattacatcgaaatgaaatatggagatcatggaggtacctctattttttaacgttgttcatagtcatatgaaaatatatataagtcatgtctaaaatatttttatgataaaaaagtcaaatatttttaatatattttttttaaaaaaataaaacgaatgatcacatattattttacctgagctgccattttattgaggatgatggagatgtgatcccacatacgtgtgtctccgcttctgaggttgtctatacatttcctcccttttacggagattaccagccatcctcccgggatgatctccttgcctcgtgactcgagaaacaatgtgaagtcgttcataaactgtagagcgtatgcgtcacatacttccggtgaacatattttgcccgcacatatgccctccttgtttgtcagcttgccgatatgcacttcttcagggacctaaatcagtaatcacgattaatttcaagaataagtttctctgaaatcattgtttcttctgtgacagtaattaagtctctgaatatcctgaggacggcaacaaatgtgttaggaacgactcctaacttaataccatctgcgttacaaaaataattgacattttggggatagcaaaatggtcaccaggatactattttgattattagttactcgtaaaaagattattgttggcatcgaaaatcatttcagcaccaacatatagagatcatatagctcccttctgtaagcgtcacaccaagaagtgtaaaatcaaatgtgtttttgattattattctgtgatgaacaattgggcattggagattattggttttgttatttgtaatttattcacgaagtggttttggagatgattggatttcacaggtgaatatacaggaactgctgtggttttatgtggaccggtcagaccgggctctggtagccggtcagaccggcgtgtaatgcacggtcagaccggcgcagcccgtggtctgaccggccgatactgtgttggtttcggtttcgggttgtttatttggatatccgagtttatttcatgattatgacttctggatggatactatacgtatgtaatactattgtttgctgctaatgagtcaagttggagatagcttggtctcggaatatggtttctttgtttgttccatgtgtaggttactcgatgtctcgggagagtatttgcggtgatggaccgggagtcggcttggggataagacgacgtccgtggtggtcagagatcatgcggaatacttaggctagagttgttgcacgtggttgatggagattccatatggcatacgatggaggaattgtgtgcgtatgggatgcggagtcgaatttggaaggagtccaaatttggtacgtttggttatgtaaagtttatttcttcgatttgtgtttcaccgggtttcggcggtctaaccggcggcgcaccggcggtcagaccggcagcgcaccggcggtcagaccggcggcatctcggcggttcgaccggcgggcacacggcggtcagaccggtggctacaggagtcagcaacaggcattttcggcggttcgaccgatcgatctacatcggtcagaccgacgttcatcaggcggtcagaccggcgcaactacttcggttagaccgtgatccatcgatttcgagggtaacttttattttcgctaaaagtttttgatttttgggtataccaaccattcacccccctctggttggcttagttcctgtgattcgatcctacaagtggtatcagagcctcgttttcttctttggatttttatcgatctaaagtttttttgccatggctactcccgctaggttttcaactaagcctcatgttttcgatggaacggatttttcttattggtgtagtaggatgcaatcttacattatgtctgaaaattatgatatttggaggaaagtttctcatccttatgtgattcctgaagccattaatactgatgctttaaaaactgaatttgaaaataattgcaaagctcgtaatattcttttgagtgggatttctcgttctgaatatgatcgtgttgcacatcttgaaactgctcatgagatttggaatgctttgagaaattttcatcaaggaacaaataacattaaagagcttcgtcgagatctttttaaaaaggagtacattaaatttgagatgaaatctggaaaggctttggataactatctttctagatttaataaaattttgagtgatcttagatctgttgattcttcttatgatgttaattatccacaatctgagatttctcgtcactttttgaatggtctcgacatgtctatttgggagatgaaagttacatctattgaggagtctgttaatatgtctactttgactttggattcactttatactaaattgaaaacacatgagatgaatattctttctcgcaaagttgattctaaatcgagtgttttggtttcttcttcttcttctttgattgttgatgcttcttcatctatgccttcttttcttgctgcttttaatgccacatccgattatcaactcgaacaaatcgaggaggaggatttggctttggttgctaacagaattgctcgagctatgaataatgtcaggaacaggaaaagaggtggtccaaatcgttgctttgaatgtggttcaattgattatcttcgttcgcattgtcct

SEQ ID NO: 78135 - DNA, 8244 bp, Oryza sativa
aggaagagttcttcaatgaggctgatggtgtggaggagtaggtgtagccttggtcaagctgcctgtggagtgaagccgtctacgccgtttaatttatttttccgctgcttagatctttattgattgagaggaactatctacctctgtaatgacattttatacgcttattaattagagtaataattgtactctattatcaatttgttattgtgtgcctcggctaattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatacacttcataatcccttttaatggttctcattcaaaatttattccagtgttattagtaccgtacatctattactgtactaatggcttatttatcagcaaaagttttacaatattgttttatttaatcttgctgcaataaaataaagttagcatgttgattttataactttcttttatttcttttgaaacctgttattcaaaagtacaaaatttgtgaccttgtttccaactgttttaacttatcttgcaagtttggtttactttatttacttacctttttactctgatttttctaaactttattcaaattaatccaaaaacttgtgctgttaattggatagatgtcttaactccctcctttcacttgtctttagatgccgcgctacaagcctgagtacctgtttggtgttgagggttttgtccaggagttgcgtacgatgtcctttgtcataggatttgggactgcccctttttatgctcagattcctcatgatcgtcatgaagagaagtgccgagtcaaagtcaccttgaatagtaatagtgaagatgtcccctcagtgatgttcgaagctggaggaagaaactacatccatgcatgtcaggaagtggcaaggatcgccataggagagctccgtgatcgctacagtgatcggttggctgacactgagtatcgctaccatcctcgtcaaccacagggaagtgaccgtggcagctaccttgagactgaaggaattgagaatgatgctaccacaaggcatttagttgagatgctgtgggctatggatgaaagccgtgcagagactgtgttagcggctcaagatcgtgaagattggaatcgtggtaagatttgcaagttagaagacaaggtggatcgtttggagaaggaactagccgcgttgaagggagaagcaccaccgcagaaggccaggattcgtcttaccgcaaggaagagagctctatttgtccctcgctatcaattggcgccaaaagttcgtgtggtggagaaagaagttgccccagcagatcctccggtcatcatcataagtgatgatgaagaagaagaatccaagcgcacccattccaagattgagtgggtagcaactcaagatgatgaagacgagccgaacgagcctacaatcgacctccgatgctcggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctatcctaagtagtttcccccggtttctcttcttgtgccctgccagatggtgctcactcgcagcaacgggaatggccccaacagcaacaataacaacaacaatggagagaacccaacacttgctcaagttcttgctcaacagactcagttaatgaacatgatgatgcagcaacttcagaatcagcaaaaccaaggaaataaccatgcacctccccagaacaagttagcagaatttcttcgtgtgaggccgcctattttctctagtaccactaatcctgttgaagctggtgattggttgcatgccatagagaagaagatggatttgcttcagtgcactgatcaggagaaggtctcatttgcatcacatcagttgcttggccctgcctctgaatggtgggatcacttccgcctgaataggattactgctgaacctattacttggcttgaattcaccgctgctttccggaagacgcatataccatcgggagtggtgtctctcaagaagaaggagttcaggtcgctcacccagggatctcgctctgttacggagtatctgcacgagttcaatcgtcttgctcgttatgctccggaagatctgcgcaatgatgaagagcgccaggagaagtttttgggaggacttaatgatgagctttcttacccactcatggttggagattatcctgatttccagaaattagtggataaggctatacgtcaggaggacaagtacaatcgcatggagcagaagaaacgccggattgctcacttcaaggcacaacaggggagtaatcagaagccgcgtcttactttaggaccccagtctgtgccacagggaggttcttcgtccattgttcgtccgcagcgtcagttcttcaacaacaatgctggcaacaacatccgtaatcaagtcccacgtcctgttgctgcctcgacacagcaacaacctgccaagaggaagcaaggcagcaagcccgtggtgtgtttcaactatggagacccaggacattatgctgacaagtgtccgaagccccgacgcgtgaaggttgtccctgcccagaataactctgctgtaccagcatcaaaggcccgtgtcaatcatgttgctgctgcagaagctcaagatgctccagatgtgattttgggtacgttccctgttaactcagttcctgcaactgtgcttttcgattctagtgctacacattcattcttatctatgagttttgcgggaaatcatgggatggaagtagaagatcttagacgtcctttgatggttagtaccccaagtaatcaagcactctctctgcaacgtagcccctctgtcagaatagaaattcaaggggtaccatttctagccaatcttatcttgttagaatctaaagaccttgacgtcattctagggatggactggttagccaaacataaaggtgtgatagactgtgccaacagaaaagtaactctcatcagcaatgatggtcgagttgtaactgttcatgcattgtcatctgagtttttaaggtcaagactgaaccagataactttgggagagattcctatagttcgggagtatcccgatgtgttcccagatgatttacctggtatgccgcctaaaagggatatagagttcagaatagatttggtacctggaacaactccgatccataagagaccttatagaatggcagccaatgagttggcagaagtcaaaaggcaagtagatgatttgcttcagaagggatacatcagaccgagttcatcaccatggggagctccagttatttttgtggaaaaaaaagaccatacccagaggatgtgtgtggactatcgtgcactaaatgatgtgactatcaagaataagtatccgctacccagaattgatgatttgtttaatcagcttaaaggtgccactgttttctccaagatagatcttcgatcagggtatcaccagttgagaatcaaagagtaagatatacctaaaaccgcttttaccactaggtatgggttgttcgaatgtacggttatgtcttttggacttaccaatgctcctgctttcttcatgaacttgatgaataaagtatttatggaatacctagacaagttcgtggtggtctttattgatgacattcttatctactcccgaaccaaagaagagcatgaagaacatcttcgccttgcattggagaagctacgagagcatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcacagttttctaggcctcgcaggatattatcgaaggtttatagagaatttttccaagattgctaagcccatgacacgcctgcttcagaaatatgtgaagtacaagtggtcggaagaatgtgagcagagttttcaagagttgaaaagtcgtttaatatcagctcctattttgattttgcctgatccaaagaagggtttccaagtgtattgcgatgcatctaaacttgggttaggttgtgttctgatgcaagatgggaaggtggttgcctatgcatctcgtcagttacgtccgcatgaaaagaactaccctactcatgatcttgaattggccgcagtagttcatgcgttgaaaatttggcatcattatcttttcggtactcgtacagaggtgtataccgatcacaagagtttaaagtatatctttactcagccggatctgaacatgagacaaaggagatagttggaattaattaaggattatgacatgggaattcattatcacccgggaaaggctaatgttgtagcagacgctcttagcaggaaaggttattgcaatgctaccgaaggatgacagctgccattggaattatgcaaggaatttgaaagattaaatttgggaattgtcagtagaggttttgttgcagccttagaagcgaagcccacactaattgatcaagttagagaagctcaaattagtgatcctgatattcaagagatcaagaagaatatgagaagaggaaaagctatcggtttcttggaggatgagcaaggaactgtatggttgggcgagagaatttgtgtccctgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatacgtagcggtatgtgatatttgccagcgagtcaaggcagaacatcagaaacctgccggtttgttgcagcctttgaagattcctgaatggaaatgggaagaaatcggtatggattttatcactggtttacccagaacgtcatcaggccatgactctatttgggtaatagtcgacagacttaccaaagtggcacatttcatcccggtaaagacaacttattccggaagtcggttggcagaattatatatggcaaggattgtgtgtttgcatggtgtccctaagaaaatagtgtctgatcgaggcagtcagtttacttcaaatttctggaagaaacttcaggaagaaatgggttctaagctgaactttagtactgcttatcatccacagacagacggacaaaccgaaagggtgaatcagattttggaagacatgttgagagcttgtgctttagatttcggtggaagttgggataagaatctaccttatgcagaattctcgtataacaacagttatcaagctagtcttcagatggctccttacgaagcactgtatggtcggaagtgtcgcactccgcttttgtgggatcaaacgggagaacgtcaggttttcgggacggatatcttaagagaagcagaagaaaaggtaaagatcattcaagaaagattgcgtgtggctcagtctcgtcataagagttatgccgacaatcgccgtagagatttgagttttgaagaaggagattatgtgtatcttcgtgtcacgcctcttcgaggagttcatcgttttcacaccaaaggaaaattggcaccgcgttttgtgggaccttataagattgtcagtagaagaggagaggttgcttatcagttagaattacctcaatctttggcaggagtctataatgtgttccatgtgtcacaattgaaaaagtgtttaagggtacctaccgaagaagctaatattgagcagatagaagtccaagaggatttgacctatgttgagaaaccaatccgtatcttggaaacaaatgagagaagaaccaggaatcgagttatccgtttttgcaaagtccagtggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaattcaaaatttataaattgttgtttaattggaatttttagaaataattttaaaagtcttgaagaaaagatctaattttaattaataaattccaatataaaatggggccagataaaatttcattaaatactttgcttaattctataattcctagattttttctgggatttatttgagctaaggaagtatttttaataaatggaattgcatttaagaaataatttaaattgaaaaaggttttaaaaagtctcttttggctttgggccgaaagtcggcccaaaaccgctctctctctcctcggcccagtccggcccagtccgcagctgccgcgcgcgcgcgccctcgctgtcgctgacaggtgggtcccacctgtcaggcccgtcgtcttcctcgggccgaaaccctagtttcgcgccgccgccgccgctttccaatccggccgtccctttccttctccggccgaattgatagaggggaaatgatctccgggatctcctctaccttttctcctttggaatctttggctaaatcgttttggaaagcgttggattcgagtttgtctcggattcgttcttcccgatctttccttcctcgccgccggccgccgtgggcctttgccgtcgcctccgagcccctttaaaaggacccccggtgtctcctctacccgtcgccaccctcgccttcgcctcacgtcgtcggaatcgctctagcgccgtgtgccctagctttgccgtcgccgtcgccgctccagccgtgcgccgccgtcgtttcagccgtcgccgtcgctcgggaagaccaccgtcgtgctcgccaagtcgtcgccgtcctcgtccgcctcttcgctgtcgccggagatcaccggagcagcatcgccgtcgtcgacccgaaggttcccgccgcttcctcctcgtcgccgtcaccgtccgttggtcttccgccaccgtttaggtcaccggtgagttcgccgcgttgtcctctccgtcttggtgccctccgtttgcgtcctagcaccgccgttcgccgacgagcgtgcgccgttcgagccgtctcctccgccgagccgccgccgctgtcggtgatgtcaccgctgacgtcatcggggtcgtccgccgtgagccgccgtggacccgatcgatctcggccgtccgttttggatcaagttgatctcggccgtccgttcgtgtgaaccgccgcccgtgcgcccggtccaccgaaaccctagcccgctgacgcaataaaccttcttttccttttcaaaaataattcattattgcgtcataattcaatttaagccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgttcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatttattttcgaatgtcattgggtggaattaacctattctttgttatggcccttttgtacttgattacttcattccttcataccttgggttattacaatttgactagttgagctttatttatattggttcaactagatattagatataattgcttagcctgcttagaaacattatgtcacgaccggaactgacccaacgggcgttccttgtgtgcgtgcattaatccttgtcccaggaggccaggtacaccaaaagttgatacaattcagagtttaaccagcccaagcgtaaatagataatttattacatgggcagcgaaggcccagc

SEQ ID NO: 78136 - DNA, 13547 bp, Oryza sativa
  unsure (1)..(13547): unsure at all n locations
gtttgactgcgacaccataatgangtgtgtgaataagctatgacanggtgactctcncacttacacatataatcatcgtccttattctcataatagtattcgttattctctctanttcctcctcccnnccnccncccccaggaggtttggatttgcatttgcanctaccgcaagnagcncatcactcaacgattcgctccgattcttgggggaaaagaaagaggagaacgagaggaacaaaacccctcaaaaacccggaggaatcggggtcggattaaggcggatttggaggtagaaggcggcggcaaagcggcggctcgggcggctcggccggaggttgaagacgagcccgacatgtgggccccacatgtcggtgactcgagagagagaagggcgggcggcggctgggccggcgtgggccgcgcggaagagagaggatgttgggccgaattcggcccaacggcttagggaggggtttctttgaactttttcaaataaaacaatttgtgaaatgttgtttcaattaataaaaatacttcccttgctcaaataattcccagaaaaatctagaaaatagaggagcaagtatagtatttaataaaattttatctagctcatttttatattgaaaattttcctagaaaattagggtttagcttgtaggcttttaaaataatttctaaaaatgatttaaaatatgcatttttaatttagttgatttttagggcgtgacaatccccttacaaaaacagtttgaaaattttcagaaaaatttctctgaggccgatctgaccgaaggtgtacagccggtctgaccaagggtcggtctgaccactgctgtaccgttggtctgactggtgctcagtctgaccgaagcacagccgccggattgactggtcgccggtctgaccgcgggacccattgcggtctgaccggtttcctcgagaaaacaccagatttttgccactttgattttgcaaaagcaatttctctctgctttttctatctatgagctaatctaaaacaaaaaccaacaagatgtccatctttaccacaaaaagaacaagcatcctttttctttagaagaagatggttttgaaatatttgtttttgtttattttagtgttgtagaaagagagggcataactccagcagacttgaaaactgttttcttagcactaggtttggtcaaaatttagccatgttcagtcacactcaaaacattgggttgattttttattgaaaaagtcatgaacatcaaaacgaacacccctattgtagctagtcactttagattgatccaaaataatgttaagttgtttcttaccatcagaaaatctttgcaaagaacttttcaaataagaaacctatttttccaaattagcacaattttcacaatctaccatgacacttttgctttttcgacatttggggcaagaaagcacttcattggttttcacaacatcttccatgtactcaacacgacctaaagcatgttttagtttcatcttgtttagtgtgcatattgagcaatcaaaaacactttgttgttgttgttttaactttttagcacaaaccatgttaaacatcaaactagcatgaaaagatatttgatatttttttcaacaactttttagttaaaaacaactcatccaaagtacgtgtgtgcaagacaaaaccaagagcaagacaagatctatttttcaaatgatgtgcaacgttgacatctctaatttttgaaatttcatgcattaaaacctcacaatttttgcaaccatcatcattaggaataagagattttaatctataaattttagaattaagggattcaataataaattcctgttttctatacatcttctcacacttcttattttttgtacttaaaataagaatagcttcctcaaaagaactcacatcattgtcttcacactctgaatctgattcaccatgtgccatgaagcaaacaccggagatgttctttcccttatcttcatcttcactttctccatctacatcgcttagtggctcaaaagcggcatagactttctcaaacatcttcttgagattctccttggtcttcttccccttgaatgtgctcttagactttgttctccttagtcttctctccaccattgtcttcctttttgcctctcctaagcttaggacaatgcgaacgattgagatcaagagcaccacattcaaagcaacgatcgatttggaccacttcttttcctgtacctaacattattcatagctcgagaaaacttattaatgaccaaaaccatgtcctcctcctcgaactattcgagttgctcattcgacatggcattaattaaagcaagaatagtagtaattcgatgaagaagcaccaacatccaaagaagtcaaggaagaaaccaaatcactagacttagagtcaactttacaagaaataatattcatctcatgtgttttgagttttgtgtaaagcgaatccaaagtcaaagtaaacatatcaacagactcctgaattgatgtaactttcatctcccaaatagacatgtcaagaccattcaaaaagtgacgagaaacctcagattgtgtgtaatttatatcataagaagaatcaacagatttaagatcactaaaaattttttgaacctagaaagatagtcattcaaagcttctccaggtttcatctcaaattttatatactcctttttgaaaagttatcgatgaagttctttaatatttgaagttccttgatgaaagtttttcaaagcgttccaaatctcatttgcagtttcaagatgcgaaatacgatcaaaatccgaacgagaaatcccacccaaaagaatattgtgagctttgcaattattttcaaattcagtttttaaagcaatagtattaatttgatcaggaatcacataaggattagaaacttttctcaaaatatcaatatactcaatcataatgtaagattgcatcttactacaccaataaagaaaatccgttccatcgaaaacatggagcttagttgcaaacttattagccatggcaaaaaaaactctagatcagttaaaatccaaaaaaaaaacaaggttctaatactacttgtaggatcgaatagaagaactaagccaaccagagggggggtgaatggttggtatacccaaaaacccaaactttttgtggaattaaaagttacactcaaattcgacggatcgtggtctgaccgaagttgtcccgtcggtctgaccacacttgtgccgtcggtttgaccgatgtagatcgcccggtctgacagccccgaagtcgccactgcctcctgatgccaccgccggtctgaccgctgcgatgccgttggtctgaccgccggtgtttcgccgggtagactgctgaatccgcgtaaacacaaattgaagaactcaagatgtagatgacaactttattacttttctctgtgtttacaaagtgcaacaacagcactcctcatgaaaatctcgactaaactcgaaatcctaactaaactatcaactcaatggtctcagaagcaataccgggaagcctcacgctccctctctatttatacataaggtaggcagcctaaagccacgaaccaaactcatactagaagtcctaatccacataggaaaccttcccgtacaaaaaacaaacattacaaactccaatcataccaaatttggccttccaaatttaactccacatcccatatgcacacaatacatccatcgtatgccatatggaatcttcaccaaccacgtgcattgaattctagcctaagtatccgcatgatatctaaccatcacggacgtcgccttatccccaagtcgactcccgatctatcaccagcaatactctctagagacatcaagtcacctatacatgaatcaaacaaagaaaccatattccgagactaagctatctccaacttgactcattgttagcaaacaacagtattacatacgaatagtatccatctagaagccataaacatgaaacaatcatggatatccaaacaaacaacccgaaaccgaaaccgacacagagtcggccggtcagaccgctcgcatagcgccagtatgaccggcagcacctgcccggtctgaccgtacccgacaaaacagcagcacctgttaatcacttgaaaatccaatcatctccaaaaccacttcgccaataatctctaaatatcaaaaccaataattacaaatgccaattgttcatcacaaaataggactcaaaaacactttgattttacatccaatacctatttagatgtaggtaattgggagggagttcttttctaagtacgatgtgataaatatgagccatacattatcacttaaaattcaattcacatccatacttcccatgattctcatctctactatcaaacaaaggaataggaataaaaatgaaactcccatgatcagtcgtcctctaaacttccaatccgctttccatctcttgccaaacaggcagtataaggcctacacaagaactatttcaattcaaaaattcatacaaatctctatcatttgcagggagacctaaataaaagcgcaatggcgtcttacataacattatcgaacattttgcattagcattcatgtttccttggccacagcacgaagtggcttagccatggacaacacaagaccaaactcttctgccatgtccaagtcatcacccttaacttcatcagggatcgtccactcaaaccgatgcagtagtgatgcaagcatcagatgcaggcatgcagcatcccttctgctaatggcatcccaaggcagatgcgtcgtccagcaccaaacggtatgaactcaaaattggttcctagaaaatttatatctctacccaagaacctgtatggcatgaacttgtccagatcatcccaaatcttagctctcctacaaattgcccatatattcacatatacagttgttccctgaggtatcttgtagccctggatttctactgtggcctcagccttgttgaatgctattggaacagttgggtgaagccggagggtctctttgatgacagcttggagataaggaagctggctgatgtctgattctgcaacgtgagtttttgtgcccataaggcctttgagctcctctggaagttgtatcatggactttggattttgcagtaactctgccattgcccactctattgtacttgaggttgagccgcttccagcgacgagcaaatcctgataaattgcaaaatatgtttaaaactaaacgtgcattccgtatgtgtgatgtgtcttccatattaactcaaacaattcatacacctataacaaaataaagcttaggtggacttacgtattttcctaaatactgccatttttggcaaaaatatcatgtactatcttttaggtatctaatgaaataaacataacaaacttttactcactgtaaaattttgcaaaattggctgtcgagagaaaaaaaaactgtattaataaaatgaaattgaaaacctgtaaaaattgaatcacaatgggacagtattaatattaccatgaacattcccctcatggtgtcttggttcatcacccatccttcgctttccacttctccttccatgtcaaacgccacatccagcaagtcattcttgcgaggctcgcagacgatgcggcggcgccgccgccggtcgatctgcacatcgatgatgccgtacacccatccgacgagattatccatccttcgccgcacgcccatgacgtcggcggcagcgatcaccgggaaatagtcagacaggttcggcgctccggcgaccaccaccgccttctcgatgacatccctcagctgccgcgtcgtcgcggcgtccatgtcctcagagaacatgctccaccacagcacgccagccaccgctgcgaacgcctcgcgtgccaccgacaccggcatgcccccggcgctcccgtcggacacgcggtgcgcgagctcacgcgccacctcctcccgcatggcatgtgtcacaccctgaagttcttctcgcaagtctaaattaatttaataaattacctcaagaaattatctgtgtattggcaagagagaaaccctaatttaataaatgcaaataataatcggaattggcatatggaatttttgttcacttctacaagtcaaaatatgctaacaggattttcagtagaattttcagaggtcaagaaataattttaaccaattaaaaatgaacacaagcaattattaaatcccttgaaatccctttttttttccctttttccttcgagtgggccatcggcccattctcccctcccctccccgtgcgcaagctgggctggcccgaggccaaggcctagcaaccggcccagccgccgcctcgcacccccctctccctccctctgggtcaccgacaggtggggcccacctatcagccccgtcccctacctccggccggcgccgcccgcgcccgcaaccgccgctcccgcctctcccgcacacgcccgcgcatgtcgcccactccccgcactcgccccgcacgtcccgcaactgctgcccctcacccgcccatgcgccccaccgagatggccgggattcaatttttgaatcccgcctctatctcctccccacctccccacgtcgccggccgattcccgcgcctctcggcttcatctcgcccccttgtgcctataaaaagcaaccccgtcccctcctctaccattttcccgttctcgtcgagctctcccgtgcactccaccaccctagcgtcgcgcaccacccgctgccgccgcttcagccacctccggccgccactcgccgccactcgttgccgctagagcccccgccgagcctcgccgtcgctgccgtcgggttcacaagcccacgggccacgccgcccaccccttccccgtccaatgccgccgccggagtccggcttccaccgtgcgccggtcagctcgccattgccacctcctttggccggcgattttgcccatctcgctccctctctccctctctaatcacactcatttgcttccctaggttaccccggagcccgtcccgccgtagccgtcgcttcccgccgctcaccgtcgtcgatcgccgtcggtgaggcccctccccttcttcccctctctctcccgcgccgcctagcgctgctgctgcttaactgccaagcctccgcgccgccgcctagctgcgttgccgttgctcgctgccgtcggctgcgccgccgcctagccgtgtcgccgccgctcgcctcctcgggccgccgcgcgccagggccaccgggccagcttaagccgcccgcgcgtgcgctcggccgtacgccgccttcgccgtctgatctaccctcgggtagatcggggccatccgttgccgcccgcgtggcagcccacgtggccgccatgtgtgcgccacgtggcgctccccatccccgatcccgtggactcggtccactgtggaccagcggacttgagccgatgacttgtggggctcgcatgtcggcgccccccccccttcgctgacgtcaccagggttaattattgtgcaatgaatcaattaagttttttctttttatagtaaaaaaacacagtgaatcttctaaaattcatagataattcatccgtgctctataagccattcaagtctcagtaaatcaagaaaaattcaaagaatccaattaaaatggttttgttctctatttcagtagtcttacagcctgtttgcattgtttgctttgtatgtcgcatagattccgactctcccgacgctccagtgtacttcgaaatagtcgccgaggttcctccagccacagagcaaggcaagtcatgattgtcacttgaacatgttgatcccatattggaaatgctctattgctttcctttaaatattgcattgttttataatgttaccatgggatgattacctactgtctcagccatgcatgttatttgatacctttatactttgctagcttgggttgtaacatgattagatgttggattagggattgcttagccatgcctagttcaactagtacacaatgggggaactacattaatacatagacttcagattctagtattgatgttggattagtgccaccgctttggtgttggttaactaaaatatattaaatggtgggctgtgggtgcatggctttgatggtcgcgcccatggcaattaaggaccggttcgcgggatgccctggaagaatttatcgtacttaccacaagccagcgtggacaacggctgggcttgtagtgtagctttcctctagctgacgcatccaggcaagggtaggcgtgatggagcgggatgggccctgcgacggcctttggtacttccggattcacctaaacacgagaggggactgcccgctgccttgcaaggagtgggggtgaaacctgaggtatggtgtgtttggttagagggggttatgcgaagggtcctatcacggcctctttccagtatgccgtggtggcatgtcggcgcacgggaacgtgtcgtggggctgtgtcttgtgggtacagttgtacacctctgatcagagtaaaactattcgaatagtcgtacccgcggttatgggcgttcaaccagattcaacgtaattagtctcaccctagtttagtctaatggaactgattagttcaggtggtggtttgggcctgtcccaatgtggtgtagcgttgagcagtggctggtttaatattggctaattatcacaactgttttactgctttcaactactgtttataaatgctagctttatgcaaatgaactcctttagcctcctttggttatatcttgcatcatacctcctcttccggtatgacttgctgagtatagtgggtagtactcagtcttgctctctcttctccacaccagagctgaagttcttcccagttggagccatcccgaaaaagttggttttgtcgctgccatcaaggatgcctgtggaatgaagtcacctgctgtaggagtcaagtcttcaggcttagctcgcttttaccttctctgctgcatttgtaatcttttatatttttttaagccgtggatatgtatgtcaacaattgttgtttgtgtaccctagctggtactggacaggggtttaatgcacatttagcttagaaattatagttcattaatttctgggcatgaaagtgcgtagccccgtgagccgtctcggcgtgagcagtgtcgacgtttgatgtcgcgattccggtatttgcatagtatggggatcgttggtattaggatatatgcgagacttaggtaaaagagacagaggcgaggatttttctacaggttcgggccctagaattgtcaggtaatagccctacatcctgttggccgaagccggtcgttgctcttattcaccataatcacaccagtacaatatttggggtagcctatctatctgttgtcgacatagcggactgaagtatcatcacgtagtcgacaacagggtagtcttcctcctcgaatctgtgcccggcgagatcaaatacagcgctagattcctctctttggttcccgtagataccatatgaggttttcctaggcttatctctgatatcgatatctggcagcttgtcttggcgtatgtaggcttgtattggcttgtggttttgtggcgtctatgttgtccgtgtcccctctcctcctagagggcgttgtatttatacccataggtgtcctcttgtccaagtagaactaggaagaccaatatggatacaatccgagtactccttgtcgtttccatgtaaaactctagttgtctttctttatccggaactccctccatatccgaggtcagtttccatataaaacatggtatgtgatgggtcctgccgagatttagtcaactactattaggtatatggtatccataatcctaacaagcagctcctccgtgcagagcattctcatggcgcaccacttccagcgcggccacagcgcgatgctggagttggcgtggtggccgcaggcgtgccacgagtccataccgccgcggccggtgatgtcggcgttgttcctctgcaggatctccctcgcggcgtccgcggacatggcgaccacggcgcggacgccgccgagccttatggacatgagcgggccatagcggtcggcgaggcgagcgaacgcgtggtgcgggttcttgccgatgttgtggaggttgctgatgaccggcagccggtgaggtcctggcggaaaacggcggcgagcatcgagcagaggttggaagatgtaggagatgatgaagacaaggagaagagacgagatgcataggtggaagaacgccatcattctagcttgcgagttgcgacactatgcaaagtgcgcatgcattggcatttggttctattttgctagttagttctgtcaatttttttccgaaattgccaaaaaatactgtcgcaagttttttttaaaaaaaaactttccaatgttactgtagttgcagtgtaagtataatgtacattacggtgtaactgcatttagatataaagttgcatgtattattttaatacttatatacaaattatattatattagttatagtaaaattatattataattatactatagttagatttgaaagtttttgtcttaaaaaactcgtggcagattttcttttgatagtcctttttttcttatatatttttgaatgttggatgccgtttattttttacacatgtgttgaatcatttcttttataaagcaaataatatgatttttatttattttgatttgttttgtcactgatggtactttaaatatgactaatatttttctacatttacacaaattttttaacgagaaattagttaaatgtatgttcatccatatcaaacattaaataccgaagggtacacttgcacgacataaaaacaaaagagtttctagctaggactactaattttaatgtaacgcctaaccattactatttcagatgagatccgtagggacttgaagtacttcttctgtcatgacgcgtactagtaataatcataacaaaggtagaatatatcagtctttcgaagataattgaatactccctctatttcaaaatgtttgacaccattaattttttatacatgtttgaccgttcgtcttattaaaaaaattataaaatatgtaaaactatatgtttacatgaaagtatatttaagaataaatcaaatgatatgaaaagaataaataattacttaaattttttgaataaaacaaatggtcaaacacgtactaaaagtgtcaaacattttgaaacggagggagtactttggtactaccgtgtgctacacttatttttctgtgcatcaaatggacatttcagtattagtacgtgattgtgctgtctcgtattagttgtacatgaaatgggtggaaaaaaaaggaaataacgaacgatggaaaggaagtcaaggtattaaaaaatgattcaaactttccatgatatgatgatacagttgcacggatcaaactgagctttcagatcagatttaaatgaggaacttcgttaatgcgacgtggccatttcaaccttcacttccagattttagcctcgtggcatgaatgtctttaatgtgataggaccatatctctgaactctattaaaaacacgcaccaaatggaattcttttccaagatccaacaatgcataagttagggctaccatgcattcaaagtatgacgtttgataatttatcttattcaaataattcaaagtagttactccctgcattttgttaatatcttagtacatggctctgttggattttagtatgacgtttgataattcatcttatttaaataagttatatatgcttcatttattttgataattgtgacttattttatcactaaaagttatatgatgatacctacaagccagattgaatcagcaggagttactgacagatattttagctaattttgttgaatttattttatagagatatatttttactataattaaaaacttgattgatatgtaaggcattttaatcaggatttgaacccatgttaatatatgccaactaactatatataagtaacatagggcacacatttatcagtaatgatacgatattaagatggttaatgcattgaatatagaaacgatttactgaagaaatattgagttcaaaaattggcaatagtagccagtgataatatttttatcaatatttctcacattgattttctatggttgtgtataatttcatgcctctggaaaacattttataaatgcatcttcgtttatattgacagtatgttgatcataaggtatttcagaaatgtctctatactaatttaaaggcattttaaaagtgcatgtatagtataagaaaaatatctttacaaggtatgtttgttgtagtgtacacgacaagagtaaggacaatcatattcacttattcattttgtttaaatatatataagtataacatagtatttcaaacattggcattgtcttcaatatataattaattagacattcttaacattttaatgttgaatatatagcattttttcgactaaaaaattaaagttacacaagattgatagtatactctttcagataatttagtgtgtttcgcaaatcacgatccaggtgacatgttctttaagcgaacacatttttcgagattatggagtactgaacttcagattgatctgactactgctgggatgtctgaaaacaccgtttcaaattaatactcctaggcactgttttgatcccttctcaaaaatttttatcctgtcagatcaaatagactaaaaaaataactaattgtacagattgtgactaatttacaagacgaatcttttaaacctaattactccatgttttgataatgtggtgctaagtaaatatttgctaatgacggattaattaggcttaataaattcgtctcgcaatttacaggcggattctgtaatttgttttattattagactacgtttaatactttaaatatgtgtccgtatatctaatgtggcacgccaaaactttacacccctcgatctaaacaccccctattaacaaacaacgtgtctttacctccaactatatataaatgcattttcatcaatatttctgacctattatttccgattgggcgatatgatagcttgattcggatgcacatgtgcgtgtatcaccagtttttatattagagttagcttatacaagtgaatgtgctggacatttttctatagaagcatttattttccttgtagcataagttagaggaaacgtgttactgtacaagcttgacaaaaaattgtcagattaccggtggacgatcataatcaaatactttctttgtcccatttcaagtgcatttgtatgtttctgggttcaatatttaactgtccatcttatttaaaaaataaaaaaataagttacaaaaatattattcatattttatcatctgataacaataaaaatactaattgcaaaaataattcaaataagatggatgatcaaacgttgggcatcgaaaccatagctgcacttaaaatattaaaatagtacggaggaagtagctt

SEQ ID NO: 78137 - DNA, 12930 bp, Oryza sativa
  unsure (1)..(12930): unsure at all n locations
cgatcccccttgagtgacgtatcactggtacacnagctcatcataattcaataatatattccgggttatcaaattttgtaatatttattaagagaagcgggctaatctagtagtctaacatattgcgtgtttttatagtagaaaatcttaatttaaaaagacgatataattttttctactgatgtacatacatattttaagggtgttatagttttttttactcgtgcataaaacaatatctaaaggttttttaatagtttttcttgtcgtacttatgtacgtttctttgtttccatcgttagtacgtgcgctagtttctgatacgcacgttatactgagaggaagcaaaaatagatctaatataacagtctatttagtccaccaatttaaatgaaaatcgacggtgagattataaaatgccatatggtgatttaggagcgtttgtagggatgccaaatgacggcttaagaacgtttataagaagattaatggactttagtatataatagatagatagatgtatacatgcatcactcatccatatatttgcaacaaagcgcggggtatcaactagtttatatatgagaagatatgagacagtggatgtttaatttatagacataattattggtgtgattatttctgatttttaagaagtgctattactcgatctttataccatatattgttggaaccaaacactcattatgcattgagccacatcatctagaaaataatagttttttttcctattaatactttgatcacaaccattcatatatcatattcattgacaatccacttagcatagttattatcgtaaagctcaacattaattgagttatgccaccttagaaaaataatacccactgcatttctctcatgcttcatcgtatccgatcatgtgtcatgcctaaactgttatagaagtttaaatattatcctttaagcattatgactacatattttctaaattgttttctttgaactattttataattatttctaaaattcccacggcaatatgtggggtatccactagtgaatattataagtgtgcacaatgaacccaattagcaaaaattttccttctgtcgagcaatcatcgttaggaagtacaataatatatgtttgcttggatgggagaataagctgtatataacggataaacattaaacaggtgaaatgagttcttgaagttaccttaggtactacttattgcttcatttcttattattcatctctctttacttgtcgttctgtagcttattgatgtttttctttttctgatataaataaggacacggccctgatttacaatttgtagaaatcaagcgtacgtagttgttcatttcaagagtcgtcaagtctgcacagcaacgaggagaataagatcatgagcccgtttggtattactccatactatgaagtgatacagagtattggtttgcaaaagcaacggaaatcaccatatatatggcatcccctttttttcacgaaacacggcaaagtcgcaggtgcttatataaatgcacacacattcctccttataaacacaccatacctctgtaattgcctctgaaaactaggttggcatatcttgagattcatagagtcattataggtgtctcgctgtcaacagatatgtcgtgtaacattgaaagaataattagccgtaaatacgagcactcatctcaagttgaataaccggataggtaggtttcatcacaagaaacattgccagttgaattacactcacttcacatcctatttttgttttacaatacttcgtgtatcagaaaatatcttgggtgattacatatttagagcagctatcatcgcattacatttgtaatgttcttctattcttcatcataaaaaagtcacatgtttcttattgtatttcttgagctattacatagaggggagcaacaaatgatagtgttaacccaaacctctccctcatatccactccatttttcccagcctcagctggcaatgtccatgtgaatcggtgtagcaacgagccaagcatcaaatggaccattctgtgagctagtggcaatccaaggcaaatgcgctttccagctccaaaaggaattagttgaaaatccctccccatgaaagtaatgtcactatcgtagaacctctctggcatgaacttatctggctcggtccatgtgttggcgcatcgattgatcgcccacaagtttataagcactttcgctcccttaggaatggtgtaaccttgtatttctatcgtggcttcggcctcgtatggtggtagggcagtttggtaatatcatgttcatccatttgttgtttgctgcctatcacactcttgagttcgtgcacccttctcatcgagtttggacactgcaatagttctgccattgcacactccattgtgtgagaagtcgtctctccaccagtgaacaaatcctacagcaaatgaaacttgagtttagaattatcaatgaaatttacttggttaaattacaaaatttaatcaaaacgaaaaattgtaatccaaatttaaattagaaagctggttcaataattttagctaaattaaataaattagtcatgcatgataacaagggtcttatcttttcgcttatgcttatatttatcagtcaaaatttgaatttcaaccttaaatttggatctgattttgaggtttttaatcgaagtttatttttcagctgatggttttagatcgctaagaacacgtatataaaagtttgttttattcacaaattaatatccgtccgcaagttgtacaagtactcactgtaaaaagtccacggatggcatcacggttaatttcgttgctatcttctttactctccccctcctccagcatcacgtcgagcaggtcgttcttgcgtggctcgccggcggtgcggccatgcatcctccgctcgatctgctcgtcaatgatggcgtacatcctcttcaccagcctcgccatcctccggcgaactccctggaggtcggccggcgcgatcgccgggaagaagtcggagacgttcggcccggtgcccagcaccgacgcctcgtccacgatgtcgctcacctcgcgcgccgcctcggggtcgaggtcgacggagaacatggtgcgcgacaggacgcccagcgcggcgacgtgcgcggcgtggcccacgtccacggcctcgccgcgcgcggcgtggccggacacgcggcggacaagctcggccaccttctcctccaggagagccctcatggcgtcgagccggcgcggcgagaagagcccgacggtgctgagccgccgcagggcgcgccacctgcggcgcgggggcaggcaaaccacggagttctcgcagtggccgccggcgcgcatggagtcgccgaaggacctggcggcgatgtcggcgttgtgccgctgcaggacctcccgcgccatctccggcgacgacgcgacgacggcgcgcacggtgccgaggcggagcgacatgagcggcccgtggcgcgcggcgaggcgcgcgagggagcggtgcggcaggtggtcgagctggtggaggttgccgatcagcggcagcggccacgggcctggcggcagccggcggcgagcgtcggcgaggagctggaggacgtaggcggagatgacggcgaggaagagggagaacgcgagagggaggaagaacgccatggtcgtagcaaaacgtgcaactcacctcacctgtccttgtgtgtatatactgctgcattgcttgctgatgaagactgtttattgtttgccatttcggtcgtaacatactctatgttcccaacctaggtgtgtttagatcctaaaaatttttggccaaaaatatcacatcaaatgtttggacatatgtatagggcattaaatatggacgaaaaaaattaattgtatagtttacatgtaaattgtgagacgaatcttttgagcctaattgcgccatgatttgacaatgtgatgctacagtaaacatttgctaatgacagattaattaggctttataaattcgtctcgcaatttacaggcggaatctgtaatttgtattattattagtctacatctaatacttcaaaggtgtgtacgtataattaaaaaaattttggcccaaagaactatacacggccctaatttctaatgaaaattttggttggaagtgaaggaactcaagtcatggatgacaaccagaaaggactatgataatgctgagattgactataataatttttatataactagatcgaagaaacgtatcagatcgtgcggctacgaacggagggatcactgttgcactgtagcaagaggaatgcggccacgtagcgacggcaaaaacaataagtttattatgatatgatatgcatggttcatacagtgcctgtagtggctatggtagtagcagtggcagtagtagtatttgtagtagtagcagtaacgttaatatggttagtagcaatatctgtagcagtacttgtgaatttctagtgtactgcatatttgctgagcttttagggtttgtgtattattacgctgttatcgctcgaggcttgtcttgagctgtatctatggtattgtaataactggaaccaatacgatgtttctgctatgctactctgatgtgcatatctctgagtaaacgatgtttatgaagatatatgctatagacttatattctactcttcttgtggaatatgtcggtcgtttcagagcggttgcggtgaggaggtggcgtcgccgttgccgctcgccacacagccgcccccgccaccgcccacctcccacccatgcgcgccctgtgagagagatagtggagagagaggggaaggagatgtatgacagatgggtcccataatttttttaaaaagaaaatactatacagaaacaaggtgttgcatcacctacaatgagcctatgggcttgtttggcgcattccatcttgtttggcgcaatcacagaaacaaggtgttacatcacctacaatgggtctatgggcttgtaactaggggtgggcaaaataagaccgaaccgaagaaccgaaccgaaaagaccgacaccaagaccgagaaattcggttagtagtccggtcttggccattgaaagactgaaatttattcgggtaattcggtcattgctctcagttaaccgaattaaccgagaaaaccgaattgtgtcccaataagcctaggatgcccaataagcccagtaaactactaaaccctagaggcaaccacacagccactccctcctcccacggtcccacgagcctcatgcagcgccgcctctccccaattccccatcgcgtcgcgcactcgcgctcggctcggtcacggcgcctccaccgcgccgcctccggttccacggcgccggcaccgcctccgccttccgcctccacagtgccgcctcggcctccaccgtgccggcgccgcctccacctccgcggctccgccttcagcctctagccctccaccgcactggcaccggcgccgcctccgctctccgccctccgccctccaccctccgtgctccgccagtccgcctccatcgcgccgcctccccggcccgtcatcctcgacctctatcgccccggcgctgcatccgccggtccgtcctcggcctccgtcgcgccgacgccgcctctgcccttcgctgtcatgccctaaaaatcaactaaattaaaaatgcatattttaaatcatttttagaaattattttaaaagcctacaagctaaaccctaattttctaggaaaattttcaacataaaaatgagctagataaaattttattaaatactatgcttgctcttctattttctagaattttctgggaattatttgagcaagggaagtatttttaataattgaaacaacatttcacaaattgttttattttaaaaagttcaaaaacccctcctttaggttattgggccgattttggcccaatactctctctcccgcgcggcccaagccggcccagccgccgcccgccctcctctctctcgtgtcaccgacatgtggggcccacatgtcgggcctttcttcaagctccagccggccggccgaccgagcccgagccgccccgccgcgccgccttctcctctcaaatccgctccaatccgaccccgtttcttccggatttttgaggggttttgatcctctcgttctcctctatctttcccctcaagaatcggagcaaatcgttgggtattttgtccgagttttttgtttccggcttcgattcctctcgtttggagtccgatctcttcaatccaaggctatatataggaccacctcgtcgccctctttcgtttgccctctctctcgtggtctcccgtgcctcctagccgccgcgccgccgccttttagcccgccgccgccggccgtcttcggttgcgccgccacgccgctcctgccgtcgccgccgcttgccgccgccgtctttaggtgcgccgtggtgaggggaacctcggccgccccttccccatcgttgccggtcgccgtagctcgccgtcgccgcgcaagccgagccaccgccgtcgcctcctcgtcgccggccgtcgtcgtgcgtcgtttgtcgttgtggtgagtaccgttgggttcgtcttgtcgtcctctacgtgtacttgtcctccaaagccccggccgaccgttctagctccggcgaggtggccaaccctagccggccggccattgatgacgtcatgctgacgtcatcagttttcctttttcccaattttctaatagattaaaacttcggaaaatcataactaaataaccgtagatccgtttcaggtggttcaagttgctaaatttttctaaaatcaagatctacatgtaaaaatatccacatgtactgtttatgcttgtttttgtactgttttgttgattttttgtttaattgctttagtttccgacgttccggaggagagtgtttccgttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccaattaaataatggccgaagatgactttattttcctatgggttataatttgattagcatgaaccttatatattggattggttcagctaaatgctatatgtaagtttgcttagccatgcttagaaacattagctaactaaaggggttaaatattaattgataattaaaatctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattaaagtgcgccagactgagaagtggcgagaagtccataggggtcgctggggagtccatgccttgtttataagggggtgattatgatccaggaaaggtgcgccgtaatgggttatgttgtgcgaggggtattgtcacaactcctctccgaggtaccgtggtggtattgaggcacctggtgacatgatgtggggttgtgtcttgtgggtacagtggtacacctctcatcagagtttaaactattcgaatagccgtacccgcggttatgggtgagttgagcaatgtttttcgtgattagtctcacactactcatcaatgttaataatgtggtaattaatttgactcctggtttggaatggataattcctggtttggaggtttaatttgttcaactggggttggttgttcaaatgtggttgggcctatgcaacatgggtgtgttgtatggtgttatttaatattgattaattattcaactgtttttactattctcttaaatatttattaaatgctgtttctgcaaatgagctatattatgccatcctttgttatcttgtgcacttgcatatttgctgtgtgacttgttgagtatgttatatgctcattcttgcaatattcattcatcagaggaggagtatctcagtgaaggtgatgatctggaggattaggcttgttcttggttaagatgcctgtggagtggagtcgccatagctgttccgtagtttgttatagttttttttttccgctgcgtagaacgttattctttgagaggaactatctacctctgtaataattagttatttgcgaatattaaatagttatttatttgtactctattattaatttgtcattgtgtgcctcggttgattcctggacgagggtttaacacacatgtaagcgttcggaattttggatagaaattccgggcgtgacattcgcctacatcacgccgcctccgtcggtccgccctctgcgagcccgcctctgcctcaatgctgccaccgcgtcgcctccgtctccagccagactgcggtgggggatttgatgcggtcgcgttcgatccggtctcttctctgtcaaaattcggttagaccgagatcgagaccgaatttgtcggtcctaagttttttaggaagaaattcggtcctcacttttcaaagaccaaaatgaccgaaagaccgaagaccgagaccgaattttggtcaaaccgaatgcccacccctacttgtaacttcatttgggacccaggcccaagtagggcccacgtggggtgcaccccaaacaggtggagcatgaccctagggactcctaggtcatcctcccacctctttaaatagctaggtgcctcttcagggtttctcgggttttttcagactaaagtttagcttcgttacttggccgtataatcccgtgatcggttagatcgccggtttgttcgttacagaaccctaacttatcatttgtattcaattgctatttgcaatttagattgcttttatcttgttcttgattgtttcttcgatttgcttataggaataaggttgatctgcaccgacaagattaacaacccacggagttaaggcgcaacacaacaacgtctcgtacgattgtagttgggtcgtcaacgtttctcccaaatcgtaattatcatcaactcaccgaaagattgggccaatcctagccatgagcatctcaagtggagctcagggttcatcagatagggttggaaaagatccgactcattgtgaacctgtcagcagagagaagaatcccctcaagggacacatcgtctcactcatctaacttttctttttggtattgctagtagttatatgctgtttgtgcaatcctttccctaatttgtttgtggtgtgccaagggagtttgtgaaggtcggatctcaccttcgaagggaagagataccctcagtggaaggaggagtgcatttgaggaaccttatggggatagggttggaaaaaaccgagctcattgtgagcttgttaacatatagtagaatcccctcaaggagttgaatttcgggaacgcatcatcttacaagaactccggtgatatctctctcactcatctagctctgctgcttggtaccactagtagtttagttgttgtttgtgtaatcctttccctaattgtgttactgtcacttttttgctcgacttgttaatttacttgtaaatctgagatttttgtaaatatctgaaaatattaggaaatattcgacaaattcagcttatgcttttccgtaaagtttgaaacgcctattaacccctctctagacaatatcaaggtcctttcagcaccaaattgtgcttaccgcgttaagtgtagcgcgtagtcatactaaatttatcgattagtttacatattgattttcaatctgtcatcttcttggcaaccagctgcttgaagttgaatggagtggtgaagtgggacatgccatcgtagaaggtggcggcggtgagctgtgcggacctctgggagggatgcacacggtcccagaagagaaaaccttcatggtccgtgcagagtgtggagtttggcaaacaatcatcctcggcgcccattattccgctcccacagcatgcgctatcggtgttcgtgaaccctgtagcaaaacagacacaaggtaaactctacgtatatagatcttggatgacatagtggagccataaaatattgtctgacaaaacagggtatgtactaatatacaactcaaacaactcaataaccataggatataacacaggataacacaatgtttggtagaacaacttaagtaatattatgatgaaaaaagaacacattgactagccaacagagcaaagcttattacattgtatagtggctacatattggttcttaacgaaatcagcatagcttatggtgtattggcccctgcctttgtgtgattatataactcaacaaattgtttgtcattttacttgcttagaaggtagagggttggagatatatcacttcttgtttccaataaattataagcgaatgttatttgacggaatcccatccccacaatattaacaaatattaacaggtggcatatagctcccaagtccccaccaccggtgccactatctgccgcaactcccaaagtccccatcaccatgctgtttagggtggaaaataacatctgagatctcgtttgtttagagatacatatatgtgcgggcgtgccagtgtacctaaatacacaatgtaaacaaaacatagggaacatgctctttattaatcttaaatgatcataaatacaaattcccaatgtaatatatatgtatgcgcgctccataatctgtcattggacagatctgacttgtgcgatatggtctcctgattcctggggcctcgagaagctcccagttaattacctccgtaggtctaggcctgcaagagaacctccgattaagctgcttgtggtcgtctcgtcgtctccgcttcacgttctccatgcatggttgtgatgatgatgtagatgtgtgtgtgtgtgtgtaagcgccggcagcgatccatggcctcgtcggtccgtgcgctggtgttggtcgcccaccctccgtcgtctagcctcgtcggtcttgaacaacgtgtcgacgtagattgttggtgaagacatgcatggagttgcatagcttgaacgacttgacgtcacagcagttgcgtcgagattagattagagaagaatcagggaggaattattgaagatggttgatatagacggcggccggatttaatcaaagctcggcatctcatttgggacaaataagaaaaaccaacaggacttcttcagcccacgcattggtttgtgcatggcactgtagcagcgatgacatgtcatcctccaattggttggccacgttgccacaataatttacttaatcaacatgcattagctagcttgttgccatccaacagcactggctcaccgtcctcccgtcgtccttcctctgtactgcagccatacttgcctccatcgtcatccgctggtttcgacgctatgcgtgatgcttgacctccggcatgagaactgatagaagtcttggcagtcggcggcagctccggcgatcctcggcgcgctccggcagggcggcttcccgacgacctcctccatggttagcccgctccagtgcggtgaagcttgcaaatcaaggatgtctggtatctcggcgaggtcgcagcttcgggtagatgcatcaccagcggcttgaattagcagcgtcgagtctagggacaagtagcactacgtcggcttgaacagacgccggcatcgatgaggcttctgtgacgcgtagatgaatcggccaccgcaagttccccggcgacgacgatacgcgcagatggatccctatgcatggatttgtgcgtgctgtagatgaaagaaaacgaaacaatcttgctagcttttacctggactagccatcaagctcctctcctgcgcttgctgatgatcggatcaccgcgcgtgccctctcctgccggacgccgggactccggccgaagtcgctcgccgccgccggtgcgtgtcgtcgatggatggatcgccgatgagagttgatggatggatgtgttgatgctggatgggtagatgcgttgatgatgggtggcttgtggatgctagatgcgttggtgaatgaatgtgtggatgagttcgtgaatgcccctagctgccgaggggtcgacgccttatataggggtctgaggtctgtgctcgccacgtccgcacgccgtttcctccgcgtcaagttcgttgtagataaggcttgatcgatcaatttgttatttgttcatatccttctttgattttatctcttagcttctcctagcgtcaaatatctgatttgtaattcgctttgtttctctactgctgggccacagtccggtgataagcgcctcgccagcgctcgcgcgaagtaactaactagatcaagtttgttatagagataaaatcaattggtttgttggttatctcttaattcatctggttttatctcttccgcatattaacttctgaaatcttggcgcgtaggcagctaccgtcttcggccatgggccgagcccatgattaatcactcggatatgcataggttgcttaatcacccaggcatgcacacacatacgaccgtctactgtagtacatgcatgcatgcacgtgattgcctcaccagccaatcttcacacggctagttattggttaattatacatgcacatatactaatccaagtatatatattcccagctgcctgtgcatgcatttatttgcgtgtatatacatggccgagcattgtgtagaaatgataagctagccaacttacaaactgcttgtttgctttgtccatcatgagtaagtcttgtgtacacatataatcgccaaaataccatcaaacacatgccccccaccaagtaaattttgatcgtggagcgagcgaaattaacttggtgtcgtgtcggctcatgcgatacatgtccggtagagtttagtcatgcgacgaaaggactcccatgttg

SEQ ID NO: 78138 - DNA, 13071 bp, Oryza sativa
  unsure (1)..(13071): unsure at all n locations
ctgatgcccagttagccgacttggcttttcagggtatgatccctccaattagggagaaattctcatctgaggattttgaaaacttgtcccatcttagacagaaggtgaccttgcatgaacaaaggtttgtggaggctaggaagaattccaggaaggttaatcatgtatgtccttatatatatggatcggatgatgaagatgatgattctgagatagatgcagccgaatgggtaagaagtaaaatagttacaccatgccaatgggtaaagagttctgaaaagaggaaaggtatgactttgatatcactaaggccgacaagatttttgacttgctactccgagagaagcagattcaacttcctgctggtcacacaattccctgctgaataattgggcaagaaaaggtattgcaagtggcacaattctgggtctcataccactaatgattgcaagatcttcaggcagcagatccaagcggctattaaagggggcaaaatcaaatttgatgactctaagaggtcgatgaaggttgatggaaatccttttcctgttaatatggtgcatacagctggccgaacagccgatgggggccgtgcaagaggttttcaggtaaattcggctaagactatcaacaaatatcagaggaggtatgacaagcagcaggagaagcattatgaagaagatgacgatggctttgatcctcattggggttgcgagttctttagattttgttggaatgaaggtatgaggctgtcgtctattggggactgtcctaggtgcagtgatgttgcggagagctcaagccgatcatatagtaggggcaatcggctaaggtagacaagacttcctgttcatcaaaggccgggtccagtgaaccaagtacatggccaggaggacgatgaaaacagaaaaaatgcatggtgtccttctggtatctttacgaagaatcaaaaaagaagggttcaaagattgaggagcagggagcgctctcaggaagtcgagcaggaaatcaaccatcggctgaagaagacaaagccgaagcaggagtggcgtgttaagaatcaagttcctgtagttgaggaagccacagccgatgaagcaaaaaggttggccaaaggaaaaagtgttgtaactgctccgatcaacatggttttcacgttgcctgccgagtttgggaataagcaagccgatattgacgaagttgaagaagaatcggctaagttgattttgtcaccagagcaggcagtttttgagaagctagaggggacggagaatcggcatcttaagccattgtatataaattgttatgtcaatgggaagccaatgtccaagatgatggtcgacggtggggctgcggtaaatttgatgccttacactacgtttaggaagttgggcagaaatgctgaagatctcatcaagacaaacatggtgctcaaagactttggcggcaatccatcagaaaccaaaggagttctgaatgtggggttgacagtcggcaacaaaaccatccctacaacattctttgtcctcgatgggaagggttcttatagcttgttggttggaagagattggattcatgctaattgttgcattccttcaaccatgcatcaatgcttgattcagtggcaaggcgacaagattgaaattgtgctagccgacaggtcagtcaatgttgccagtgccgatttagctctttgggagatggatggtcttgattgtttacctggaaaagtttgggatggagattttctaaaagtgtccgattctgatatacagccaattgaagatggagaacccaagctattattttgagggcgtcgtggagagttcagaggtctgcaacaaggacacaatagatgatctcgatgacaaacaaagacagggttttatgtcggccgatgatttggaagaaattgatataggtccaggtgatcgaccaaggctgacatttattagtaagaatttaccggcagagtttagaaccaagttgatagagctgttgagagaattcagagattgcttcgcttgggagtattatgaaatgcttggactcagccgatcaattgttgaacatcggctacctatcaaaccaggggttaggaaacaggaacaacctacgaggagatgcaaagccgatatgcttgaacctgtcaaggctgagattaaacgattatatgatgctggttttattcgtccctgccgatatgctgagtgggtttctagttgaagatgcacttaaaccccctagtgggttttggtgattaatgacaaggtggttaaaggtgactaacgtgtttatcaaagttattcacggactttagtcccaaagcgagttgtgatggctaagaatgcaagtagaccccccaattcgaatgttcctaaagtgcaaagtcatcngaggtgattagactaggtttttcactttcgaaattgagtttaggaaaaaccgtactattaagaggggtttcaagtgtggttctagggtatacaaagtgctcttagtcatatccatgagtcaaaagatttttggaatcatttttgatcaatgattttctcccttggacagagagggctacccggaggttctggccggaacttccgggcaccgtttatttgcaaaaaatttcctaagtgctgcccgaaaattcctggcacttttgcccggaacctcctggcaggtttccagttcaaacttgtgagtaacggctagatgacgtcaccttgccgttatatatatggatttcgtccccaggtcaccttttcaccattccacttctgttcattcagtttctagggttttctagccactcccaagcttcctttgcttcctccactcaaatctagagcctatcttgtgagattgagagattagatgagagtgtaggagtgttttggagatggcttgaagattaggtttgattgagcactttggataccttgtgggctgtcacttgggcttattactcttggagatattctcctagacggttaggtgtcgcccctgagcttccaaagatcttgtggctgtcccgggaaagtttgtgaaggttttccacacctccgcaaggaaacgaggtaagtgagtaaagattcttgtgctgagttttcagaggttgtcctaggtagagcaacttgcacttgtggtcttttctagaagaaattttgagttggatcttggtggtcactcaattctagaaaatgacctaaagtgtcgagttgagggatgtggacctcttctgggatctttgcataagtgaggcaaggggttaatcgagacccggctctttggagcacctcaacggagagtaggattcgtgagatccgaactttgggaaaaaatcatctttgtctctcttgtgcatgatctttgtgtgaatctgctgatattctgcgatcttcatcttgttcctctgtgtgcctaaacttctcttgctaggacctggctttcatctcagttttaatttatctctgctgcctagaagttcctggctcaagaactccggaagttccaggctactcatcttgcctggaagttctggtcatcatcactaggaggttccgggccctgtcaatttaaccgatgcgattgttgagaaaaatcaggatagcctattcaccccccaactctaggctacatctctgctcgttcaattggtattagagcgaggtgctcatggttcaagcttcaccgctttaagtgatccatgatgtcgtacttagggggaaagaacggggaaaatggaaatgaagatgaagcaagcagcaagggaactccaccacccaagggagctactataccttttgattacagcaaacttaccattccttctcacaacttcgtctccgtgccttccgggcgtgctcctcaatttgatgggacatattatgccgcttggaagcacatgatgaaggtgcatctaatctctttgcatccaagtatttggaatgttgtctgtacaggtattgatataccccatgatgacatggagctcacttcagagcaagaacaactcatccaccgcaatgctcaagcttccaatgcaattctctccgccttgagtccggaggagttcaacaaggttgatggactagaggaggccaaggagatatgggatactttgcaattgacacatgagggatcacccgccgttcgtgaggccaagattgaattattggaaggaaggcttggaagatttgtgatggatgacaaggagacaccacaagagatgtatgataggatgatgattcttgtcaacaagattaaaggacttgggagtgaggacatgacaaatcactttgtggtcaagagactttttggtccaagaaatcccactcttgtatcaatgatacgggaaaggaaagacttcaagagactcaccccaagtgacattcttggaagaattgtgtctcatgagatgcaagaagaggaaggtcgttgtcatgcccagaaattcccgaatagaattccaagcagaatgtgcattaaaatccccgtctaagaccggccggggtacacaaacgacaatgttgacattcagatccacgtcttacaaacatcataaacgtcttacataaatgcagaggaaaaatgaaagacaacaggagctaagccttgactagaactgtagcgggaacaccactccacaggcatcctcgacggcacggacgaagcatactcctcggagaaacctccatctgacacatactcgtactttggggttgggaaaaatagagcaagactgagtactacccactgtgctcagcaagtcataccggaataggggtatgatgcagggaattatcaaaggagagctagagtggttcatttgcataaagcgagcatttataaacagaagtttaaagaagaaaacagtcataataattaatcaatattaatcgtccactgtccaacgctataccacgttgcgacaggcccaaccatccacctatactatccaatttcaatagactaaactagggtgagactaatcacggtgaatctgattgaccgcccatatccgcgggcatggctattcgaatagttttactctgatcagaggtgtacaactgtacccacaagacacagccccacgacacgttttcgtgtgccgacatgccaccacgacataccggaaagaggccgagacaggacccttcgcataaccccctctaaccaagcacaccacacctcaggtttcacccccactcctcgcaatgcagcgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgtgaaccggtccttaactgtcatgggtgcgaccagcaaaaccatgcacccacagctcaccatgtgatttattttaattaaccaacaccaaagcggtggcactaatccaacaataccattagaaccaacagtctaaacattaataggattttccccactgtgtactagttgaattaagcatggctaagcaactcctagtccaacgtctattcatgttataacccaagataacaaaggagcaaggtaccaaaatagcatggctgtaacaataggtaaacatcccatcataacattataaaacgatgcagtatttgaagaaaaacaatagagcatttgcaatataggatcaacatgttcaggtgacaagcatgacttgccttgctctgctgctggaggaacctcggcgactatttcgaagtacaccggagcgtcggaagaaccggaatctaagcgacatacaaagcaaacaatgcaaacaggctataagactactgaaatagagaacaaaaccatttttaatggattctacacatttttcttgatttactgagatttgaatgggcttaaacggagctcagatgaattagttatgaattttagaagattcattgtgtttattgctataacaaaaagtccttaaataatttattgcgcaacaactcccagggctgacgtcatcaagggggggtggcgccgacgggcgggtcccactggtcagtggctcgggagagaggggaaggggcggcggcacgtgggccccactcggcagcggctcaaggggagggcacggctggcaagcgggccccacggccccggctccacgggccggtgtaccggccaggcccggcatcaagccggccggccggccatggcaaagcggcggcgcgcgcatgcgaccgccggcgacggcaaacggcggcaccgacggcgggcggcggcgcgagcggcgacggccgaacatgacggcaagtgcgcgaagagggcggcggcgcacggggaaaaaagggaaggaaaggaaggggagggagacctcaccggaggggcagcaacggccggcagcggaaaacgagggaggcggcaaagaccggcgatgccgaggtgcggacgagcgacggcgacacctagggaaaaagagaggaggaattaggacggagggaaaccctcacggcgaccatccacgccggccggagtcggaggggagagagaactcaccggcgacatgagggagatggggtttcggtgggattccggcaacgctaagcggcggccgggaaaggtcttgcggcggtgaagctaggagtggcggtggcttagcgtggcgacggctctagcggcggcggcacacggccgtagtgcggcggtgggcggcggcgcaagcggcggcggcgcgagcttggtagggagcacgggatggagcggtgagagcggaaaacgagataggagggcatggggagcattttataggcggagggggaggcggacatggccgggaggtgccccgatttcgccggcgacgtgggggaggagagagagaaggtgggggcgattcaaaatcgaatcccgcccctctcgtgcgcgggcgcggcaggaagacgcggggagagggggcggtgacgtggcgtgggcacgggcgacgctgcgtgggcacagggaaagcggaggagtgggtgcagcggcggcggtttcggcggggtggtgaccggcgcgggcggcgggaggttgggggaggacccgacaggtgggccccacctgtcggcgaccccgggagaggagggaggcgggcgggcctggctgggcctcggcctatggtcggcccagcgggagaaaggggagaaaaaggaggaatgggcgagcggcccattcaaaggaaaagaaaaaaaaagaaaagaaagaaaaaggaaaaagaaggaaaaatgatttttcctgggattaaaattgcatgtgctcaattttaattggttaaaataatttcgagagctctgaaaattccactaaaaatcttgttagcgtatttcgacatgtagaactcaagaaaaattccacttccaattccgattattatttgtattaatttattaaggttttctcttgatttgcaccggcattttcttagggtgatttataaattcaattttaggcttaggaggagaacttcagggtgtgacagtcgtgaagtgagacaaatggtgaagaagtttctttgaaggcaaaacaagaagaagagtcaagttgtgaagaaagtgaagatgaagaaatgacttttattgtcaagagattcaagcactttcttcgcaagagtggctatggcaaagggaggaaggatgatgacaagggaaagaggcaatcaaagagagcatgcttcaattgtggcgaatatggccacttcattgccgattgtcccaagtcaaataaagctaaggcgaagggaggcaagaagaagccggagcgtgctcatgtggcggaggcgcacatggcggaagtgtggtactccagagatgaagaagatcccgaggtcaagcccaagcccaagtcaaaagacaaggttgaaggagaaggtggtgttgctaccgtcgccttcaagtcatcctcttcaagcaaggagcgtctcttcaacaacttgagtgatgacgacgacgactcctatcactactcttgcttcatggcacaaggccgcaaggtgatgactcaaaagccctctgaaacttctcttgatgttgattctagtgatgaggaaagtgataatgaattagatgatgtgcttaagagctttagcaaacccgctatgcaacatttggctaagttaatgagagctttggatagtaaagaacagtcactcgaaaggcaagaagaattgcttattcttgagaagaaaagaaaccttgccttagaggagagcttagctaaagaatgtgctaaaaatgaacaacttgctaatgagcttaatttggctaatggttctttagctagccttagggatgtcaatgaaactcttcaagaaaaatttgctaatttagacaaaagtcataaagatcttgaagttcaatttgccactctttggaatagcacctctcaaccaaatgtggtttctaattcttctaacccttctactagcaatggttgtgctaggtggtacaatattgatttgaactcttatgctactaatattgatgatatgcaagctcttaaaaagagaatgaaaggttgggcacattggtgaaatatggatgcatgaaggcataccattcattagatgccctttacaagaccatcaccgctcatcctaacaaggatggatacaggctcgggttttcgggtggaagtcctgtgtctaagtgtgtaatggtaaatgggaaagaatgcttgatgtttgtgagagaaggtaaagcaccacaagcaagtgaggtgactagtcttgtgagctgccagggacccggaacatccggacaaaccgggagaaacatccgggtgggagtctctgtctctcaaaaattcccaccaggaagttccggccagtttgccaggaagttccgggccaatgaccatgcacaagacatgaccggaagttccgggcacaatgcctggaggttccggaaagagggtctttactatgattcatatgtaatttccaaaaattcatagggcaaagtggttgcctattttaatgggaattacaatgatgagtaccgcacttgtgtgtgggtgccaaaggctttggtaactaacatcaagggacccaaacttagacaagtttgggttcctaaatcccaagcttgattttcttgtgtaggcatactcctccgatggttcaagttgggttgtggacagtggttgcaccaatcatatgactggagagaggagtatgtttacaagtcttgatgagtagaacggaactcgtgagaatattgtgtttggagatgatggtaaaggaaaggtaattggtctagataaaattgccatctccaataatcaatctctctctaatgttcttcttgtcaattcattaagctacaatttattatccgtttctcaattgtgtaagttgggttacaattgcttgtttaccgatgaggatgtgaccgtctttagaagggatgtctcctccgttgcattcaaaggcaatttgaagggtgatctctatcttgtcgatttcgatgtggatagagtgaatccggaaacttgtttgattgctaaatcctccatgggttggctatggcatcgtagactagcccatgttggaatgtggaatttggcaactcttctaaagggggaacacatcctcgggctcactagtgtcacatttgagaaagatcgtgtgtgtagtgcttgccaagccgagaaacaagttgggaatccgcatcctatcaagaacatcatgactacaacacgccctcttgagcttctacatatggatttattcgggcccgtagcctacataagtattggaggtaacaagtatggttttgtcattgttgatgatttttcccgcttcacttgggtgtattttctccatgacaagagtgaggctcaagatgtcttcaagcgtttcgccaagcaagcccaaaacctctatgatctcactatcaagagggtacgaagtgacaatggaggagaattcaagaacacgcaagtggaggaattccttgatgaagagggaatcaagcatgagttctccaccccctatgatcctcctcaaaatagcattgttgagaggaagaaccgaactcttattgaagccgcaagagcaatgcttgatgagtacaagacttcggatatcttttgggtggaggccgtgagcactgcatgccatgccatcaatcggctctacctccataagattctaaagtttcatattttcgtgtctttgggagcaaatgctttattttgagtaagaggccttgctcatctaagttttcacctaaggtggatgagggattcttacttggctataagtcaaatgcacatgcctaccgtgtcttcaacaaaacctccggtattgttgaagttacaagagatgtgacatttgacgaatctaatggctcccaagaagagcaagttgttgtacatgttgtagatgatgcggatcctagacaagcaattggttctaaggctattggagacatacgaccagtcgagacgcaggatgaccaagaagatagggatcaaccttcgtcatcgacatccaatagccctacaacaagtcaagagtcagttgacccggaagttccgggaccagatgatcggaacctccggacctccctaggctaggaagttccgggtccatctcccaggaagttcggggcagaggacagtcaaggcgtgcctacggcacaagtggatgggattgatgccgagggcactgtagagcatcctgatcaggctcaggtcccctcggtgcaccatccaagaatacatcacactgtccaaagagatcatcccgtcgacaacatacttggtgacataagaaagggggtaactactcgttctcgtgtcgctaacttttgtcaacactattcgtttgtttcttctttggaaccaaccagggttgaagatgcacttggtgatccggattgggtgatggctatgcaagaggagttgaataacttcacttgcaacctagtatggacatcggtggagagacccgaccaaaatgtcatcggcaccaagtgaattttctgcaacaagcaagatgaacatggagtggttgtaaggaacaaagcccggttagttgcgcaagggttcacgcaagtcgagggtctcgattttggtgaaacattcgcacccgttgctcgtcttgagtcaatccaaatgcttttagactatgccgcttaccatgatttcaggttatatcaaatggatgtcaagagcgcctttctcaatggacccatcttggagttggtctatgtggagcaaccaccggggttcgaggatccaaagttgccaaaccatgtgtacaagcttcacaaagcgcaaaacgggctcaaacaagccctagagcttggtatgaatgtctccgagattttcttttgaaaaatagttttgaaaatgggaaggcggacactactctcttcactaaaaaggttgaaaatgattattcatttgccaaacttatgtcgatgacataatatttggttctactaatgcctctttttgtgaagaatttagtagtatcatgactaaaaggttcgagatgtctatgatgggtgagctaaccttcttcctcgcgctacaagtcaagcaagcacaagaaggtactttcatctctcaaaccaagtacatgaaggacattctcaagaagtttgggatggaagatgccaaaaccatcaagactcccatgcctaccaatggtcaccgtgatcttgatgaaaatggtaaatgtgtggaccaaaaggtttatcgctccatgataggatccttgctttacttatgtgcatctcgtcccgatatcatgcttagtgtttgcatatgtgctcgctttcaagcggagcctaaagagtgccatttgattgccgtcaagagaattctaagatatttagttattactcctaatcttggcttgtggtaacataagggttgtgactttgagcttttgggctattccgattcggattacgccgggtgtaaggttgatagaaaaagcacaaccgggacttgccaatttcttaggcagtcccttgtttcttggtcctccaagaagcaaaattccattgcattatccaccgccgaagccgaatatgtcgccgccgattcttgttgtgcccaactcctttggatgaaacaaactctaaaagactttggctacaacttcaccaagatcccactcctatgtgacaatgagagtgccaccaaaatagccaataatcccgttcaacactctcgaaccaaacacatagatattcgtcaccactttttgagagatcatgaaaccaaaggagacatatgccttacccatgtgagaaccgagagccaattagccgacattttcaccaagcctttagatgagaaaagattttgtgagcttaggagtgagctcaatatcttagattctcgcaacattaagtgatgggtaattggctaatttatagccaaacatgtatcactaaaatgtaaattaaaaaaaaatgagcttttgtgtcttgagatcacttcttggttgaagatggtcttgataccaggaatttagctcaaacattcccccctttatccaaaaacccttttgtgaatttttttgcaaaatcctttgtgtgccttttattgcgaaaatttggtttttatccccttcttgtggtgtatattgaccattgttatgtaatgttgattgttggctggtcatatgcatcataagtctctgcttgtccatagttccctatttcccctcgttgaattctcgtcttttccttgtttttgggcctgactgccctttatctgtcaggccggaagttctaggcctccctgtccggaacctccgggtgtcggggagtatatatactcaaggggagttagaagccctattctctctcctcatttcttctctctccccgacgccagccctagccgccggcacagtgcttctagtggtgattttcactttcatccaatcaaattcggttcttctccgtggattcatccacattggtggctgggaggttctttctgtgatcgattcgtagtttct

SEQ ID NO: 78139 - DNA, 5709 bp, Oryza sativa
acatgcactggctatttttgagacctctgttcttcatttttgccggccggaagttccggtgttcttgcacccggaacctccgggcgctttctagccagcctgtcattcttgcttctctcaatttttgcctaactactgcactccaaattgttgattcctgttacagtaagcactatgactcatgagaaaagacagaaagcctctcaggatgtgtccggtgatgagagtcctcctattcggttccctcgtggtcgtttgggtaaagagaaagttgttgagggcggcagtggcagtggcactcgtacttctcccaggtttacaaggcaatcaagcaaccgtcctgttcagattagggatgttgacagtggtcaaggaagtgatgcacctaatacaagaggacgggggagaggtggttgtcgcagttctagggctggaagggcatctcatgatttccctgtaggatctcgtgagaatcccgttcggctctacaaaactcttggttttgacaccactcctttgcaccacattggaagacccaagtccaactaccttcatcaacttgccaagtgtagaagagatcgtttgattgatccagagacacagcctgaggagtcacaagatcctcgcttaaggactttcactcaattggattggtataactcggtgattatggctagagaaaatccagtggttgagatgaagtggattgattgggcttacatgaggaagaagaacaatgaagtgttcaaccaagtgatgcaagtgtgccacaacaagaatcttggagatattcttgccttggagtatgattggaatgaggaggtcattgcacagttctatgcgacagcattctttggtactacaaggaagggaaccccttatgtgaagtggttgactgagggtgttaggcacaagatttccatggcacagtttgctgagatgttggggttagatgatgaggatctcaataggcccaacattcatagtgaagcacccctccccatgatcaagaccaagttcatgtatgcaaaggatgctcctaagacttgcatgggatctactcatggattgcatcccaactacaaggtgttgtactccatctttcgttggtctttgcttccaaaggttggaaatactactgctttgctatccaagcatgctcatctttcagtcgcatgcgctacaatcagcctcccttcagtgtgatgaaattgatttggtatgagatcgccaacaccattcttgagcctaagcggggttgcatctatgctcctttcattatgaagatgattgagacagtcaccggggtattctacatcaaagatgggcaccataatccttttcgccctcatgctccaccttcctcttctccagtggtccctcgatctgttccttctacttcagctggttcttctactagtgccccaccaagttcctcgagttcttctcccatcaagaaggcacttcaggcaattttctgtatgtgtgctaagactgccaagaaagtgaagaagatcgaaaggcgtcagaaggaagatagaagattggctgggaaagaagtgtcagatgattctgaggatgaggtctatgttgatccatttgaggcttatgaggcagcccacaacgttgccggtgaaggtctatccaccttcttcaatgaagaatcttcccattctgatgatgatgatgatgatgatgatggtgatgagggtgacaccgaggcagctgctgaggatgctcccactgatgttgatgagggtgtcactgctgctcagtccgatgagtctcatcactccggcgataccgagattgttccctctgatggagatgagtgatcctcttcttctcttcatagtttctcgcctttttggtgcctttatgccaaagggggagaaattgtgaattgaagggggtcatttaaatcctttttgctaccttgactgttgtctggtcatttggccggaagttccgggtcctgtgatctggaggttccggctaggcagatttcctctctattatctctctctatatggacatgtaatcgtattctattatggttggatgtaatgactgttagatgctttattatcctttatgtcagtaagttagaccatatggatgttgcattttgatgtgatgatgtgttcttttcatctatttgagtgattgccaagtcatctagtctttctttttacatcactcatcattcaagcactttcatctgcatctcttctttgataagggtagtgtgaggtttcttttgagctttccttcatcttatgcataatgttttcatttctagttcttgatatgcatatctttagggggagcttcacacttctctcatcattcaaaatttaaattctattatctttttatttactttaaccatgttgtcatcaatcaccaaaaagggggagattgaagatgcacttaaaccccctagtgggttttggtgattaatgacaaggtggttaaaggggactaacgtgtttatcaagtttattcacaggagtttagtcccaaagcgagttgtgatggctaagaatgtaaggagaccccccaattcgaatgttcctaagtgcaaaaatcatcgaaggtgattagactaggtttttcactttcgaaattgagtttaggaaaaaccgtactattaagaggggtttcaagtgtggttctagggtatacaaagtgctcttagtcatatccatgagtcaaaagatttttggaatcatttttgatcaatgattttctcccttggacagagagggctacccggaggttctggccggaacttccgggcaccgtttatttgcaaaaaatttcctaagtgctgcccgaaaattcctggcacttttgcccggaacctcctggcaggtttccagttcaaacttgtaacggctagatgacgtcaccttgctgttatatatatggatttcgtccccaggtcaccttttggccattccactcctgttcattcatgttctagggttttctagccactcccaagcttcctttgcttcctccactcaaatctagagcctatcttgtgagattgagagattagatgagagtgtaggagtgttttggagatggcttgaagattaggtttgactgagcactttggataccttatgggctgtcacttgggcttatttctcttggagatcttttcctagttgttaggtgtcgcccgtgagcttccaaagatcttgtggatgtcccgggaaagtttgtgaaggttttcctcacctccgcaaggaaacgaggtaagtgagtaaagattcttgtgctgagttttcaaatctttgtgtgaatcttctgatattctgcgatcttcatcttgttcctctatgtgcttaaacttctcttgctaggacctgtttttcatctcagctttaatttatctctgctgcccggaagttcctagctcaagaactccggaagttctggggtactcatcctacctagaagttccggtgttcatcaccaagaggttccgggccctgtcaatttaaccgctacgattgttgagaaaatttcaggatagcctattcaccccccccccttctaggctgcatctctactcgttcactagtatagttcttgttatcaagaaaaacggtaaggtcagggtgtgcattgatttccaaaacttgaataaagctaccccgaaggacaaatatgcaatgccggtagccgatcagctggttgatgctgcgtcagggcacaagattttgagttttatggatgaaaacacaggatataatcagatttttatggcccaagaagacattcataagacagcttttagatgtcctggtgcaattggcttatttgaatgggttgtgatgactttcggcttgaagagtgctggagctacatatcaaagagtcatgaattatatataccatgatctaatcggctggttggttgaggtctacattgatatgtggttgttaaatctaaggaaatagaggaccacatagctgatttaaggaaagtttttgagagaaccagaaaatatggcctgaagatgaacccgacaaaatgtgcttgtggtgtatcagctggccagtttttggggtttcttgttcatgagagggggatcgaagtgactcaaaggagtgttaatgcgatcaagaagattcagcctccagagaacaagacggaactacaagagatgatcggcaaaataaattttgttagaatgtttatttctaatttgtctgggaggttggaaccttttacaccattgttgagatcgaaagccgatcagcagtttacttggggggcagcgcagcaaaaggctttggataatattaaagaatatcttagctctcctcctgttttgattcctccacagaaagggatacgttttagattgtatctatcagctggtgagaagtcaatcggctcagtcttgattcaggagttggatgaaaaagaacgagttgtattttatctcagtcgtcggctcttggatgctgaaactagatattcccctgtggagaagttatgcttgtgcttatatttttcatgtacaaggttgaggcattatctactatccaacgagtgcactgtcatatgcaaggccgatgttgtcaaatacatgttatcggctccaattttcaaaggaagggttggaaagtggatattctctttaactgagtttgatctgtggaatgagtcaccgaaagagattaaaggacaagctatagccgattttattgtggaacatcatgatgattcaattagctcggttgagattgtgccatggactttattctttgatggatcagtgtgtactcatggttgtggtatcggcttagttataatttcccctaggggggcatgtttcgagtttgcttatactattaaaccttatgcaactaataatcaagctgagtataaggcagtgctcaagggttgcaattactcaacgaaattgaagccgatgctattgaaatcatgggggattctttgctggtaatcagtcaattggcaggagattacaagtgcaagaatgatacattaatggtttataatgacaagtgctaagaattgatgaagtaatttcggctagttactttgaagcatgtatctcgagaatagaatatcgaagctaatgatttggcccaaggggcatcggggtataagccgatgatcaaagatgttaaggttgaagtcgcagcaataacagccgatgattggaggtatgatgtgcatcaatatttacagaatccatctcaatcggcttcttggaaattaagatataaggcgttgaagtatactttattggatgatgagctttcttatcggacgattgatggggtgttgcttaaatgtttgagtgctgatcaggctaaagttgcaataggtgaagttcatgaaggaatttgtggtactcatcaatcggctcataagatgaagtggttacttcggcgtgcagggtacttttagctgacaatgctggaggattgttttagatattacaaaggatgtcaagattgtcagaaatttggagcaattcagcgagcaccagcgtcgctatgaatcctatcattaagccatggccattcagaggttggggaattgatatgatcggcatgattaatccaccatcgagtaaaggacataagtttatattggtggcgaccgattatttcaccaaatgggtagaggcgattcctttgaagaaggttgatt

SEQ ID NO: 78140 - DNA, 14651 bp, Oryza sativa
cacatccttcgtaccaggaaataaattcaatttgcagcgatttctattctgttctggtaaatccaaattcatgttcaattgctaaattaacaacccaagtctaccaagaggtttatacggtgatccaaatacttagtttttgcactctgaatgtgttttgtgtttctgcattttattcacaaggcgagtttgaagtattatcgaccactcctagattgagatgcaatattctcattatggcaagtgaagatgcaagttggcacatctatctaagaggagaagcatgcagaaaacaagaagcacatccaagttgtcaagagagagccttgctcctatctagatcacaaggtgatcaaatttttcggtgaattttgctaacatgatattgttggtatttcttagcgactaattcccagcagtagcactagaaataatcctggtatattatggttacagatatgatccgcaagcgcatggatatatcattgtagcatttcacccgggagtattccaaggtatcgcaagagaagatatgataagagagaactatgctaacaattcatatattacttatatacatcaaagtctatgcaggggttaattcagttcaaagggtagggtgacacacagaagaaagaactaagaactactctcactaaaatatagtttaagctaagtggagaaagaataagaaaaatatcattcctgtacttctagtatacatacatctttagtctatacttgctagtatacagtcatgcaaccaatacctcatacccagtgtcctcctggtgtttcgagaagccacccctgactgccgagttccttacgacagcccgtcatgaccatacaaccggggctaaatacggaggagtaccctccccaggaaattaacttaggacaatatacacatgcagaggacacccgtactaagctgtcaccatcagcggccagcatctgaaccactgtatattaccccaattaatggtatctaataatctaagcaccgcgcttacattactaaatactactctacatccttgcaaccgacatagagcaaccgaataatcggacattaaacccacaccaatacacctatctggaaagctagttacacgactatattgattcaagtataaagtaaagtcggcactcaagtaatatgaatggaataaaataccgaacttgtataaagaagaatattctattaattcaataagtcttacaaaataagaaagtaaagctattaaagccatactagaaatctcctgaagacttgaggactatgaagactattctatttcctactccactagcactagaactactaaacaatacttgagagagctcttgatcttcttcttgaggtgtgtgcttggaatgaaggaagtgaaggggtatttataggtggagatgacttgggagggtggagatcctccatagcatccaacgaacatcttccttctcctcatgccatctgtcctcctgaagtcggtaatagcgcgggaaccggtcataacgaccttaggtagtgagtagcctgtgtaagatgggggctgattgggctcagtggtgggtcggccgaccccttgctggctcttctggccccagctttctccagtagactcccatgttggcccctaaatcagtgacatacattctaggcccatttgtgattgttaaattggacatttaggccttctcatgcaattgcacatcaccggcagactttcgactaattgatcgatatatttcctcctccttctcttcatttatgagtgcttctcctgcatacatgttagtagcatagcatatagtggaagtaattattttatttaggaattatgcattgcaagcatagctagtcttcatatattggataatattgatggtcgaaactggttatcatgagatctaagtacttcgttttgtatacaaaagttcatgattctgctaggattacataaattcatgctagtagactcaagattttatttccatggcgagtttgaagtttgggcatcatgtttcgcgtcgctgcttagttcacacaggtttatactagcagattcaggatttattcccaatggtgagagtatggtctacttcttctgaatcgagggtgttacattatagtcatagagattgtttggcgcacaatgattttatctatgtgagattctttggatattgacaatttttatgctacaagaaaattggtctcaaggtgaagattgttaaacatgtgatccaaatattaggactacagtatatttagattagttttctaataggactctatattataagattagtttcctacttggactttgtgtcttcgcctattaagactcctatatttctcttgtaacccttatgaggagtgtgtgacaacccaatgcatccccctgcgtttgtatccaacttctcaatattgatcattgtcggtcggtgcccgtggttttttcccgcaagggtttttccacgtaaaattcgtgtctccgttgtgcatctattttcataaaaaaattatcccagacggacgacttaaggttcctcccacgaagaaatatcttcgcagacaaagctctaaagatgtccgtctaggataatatactatctttcatgtcggacgtcttaaatctctgcctggaatgatacattttcgtagttaagcctccgccttggacgtttgggagcaaaaatcgtgcatgcatgcttagtgaaaaggacctcgtatgcgaaacattttcctagtagtgatagaggaaacccactcaataatagtatttgggagcactgcttgggatcgatagacctcaaatatagctcgagctcccagttcttcacaatcttatagtcactgaagcctgctgtgcctgctgtcttgaatagatcacgccactcattttcatctcgctgtcgacctttggttacgaccatcataaccacattgatgaggagttgggcttctagaagtggccctgaaggagccccattcactatgtcagtgataatcaccttccatctatattctccgtttggaatagttttgttgcattgggctaggatcttcacgtaatcctcaacattccagtggtgaagcagaagctaccatgcacaaaacagtcaccaaaaaaaattaacaaatgcacaatttggtcaaatgtttctttttattactaatatatatatttggtcaaatgtttgttgtataattagattataatttaaattggtatttaatctatttgatttcttgtctttgctttacatgtgattcgtgaaatattttatcatgttttcttcgtatgctttggaatttagttattcgtaggtttgttttaaaataaatttccatacaactcaagcaatgatcacgacatgatgcaaaagttttaaaaactttgaaaccttaatgctttttcttaactagaatgttacaaacctaccccattaagcaaatcatgtccagtagattaaggtagagttgcaaggttacatggacttatttgtccaagcaaaaatttcgggtattattagtgtagggacatgaccctctaaatagaattgtgaggttacatggacttattcgtccatgcaaaagaaatcaaacatgtgtccagtatacttaaggctggggagaccaagttggttgtgggtgatgttgaattgttattcatctaggatgacttgcatgtttaaagtattccctccatcagcatctacaatcaaagccacacctagagtgcccaggggcactcatctctcaatggaggttacatctaagtggtctcttcaaaatctgaagcaaccgaataaaggtactcaaccccacaatgggtgtcccaaccaaaaaacccagggtgggtgttttcctatactacccctctcttctcccccctctctctcttctcttttttctttgctcctgcttcttcttcgtcgcccctcctcttcttcttttcttcgcctcgtctcacttccttcgcccgtcgccgtcctcccgggagtctcgcgccgcaccgccacagacaccgccgtcgcctccctcctcgtctagacaccgccgccttactccctctccatctctctccctccgcctccgctcgcctctttctctaacccgtagccggcggctggaagggcgatgaggagggccgccgccgccgctggagcaacgccgttgctggtggccgacgacttatgagcgcggtggtcaacggtgagcagcgcatggatctggcatgccggcaaccggatctggcgtaacggcagccggatccgccgctcgtctccctctcctctcaccggcacacaacgcgtcgttccgctgcatgcccctgccaaaagcgagcgagggacgtgtcccccagcagaggcgcgcgttccatcgcctcgggcgaaacggctaacggcttcggacggagggtgctagggggacgacctggggctacgcattgaacatggcctaagtgattttacatattgaaattttacataagcaagccggacacattaactcacatgaaacattcaacagaagttttacacgtattaattcacaaaaccaagcttgacatagatcacatatataacaatttgtttcagaaaatatgcccttccttcctttattcacttagatcacatcctccacagaggggacccacacaattagtgttggaaccactgctatgggtagacctcaaagacgcctcgagctcccagtttcttcacaatattgtagtcactgaagcctgctttgctgaagagatcacgccaatcattctcgtctcgctgtcggcctttggtcaccaccatcatagccacatccatgaggagctgggcttctagcagcagtcctgaaggagcaccaataactatatctatgatgatcaccttccctccatcttctcgggttggaatagctttcttgcaattagctaggatcttcacacaatcctcgtcattccagtggtgaagcacaagctaccatgcacaaaaaagtcatagaaaagttaacaaatgcgcaatttgaattacacacttcgtggcgcactagtcgttaactgttcttctatataggaaatggattctaattaattactcaagactcaagacgatgtcttccgtatttgcatgttatcctaatattataaaaaaaataacaagatatatcgatatatgatatatgactttaaaaacatccaaattcaaattcaatcatcacaagttataaaaaataataaatcaaactctcactggtatatatacgtgcgctgaaaatcacttttaattttaatttatttcagttaatactacctggagcatcacagcttgagcaggtgggatctcacggaacatgtcgcccgctacgtagttcaccacaccagttcgtgtctcgccaatcacccggggaaagtccagcacggtgaacttgatgtgtgggaaggcctcgacgatggccttcgccgccctgccgtcaccaccgcggcaatcggtgagcgactccaccccctggaacacctcacggcactcccggagaaccgtggggaagtctgagtggtcgtgcgccgctagagcttcgttgaacatcgagtcagactccgggtcaaggttcgccatgctctcgtcgaacagcgcggcgccgtgcacctcctcgaacggcgacggcggcgccgaggacgacggcggcaggtccttcccgaaccagtccgcgagccccatcgccgcctccacgaagtgcctggacgtcgcggcgagcaccacaagcacctggctcgggtggccgtcgacgacgggcgctgcgccttcgccttccaccaggagccacgacagcggggtgaggcggtacatcccggcccacccggtggcggtgtcgtcggcagcggcgaagacgcccgagttgaccagcagccgcatgaggcggcggaggaacgggagcttggcgggcgggagggagagggcggcgacaaggtcgggcagcgaggcggtgccgccggcgcggtggatggcggtggggatgccgagcttgacggcgcactgaaacgccatggacgtgacgaagtagaggctgtggcgcaacatgtcggcctgcgcgtgcagcagctcgtcgtcggtcggtggtgccaacatgttgggaggctgacctgccattaaaaattgaaatctagctagctatctcgatcgcgattaacttctcgcgactgtggtatgtttgttgtattagcatgggtacgagtgacgggtttaaatagagtgaggctcagcgattcaactgtcaactgtggctcgtgttcagcgtggaaatagaaaattgttgtcaatggccgaatggcctacagttagatatggtagtttgatttcgttttttatttgtacacgtgtgcactgttatggcgatacgatagaaaatctgtaggttgatacgtgggtactagttatttagaaaatctaattataacaaggtagcccgtgcacatgcgcgggcatcttgtttaacacgtttaaaatttgagacccactacgattctctctattgatagtagaaagtaatctaatccgttgatcttatttgatcgaatgatttagatctatttatactaccaccctaaatagcagtagttcaaacatggagagacattactataaaaaaagtgcgtaaggggtataattatcatttagtagtcactaaacctagttttattcttgtttggcttatttcgatggaatatgagcgatgccagcacaataaataaccacagattgatcaatctagcccgaaaaaaatatataaatgaaaaggttagccttaatcaatgtattagtaaataacgaatggatcagatcatttctactggtgatataatagtatcagtagagagcatcggatcaccactcaaaattttataacaaatatatatgcgtgagtgatatttttattgaaatatcttttttactctattctaatttatttgggattacgttggaaatgatttttttttctaattacccttgcatcatataaattgtaaactaaaatcatgtgaaatcgtgaagtcttgaatttatttatgagaaaatatggtgtcgcaatcacaaccatggaattggtttgtatgatgttttttatactgtagatgtttttcgattttaggataaattagttgaagatatttgtttattaaacatattgctaatatgactacgtcatctaattaaagatagacttatactctatagaagtcaaattttgtcctaaaatgtttgaagtttattgaatctgaccaatttaccgaatagtttatgatctcaacctaggaattttggtatataagccaacaaatcatccaagtaattggttggaactaatttatttcctttgcgtatatttgtttgtttcttttgcaatgtatttaatttcaaatactacagtaagaattcaaatttaattagtatcttcgatttttgtttactttttacaactgacagctaattatcaagagtgggttttatcatgtggttcaataagttaatttagtatttacaaagaagcctcgctagcaattaagacccggtgattattatgttgttgtcgatgggggacacccgtagaccggatatagagggtattggggtacgctggtacgaggatctacgtaatatgacatcaagctaatagaaaacatggattatattggttcaggccccttggtaggccccttggtaggtaataaccctaaatccagttgatatgggattatatgatggaatcacagattacaaagggaacaatggaactcgatgataccgacgagaccgtagtcaagttggttcgactagatcacccggcgacttggctcctgtaggctccggcttcgtaggctatggtggttgtctcggctgtgagattcgatgccttaggtccttccggtgggtcccttttataccgcaggtaaggtggtttccaagtaggactcggagacatcggaccctacacgatacagtgacgacccagtccgatccgagtaggaacctttccatctgtggactccatgatgaattttcttagcgtatacaaagaacatccgtatacgcgcagatataccatatcgatgtatagcgtatatccaagggtagagggtataccttattcgtaaccctgaaagtagcccctgacttctgcttaaatgaactcatgtaaccgatcgcgacttctgatgtcgggtttgttgtcgttctcgactggtcgatctcggcgtgaggaccgtagagacaaggagtaatcgacgacgccatgcgaagttcaacggtcgtgagtgaatttaaattgaagtccaaaaactgccgcgtgtaacggacccagaaatttccggcggccatctctctcctttccttggaattcgcatcgtcggtagtgcgtctatttaagggagttttggggatccattttggagcccgcctgttgcaaaaacttcctagcctccaagcgctcttcgtcttctccgctcccgcacaaaccctagcttgctcatcttggtccctcctccggtgatctccggcggcaatggacctcgacaagtccacttccaccagcgcgtccctgaagaagttgcaggaggaaggcgctctccccggtcgcgggaccatggagagggaaccaggaggtattgaacctgaacctgtcctgggccgcatggttgcggttgaggactacattctctgcggttttctcccgccgccttctgagtttttccttctcgtcttgaatttctacggtctttctctgctccatctgaaccccaactccatggccttcctcagcatcttttcccatctttgtgaggtctacattggggtagagctgtttcttgatctctttcgtttctactacgagctgcgctggatggaacgtaaaaatgtgtccgggtgtgttagtttccgacttcgggatggcctgaagtcgcgatacatccccttcaagtgcccctcttctcgtagcaaatggcgggcgaggtggttctatcttcagatagaaaatttggatccaatctttgttgtccctgaggaacaactagacaagattccgttttggaccgccaagcctgccttgaccccatcccttcatgtggacccccgtttttataacaggaatctatcgtgtaaacagtaccatttccctggatcaagtagtctagtacacacgagttcatagctgaaataccaaatgcacatacacgagagtctagtgcgaattattacatcataagcccgcaggcatagtctcaaatcatcggaccgagcggtccggaatacattccaaaaacagaagtaggtaaggcagcagagtcaaggcagcggcacgccattgccacaggcaacgaccgtaactaagacctactgagcgccatcgtctccatcaccctcctggtagtaagcgtagggatcctccgaagcttcatctccgacctctgattaagtttgtatattacaagggtgagtaccaaccgtactcagcaagccaccacagcaacaatgcacatgacaggggtattcaaaggatggctatggttcttttgcgcaaagcaagttttgtaattctttttcacaaacctgagacctagcacagactgatcaaattttagtaccagtgttcatattaaacaatgacggttctgtccaccatccattgtgatcccaaggatagcttcccgctattgagtcgtcatggttttctgaggacgtccacattcccgcccctcaggaagtggctccatcagcatagaaatcatcatgcaatatcccatcccacacaagttaagaatttagagtctagccaagtgtaatacatgtcccagtgctcaataaccgcgagcacggctattcgaatagatttggtttactcacactgcagtggatgtacactttacccgcactccgcgactgcccaacacatgagcctcgtcccaacacatgagacgtgttacggcaaagcttttcgataacctcgcattggcagtacccgctccatgaactttacatcctcatgcactctaggcgtacacggtttctagcagtgagaggagttctggtgcacccgggaagggaagactcacacatgcattaagttataattacgtttagattctcacatggcagtcctaccgatggcgacaccactgtagacacccgcctcgcggtcctaccaatggctgccccaccgtagagcccctgcctcacataacaagaaaccactatggatggatactgcctccgctcagctatctactccgcttggtctataccgatacgagaagtgcggttatacgggggtcgtttcatgcttaacttcatggctcggtccttaattgacaggggatggcactagccttttccggataccacccaaatcctccgtccgccccagtcgaaaatagttgtttaatttcatttctcctttcacaaatcatgtcatcaacatcatggcaatgtggcgctcatgtccccacatgctgcatctcaattaccttcccaaaggtaattgcccaagcatatagcatttgataaatatgagtatgcatgattctagaatagcatttctaagcaattgtcataactgagtagggactcatacgtaaatggttacaaaggcataaggggtaaacaagaaccaaggcatggcataatcacaagtaggatgttcatcattgcatgcaatttatttgtaaacaaaataatttcacaattgggatcaacatgttcaaagaatagtgatgacttgccttgctcgaagctttgcgggtcttggtcctcgctcggatccgcaactccctcgggctctaaaattacatgcgaagaaacaatttgaattcggttagaattcaaataaagatccaagtaaatccaagaagatatcgagcgcggaagtcggtttcatacattatctattttcgttcgtgaaatagagctactccgtctatttaactctatccatccccaaactattttgtggcataaatattttattagcacaagtttttaatttaatccgcccgggtattacatccatataataggttagaaatttctatcgcgagctaaatatcggacaaaatcctaaaattatcttataatattgcacgatttaatttagtctatgactaaatgattaaatataatacacggctaaaattcctagtaattaaatccgaatttctaccgtgaatcgattacttatagagattaccgaaaaataatctataattatattaaattttgcaattctacgactataattaatctataattaaattctaattattttaaattttctaaacttccttaatctccctctaatttctatttatttttccttttctttttctctcctcttttctttcttttctttttctcctctttcctttcttttctttttctcttcttctttcttttctttttctccctttcctttcttttctttttctctcctccctcccggcttctttctacctctctctctctcggctcttgctcacccgggcggcaacggcggtgtgcgcgagggggggaggagacggctcaccggcggcggtggtggcggtgacgacggtgacggcggcgcaggacgtggcgcggcactcggtgcggtgcggcgtcaccgaggtcggcggcgtggcggctcaaatgcggcggcgcgaaggcggtggcgtggtggcacaacggcgacacggtgtagtgggtagaggagaggaggagggaatggagtttggagaggggagaatggtgggcttatataggggagagaggggataaggggggagagggaagtgaagggggtgacacgacggtggcgcggcggcgcggggcgcgaggcggcgataggacgcgcgcgcggtgatggaacggcgacagtgacggcgcggcagtggcggcaaggggcgcgaggcggcgatggaacgcgcgcggcgacgggacatcgacggcgacggcgacaacggtggcgcgcggctcggggcgggacgcgacgtgcggcgacgcgacgggcggcgacacgagatcgaggcggcgacagcgacggtgcgacggcgacggcggcacggggctcgaggcggcgacggcgacggcgcgcggcgatggtgacggcgcgcggcgagcggcgatggtgacggcgcgcggcggctcgggtcgcgaggcgacgcgatggcgcgcggtggtagcggcggagcgaggcgacggcgacggtgacggccggcggcggcgcggggcgcaatgacggctaggcgcggtgtggcagaggagggggatggctaggggacgcactcgagcacctagcgtgcaatgaatagtgacttttcctatttatcccgattttagactattttctatttaaatatagccctataaattctaatttttgcataaatgaagtttactcaatatttgtgttattgtaactaaaaattcaccctaaattaatattacccatattttatttttatataatttatttgaatttttaattagggttaattcttgctccatcgcacttaaatttaattattaccattatggtcgcgataatattttatttatttctatcctcacctaatctttattttaaattatatttattttgccaatttatttttagggtttattcctaattaactattctttactcacaactaatgaatttcgaaatcaaatccaaataaaataggcgaatagaatcggcatgatgcaattaatttaaaaagtttttgaaggtccgcatttttagagttttgtttttattggtcgaattttcagggtgttacaaacctaccccccttaaataaatctcatcccgagatttcttatcggatttcgaatagatgcgggtattctgtctccaagaattcttcgctttcccaagtggcttcatcctcagtatgattactccattgtaccttgtacatacgccacactttggtcctagtcctcttttctgcttcatccaatatccggactgggtgttctggatacgtgagatcattgctaatatgaatttcttccaacggagcttgttcctccggcactcgtaagcacttctttaattgagacacatggaaaactgggtgcacatcagcgatattttctggtagctgtaactgatatgcaacttctcctcgtctagcgatgatttggaaaggtcccacatatcttggtgctagtttccctttaaccttaaacatttttgtacctctcatcggagaaaccttcagatatacataatccccttccttaaattctagatctcttctccgggtgtcagcgtaactcttttgtcgtgattgtgccacttttagacggtcacggattaggcgaaccttttcttcggcttcttggataatgtcaggtccaaataccgtccgttctccagtctcggaccacattagtggggtacgacatcgtcgaccaaataatgcctcatttggcgacatctttaggctcgcttggaaactgttgttgtaggagaattcggcgtagggcaaacatttctcccaatccttgctaaaatccaaagcacaagctctcaacatgtcctccaagacctggtttgttctctctgtctggccatctgtttgtgggtgataagctgtgctaaaagcaaggtaacttcctagggcttcatgtactttttcccagaaatgcgaggtaaactgtgtgcctcgatcggatataattctcttaggcacaccatgaagacatactatccttgtcatgtataactcagctagcttggctccgctataatttgtcttgacggggatgaaccttgcagtcttagtgagtcggtccacgattacccaaatggaatcgtaaccagttgcggtcttatgcaatccaacgataaagtccatacctatctcgtcccatttgcattctggaatcctaaggggttgcagcaaacctgccggtcgctggtgctcggccttcaccctctggcatacgtcgcagagtgctacgtattctgctacatcccttttcatgttgggccaccagtatccttccttcaggtcctggtacatcttcgtacttccggggtgtaatgaatatgctgattcgtgagcttcccttagaattaatcccctcagtccaccctgttcgggtacgtaaatcctcttcttataccatagtgtttccttctcatcaattgagaattctttcgcacaaccagcggctatgcgctccttcacctcttggatctctccgttgtccttctgggcttcctctatctgggtcctcaaaaggggctggatgtccaaggtgtttatttgaccataaggaactaaatgtaaattcagttgggctatttcctccttaagttcaggggttatcccttccatcctcagatgattgcaatggctctttcgacttaaagcgtcggccacaatgtttgctttgcctgggtgatagtgaacctctagatcataatccttgattagttccaaccatcgcctttgcctcaagttgagatctgactgggtgaaaatatacttcagactcttgtagtcagtgtagatatcgcaatggtttccaatcaaatagtgtctccaaatctttagctcatgaaccacgactgctagttctaggtcatgggtagggtaatt

SEQ ID NO: 78141 - DNA, 8505 bp, Oryza sativa
gagaggagggagaagaagccgggagggagagaaaagagaaaaggaaagaaaagaaagagaaaaagaaagaaaagaaaagagaaaagagaaaaaaagaaaagaaaagagaaaaagggaaatagaatagggaggttaatagtttagaaaatttaaaataattagaatttaattatatattaattatagtcgtagaattgcaaaatttaatataaattatagattattcttggtaatttctaacagaaatcaattcgcggtagtaatttagatgtaattaataattaaacaattagatgaattcttatagattattatagattatttttgggtaatctctataagtaatcgattcacggtagaaattcggatttaagtactagggattttagccgtgtattatatttaatcatttagtcatagactaaattaaatcgtataatattataagatagaaatttctaacctattatatggatataatgctcgtgtagattaaattaaaaacttatgataacaaaatatttatacccgcaaaatagtttaaatcgaaattgggtttgtgtcacacccagaaattcacgaaccagaatttctaagctgaatgtgtattaaacccctgtccaggaccagccagggtacacaaacgacaattgttgacatacagatccacgtcttacaaaaatataaaagattacaaatgcagtggaaaaagataaaagcgagctgagcctgaagactagactcctgtagcggacgactccattccaaaggcatccttgacggcagcgacgaaaccaacctcttcgagacatcttcactgagaaggacttcaactctggtgtgggggaaaagagagcaagactgagtactacccactgtactcagcaagtcataccggaagaggaggtatgatgcaggatataaccaaagaaggctaggggttcttttgcacaaagctagcatttaaaagcagtagttgaaagcaataaaatagctgtagtaattaatcaatattaaccaatcactgtccaacgctacaccatattgtaacaggcccaaccaaccacctgaactacaccagttcaatagctaactaggggtgagactaatcacagtgaatctggccgaccgcccataaccgcgggcacggctattcgaatagttttactctgatcagaggtgtacaactgtacccacaagacacagccccacgacatgtttccgtgcgccgacatgccaccacgacataccggaaagaggccgtgacatgacccttcgcataaccccctctaaccaatcgcaccacacctcaggtttcacccccactcctcgcaaggcagcgggcagtcccctctcgtgccacggtgaatctggaagccgatcaaccggacaccccggccgacccaactccatcacgctcacccttgcctgggtacgtcggctagaggaaagctacactacaagcccagccgttgcccacgctggcttgtggtaagtacgataagttcttccagggcatcctgcgaaccggtccttaatcgccatgggcacaactagcaaaaccatgcacccacagcccaccatgtagtgtgttttaattaactaacaccattacggtggcattaatccaaagctataccaataatcaaagtctatgtattaatgtggttccccatttgtgtactagttgaactaagcatggctaagcattccctgaaccaacatctaatcattttagtaccccagttatcaatggcataagataaacaatacatggctgagtagtaggacccatcccacatgatattgtaaaagaatgcaacatttaatggaaacgcgggacatttgtaaattgggtacaatatgatcaattgtaatgcatggcttgccttgctctcgcactgatgagaccacagcaacgtcttcaagaaaccgtggatcgacgaaacggctgaaatctacgcgacaaacaaagcacacaagcaaaacatgctataagactactgaaacaggaaacaaaaccatttttaatggattctatacatttttatgaatttactgagacttgaacgggcttaaacggagctcggatgaattagttatgatatttagaagattctctgtgtttattactataacaaaagtccttaaatcatttattgcgtaataagtcccagggctgacgtcatcaaaggggggtcggcgccgacaggcaggacccacatgtcagtgaagcacggggtggccggtctaccgtggaccgggaccacgcgggtggtccaccgccggtccacgagatcgacggcccggatcggcccgggactgatcggacggtgcagcggcgacctggctcggctcggctcggcacaaagccggccggccggccatggcaaaggcggcggcgcgcgcgcgtcgccggcgacggcaaccggcggcgggagacggcggcgcaaaggcgctggcgcacgaccggggcggcggctcgacccgacgcggctaggagggagagggaggggaaaagaggagggggatgcctcaccgagagtggccggcgcggaggaggacgaccgcgaacggcgacggcgagccacaggaggacaacggcggcgggcggacgagctccgagatgccctaagagaggcaaggagagagattagagggagaggggtggaccacggcgagcggaacccatggccgaaggcagcggtagaggtggtgctcaccggagtgcgaggggatgcgggctccggcgacggacctcgacggaggaggtgcggacggggtggaccttggccacgcaaacccgacggtggcgacggcgcgatgtggcggcgagcctagcggcggctagcggcggccggagtagcgggagcggcggcggcggatgggtgcacggcgcgggagcgatggagggcacgagagagttcggcgagatggggaaaaagagagagggggtggcggtggagcttaaataggcgagggggaactcggacgtggccggtaggggcgggattagccggccgacatggggagtgggggaggagagagaggcgggattcaaaattcgaatcccgaccatctcgggcgcaggcgcgagcgggagagagggggaagtgggtgcgggagacgcggcacacgaccggggcggccgacgtggcccggagggggcgggacgtgggcgcggcggcggtttcggcgctggtggcgacgtgggggcggcggccggaggaaggggacaaccccgacaggtggggcccacctgtcggcgtcccggggagagagaggaggcggccggcctgactgggcctcggcccgcggccggcccagcgggaagagggggagggaaaaagagaatgggccggcggcccaagaagaggaaaaggagggaaaagaaaacgaaaaggaggaaaagattttccttgggatttaatattgtactttgcttattttaattggttaaaattatttccaagactctgaaaattccactaaaagtcttgttaatgtattggagcatggggaactcaagaaaaattccaccacgccgaatttgattattaaatgcatttattagttgaggattagctctaggttaattcaacaatttctttaggtgatttatttaacaaattttaaagctggaaaggggaacttcagggcgtgacagtttgccctagttcgtggatagtaaagttaatataaaagaatcgactctcgcattcgacttccatttggatttatttggatttttatttgaattctaaccgaattcaaatcaattttcgcacgtaactatagagcccgagagagttgcggatccaagcgaaggtcaagacccgcaagactttgagcaaggcaagtcatcactattctttgaacatgttgatcccaattgcgaaattatttttatttacaaataagattgcatgcaatgatgaacatcctatttgtgaatataccataccttgattattgtttacccttattcccttgtaaccatgattacgtaggagtccctagtcaagtatgacaaatgcttagaaatgctactctagaatcatgcatactcatatttatcaaatgctaaatgcttaggcaattacctttgggaaggtaattgagctgcggcatgtggagacatgagcgccacattgccatgatgttgatgacatgatttgtgaaaggagaaataaaattaaacaactgttttcgactggggcggacggaggatttgggtggtatccggaaaaggctagtaccgtccccggtcaattaaggaccgagccatgaagttaagcatgaaacgacccccgtacaaccgcacttttcgtatgggtatagacctagtggaatagatagctgagcggaggcagtatccatgcatagtggtttcttgatgtgtgaggcaggggctctacggtggggcagccattggtagaaccgcgaggcgggtgtctacagtggtgtcgccgtcggtaggactgccatgtgagaatttaaacataattataacttaatgcatgtgtgagtctttccttcccgggtgcatcagaactcctctcactgctagaaaccgtgtacacctagagtgcatgaggatgtaaagttcatggaacgggtactgccaatgcgaggttatcgaaaagctttgccgtgacacgtctcatgtgttgagacgaggctcatgtgttgggcagtcgcggagtgcgggtaaagtgtacatccactgcagtgtgagtaaaccaaatctattcgaatagtcgtgctcgcggttattgagcaccgggacatgtattacacttggctaaactctaaattcttaacttgtgtgggatgggatattgcatgatgatttctatactgatggagccacttcctgaggggcgggaacgtggacgtcctcagaaaaccatgatgactcgatggcgggaagctatccttgggatcacaatggatggtggacagaaccgtcattgtttaatatgaacactggtactaaaatttgatcagtctgtgctaggtcttagggttgtgaaaaagaattataaaacttgctttgcgcaaaagaaccatagccatcctttgaatacccctgtcatgtgcattgttgctgtggtggcttgttgagtacggttggtactcacccttgcaaatataaacttaatcagaggccggagatgaagcttcggaggatccctatgcctattaccaggagggtgatgaagacgatggcgctcagtaggtcttagttacggtcgttgcctgtggcaatggcgtgtcgctgccttaactccgctgccttatctacttctgtttttggaatgtattccggaccgctcggtccgatgatttaagactatgcctacgggcttttgatgtaataattcgcactagactttcgtgtatgtgcatttggtatttcagctatgaactcatgtgtaccagactacttgatccagggaaatggcactgtttacacaattgattcctgttataaaaacaggggtccacagctactaggctctgccataataagtaccctacatagctagggtacgggactactagtagctattacagggatttggcatgcatagcaagctagtagtacctccggttttatttactagctaggctagtaccaaaggcaggacttaggcatgctaggtactagctagctatcaggaacaagactatacagtgatacacacagcaaacgtgcgtgatgataatcctagcagcacgcgacatactcgggagaagccggcacgtggggccgcggcatgggggataagtggtataccgttcaacggtataccgttgtgtagtctctctttttttttcttgaaatctccaatatctcatgattggaaatagtatcatgtatctctttgggcatactctaataagaaagaagcacttagcctctctatctgacatatgacatacattgctcatgccattaggccttaattaactaattttaacaaaaggtagtagtaaaaatacaacattaaatcattcacgctaatgctaaaggagcacaaggatagtatcaagcacggaggaaacgtgtaaaaccaatccaggcatccaaaactggagacctgagaattataatcaggattcagggaagtttgataaatttgctgtttctcaaactaaggctgtgtttagatccaaagtttggatccaaaattcagtcattttccatcacatcaacctgtcatacacacataacttttcagtcacatcatctccaatttcaaccaaaatccaaactttgcgctgaactaaacacagcctaaggtggataaatatgtacaatggcatgtacacagcaaaatggtgaaaagttatttacattttatccttacttggttattgtcgcacagcttagctagaaaccttgcaagttaagaagagatgaaacgtggcatatgtacactagtcttgcaggaaaaagaaaaagaaaaagaaaaaggatactgctatattgcttcaggcctcaacctcttcaggtacttgttcatctgttgctgaaacgaactcttctgttatgctcgtatctgggttggcatcctccatgtttctatctggatgggactcctgttgcattatgctttcctttatcattgacatcagagattccaggacattcttgttttcagcgagataacatttaagagcatcctttccatggaaattttgcccgttcaagtgatagaatactcctgattttgttatgaacttgtgtttgaagcctacttcaataatctccaattcacgactcaggcccttaccaaactcaagctcaaggtgtacagtcttaaatgggggtgcatgcttgttcttgacaatcttgacctgaatttgtgtgcctacaacctgttggattgaaactggatcggggttatataatgaaacaagaactgaacatgaaacatctacgaaattacaaaacctattattactaaattcaatatttatttttgtgttacctttttggcaaaatgggacactacatagaaagcaaatattattgatacgattgtgttacctcttctgacttttttataagaccaatccttttggtgttcaagcggacagaagcatagaactttaaggcattccctccacaggttacttctgctggtgctccgaatccactaaatgtgcttaatttcgatcttacctgtacacatacccagaaatgatcactctgttacctctaaataaacatcaaaagttcttttgaactaagtgattaggcttggttagaattacaatactggacataatactaacccataatacaccctgcaaacgcacccaaaaaaacgtcatattgtacaaggaaacaactccactaaactatttcctgtcttagtttgcatacatggttggaggatagtttgagttccgtgtctttgttcttcattatagagttaatatatcctctcttactataaagttatagctcactaattcctaaagcttaacatacaaagatgccacatcatcatccactaataattgttacatttaaacatcatggaagcatgctatattatctataattcaataatctattaaattttagagatttaaaatgtaagcaggttaaatcatcatcccacataattcacataatagttaaatatatctctccatcatttcttttataatatcctatatacctatataattcatcctcacttagttcatattatttttctctctcattaagtcatatcacatcaattgtttttaatccttagatgcttaatctatggttcaaattatctctcttttcttctctcattaaaccatatcatcttactccctccgtttcacaatgtaagtcattctagcatttcccacattcatattgatgttaatgaatctagacatatatatctatcttagattcattcccattaatatgaatgtgcgaaatgctataatgacttacattgtgaaacggaggaagtaatttttttagcccttagatgtatggtctaaattatcttccttcttttgatctctcataaagccacatcattttacttttacatttgaatcatcattctaaatacaatttaaatttaaatcacaacaacttatgtaaacttatgtttatgtaagcttatgttgattaaactatcttacacattatttttctttgttgtatcattgcaaactcctgcagtaacgtgcggggtttcacctagtattacataatttcgtgacaaccgtcaacctgaaaaatgtccgaagcccacgtttgactatgggaaaattttttatataaaaaagcaaaactctggttttttaataatataatagggtggtgttttaggagtgctggaactagagttatcaaggctgacccagccatcaactttctggaggtctaggtcacatgtccaacagctgggtatttatttaaatattgaaataaattaatgggaggaagtgactatttatactttgcgtgcggac

SEQ ID NO: 78142 - DNA, 2707 bp, Oryza sativa
  unsure (1)..(2707): unsure at all n locations
ccgctaatgacgcccttagganngatcaacttttggtgtaccttgcctcctgggacaaggattaatgcacgcacgtaaggaacgcccggtgggttatttcaggtcgtgacactgggattcaatatgctcaaagatgatgtgacttgccttgctcgctttcccaaacgtcggcttcaacttccacgaagagcggatcttccgaagctatagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatagccatttgaagcttatatgctctttaattgaatatttgcgaatttcttcatttaaattttaatttaaaatcggatttattgcgtcagccgaggggaaagggcgcgcggaccgggtccacgggagtggggcccacgcggcagccccacggtccacggtggaccgggtgcacgcggcttacaccggccggcgccgtgggccccacgcgtcagccgcacccgagggcgcgggcggctgacggccgggccccacatggcagccgcgggacgcgcccgaaggcggccacgccggcacagccgacgggaggcggcgcgcccgcgccccgatggtcgccgccggcgaccaccggcgcggcggagcggcgcccgagagaggggagggaagggggaagcgaaacggcggtccacggctcaccccgggtcgacggcgacaacggaaacggcgaccgaagcggagagaggcggcggcgcggctcgggtcgacggggacggcggcgttccggcggtcggcggtcgaaacgggggggggggggtggacgaggtcggcgaggtcgcggcggagccgaaggaggcgacgccgaaacgggagagggtccggggcgacgacggcggtggaccggagctcggcggcgacggcggagagagagaacgacggcgcgagctcgattccgacggggagagagagcggcgagtggcggaaacggtggagggaggcacggggagcgtttaaatagtgttggagggggagagaacgnccgnatgagggtgaatcggccgcggaagatccgnccgccattgatgcaccggcgaagtttgctggagtgtttccaaacgaatccgagggagagagagagagagggaaaagtggggggaaagggagagggaatcacggggagtgatttccccctctttattgcgcgcgggggcggcggaatgcggcggaatccgcggcggcggcggcgctagggcacgggcaaggcggcggttgcggcgcgaggtaggggatgacgggtgggccccacccgtcagcgagggtggcgggcgggcccgcccgtcagcggcgcgcgcgcgggggaaggccggatgggccgcgggggagaggagagagagggagggagctaggccgagccggcccaagagggggaagggggaaaaagactttttagggtttttttcttttaataaaacctttttaactttgtttatttcttcttaattattatttgtgctctgaaaattccactaaaatttatttacgcattttaggcttttaggaaatatacaaaaatcctccaagccttattcgacttttaactttgcacatttttattgttggaggctttcacatggattttacttattctatgcacaattttgaggatgtattttagagtcgttttgggacgcgacacccagtttataaaattatgttgctttaaattattgcattatcgctttatttaaattcccgcgttatcactgttttatctagccatgcctatttacctttgttatgaccttattattattgttattgttattattaccttgttcaccctagattaaacaaaaccccaactagtggacactcttctcatggtaccactagcatgattttaggtagatgcttcgctattttaattaggtaacactaggtggtttttcaactctagactttgggaatattcatatcacctggacactttggaatggtttggttattgtggaattggcttcacaccgctccttctattcaaaatccccaaaatggttttaggctgggcttggggtgcgtggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatcactaggacaaatgaaggctacacgagctgcggcccggtagtcgagatgtcatggcacagggccggtgtcctgctgctaggggctcagtcctgcctgcctgtcccgggggttccggccgtaggtgggattgagtcggtactcttgtctatggctaggatgggttggaaactatgtcacgtcttccgtctgtacaccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaactgtggaatggttggcc

SEQ ID NO: 78143 - DNA, 608 bp, Oryza sativa
atgccacttcacaaacatgcaaatttaaattcaatttatacaagtggaaacaaaaataacaaatttgactatgaagtgaacgtgcaattcacgatcaaatttattatttttgtttagaattatataagttgaattttaactcgcatgttagcttaaagtggtggacgacaccctcgtcagctactacaagagaaagtcaggaaagagtgagagagaaggaatgagaaagtcaggaaagagtgagaaagaaggaacgagtgtgtctatctcgggaagaggaggcacctcagggttcatgccttgacttaggctcggtttagatggcaaaaatttttgttttaaggtatcaaatcagatatacggtcctagttgtaatgctgccagcggccggctagggcgaccagtagcaggccaggatggcgagcaatggtgagtcgacgaccaacggatgagtgcctgagtgtgagtggcaggagtagacggcgactcgatgagcagtggcgagaggagattgtgttggatcaaagacaaacagacacacagcctgtacagatgccgtattgcggttaggaaaaagaaagaacaaaagcgaaaaacgggagtcgaga

SEQ ID NO: 78144 - DNA, 5657 bp, Oryza sativa
  unsure (1)..(5657): unsure at all n locations
cacgatgggcaaatagnccagccatgcagcggnaaacaccagtcgccgncgaacgagcgncccagtcggtgaaanacgtagacgccacaacgnncagcataataggccagccatgcaggcgaaaacaccactcggcaagagtagtgccgcggcgttacatgcaacagccagaaaatacccagagattaatttgatatttagagatcaatctaatgaaaaaacaaataagtcgtaaggggaaaaaacccagcgaagtcgaagattaaattgttgaactcggcaaagattattggtcttcctggatgcgtgcatgtcatgggatccatcctcctgccatgcgtgtgtacagatcgcggacccgagtctggatcaaatcccagtcggaggcttcgcgcgtggtcttaactcagaaaagtccgataccacaacgcaatacgacagctccgataacacatgcatgtaaacaaatcaatctgattagcagagaaattaatgcatatatgtagttggttatgagagcaagtaagcaagttaatttatttgctccctccatgcatggcctgcatgctcctgtgtgcacgttggtcgtccatgcaaggttctagtcggtggcatgtcaactgaatcagcacatgcgtgtgtttgctcctgatgcccgggctttcctctgcccaactaatggcagggccatccgcgtgggaggaaggggaaaagctctcggcaacggttaggcaggagtggatgacgatgataatgaacacgtcttgatctcaaccagcatgtgaaaaacaaccaaacaccaggaagtcaaacaacgattaaaagttaatctaataaaaattagattggaacgataaacctgattgaagatttgagccgtcgaaatcgatgagatcgatctcggggtttcttctgaagttgattccatcgcacttttcgataggtaattcgacgcaacccctacttggcgcgccaactgtcgaaacatgaattcggcaataataaaacggggtagcgcacgagacctaaaagtggatggatgcagagacagaggatttagacaggttcaggccctctcgatgagaggtaataccctactcctgtttggggatttgaatccgccgggtgtattatagatctgacgatctagttgtctcatgccccctagagggcctcctgcccaccttatattggatggggggcaggattacaagatagaaaccttaactaatacgatatcggtttcctaaatctattttacaatattatcaaatcaggactttaggccgctccataatataaaaggaaacgtaatactcaagtcataatctgttacatatttcatagatataagctatcccctatgactagtcggataaccatgccgtgtgggtatggggtacccataatctccacacgaagttcataagaagtttttccaagtttagattgcaagaaaactcgatttgaaatataacatgcagtgttaatcgcctcatgccaaaattttgtaggagttttgtattcatccaacatcgttctagccatctcaaccaaaacacgatttttcctttcaacaacaccattttgttgaggaacacgaggagaagaaaattcatgttcaagacctctttcgctgcaaaattgttcaaatgaagcatttttaaactctccaccattatcacttcgaattcttttcaaagaaccagaaaattcaagctccaatcgaagaaacaaaccacgaaagtgttgaaaagcttcgtccttagttgccataaagaaaacccaagaatatcgagaaaaatcgtcaacaataaccaacacataccactttcctcgaacagattgcactctagctggaccaacagtgtccatatgtaaaagctgtcccggtgcatccgtcatcacagaaacaataggagcatgtgaagtagaaaccatcttagcatgacgacacggggtacaaaccaaatcacgatctttcttaagtttaagcaaaccacgaataagatccaaaccacttagcctagtgagatgatcaaaaccaacatgtccaagtctacgatgccaaaacatcacatctttatcaaacttagcaaccaaacatgttatcacaggtgaaacaggattttcaaaatctgctttaaacactcttccatatcgagaaatattcagcacagaatcaccatgagaatcaaaaactttactttcagttttcttaaagtgaacctcaaactctttatcaacaatttgcgaaaccgaaagcaaattggactttaaatcctcaaccaaagctacattcttcaattcaaaattttcatttacctttaccaaacctgtagtgagaacggcacttgtagaagcatcaccaaagataattgattcagtattagatgccttctttagggaggagaaccaatttttatcaccggtcatgtgccgcgaacaaccggaatccacgatccacacgttctccttccttgccaccaaagcctacacacaaacagaagtcgaagcttcagtactggggttagataataataaaaatttagtaatccagtactgagacacacgaccagaagaagtcgaaagcttcagtactgggttagataataataaaaatttagtaatccagtactgagacacacgaccagaagatccaataggcatatatccacgtgcaaaatcaattttagaattttcagaaaaattcctccgaggccggtctgaccgagggtgtgcagccggtctgaccgggtgtcacgaccggaattaacccaacgggcgttccttacgtgcgtgtattattccttgtcccaggaggcaaggtacaccaaaagttgatacatttcagagtttaacaagcggaagcgtaaatagttaatttattacatgggcggcgaaggcccagcacacatgaagacaaacgaaaaacagcggaagactagggcgacgaccacatgcgcttgatggcaggcacgagctagacaccaaagccttcatcatccaggaacacctcttctgggtttgggaaaaattgagcaagactgagtacaaccaccgtactcaacaagacacacccacgagtgcagaataaatgcaaaggagtacaagggagttataatataggggattagggtttgcagtaaacagcattaaaagtcactttgttgctcaaagctactttgtaaacacgatcctagagctatacaatattattaatcaaggccatggacccacacgaacctgccttaacccaaggcctacgatgattcagaccgaactggcaacccgaccctgggtcccagctcgtcccaagccaacccacgccaaccattccacattttagttgttaagcaggctttaagaatttaaaacactaacttgggtacattgctaggcttgcccataaccgagggcacggctattcgaataggttatactctgatcagaggtgtacatctttacccacaagacacgtcttcctcacgtgtaaccacgtgccacataccaccacggcatatggacggaagacatgacatagtttccaacccatcctagccatagacaagggtaccgacccaaccccacctacggccggaacctccaggacaggtaggcaggattgagccgctagcagcaggacaccagccctatactatgacatcttgactaccgggacgcaactcgtgtagacttcatttgtcctagagatgtccatcggccctcgacttcgtccgtctccatccgtgtacctttgtttataaccagaccgagccacaaactaagcctaacccactagacatgtggaagtacggtagtgctttgcaatagaggcccgaagaccggtccttatgtggccgaggtgctactatcaaaaccatgcaccccgagcccagcctaaaaccattttgagggttttgaatagagtgggaggtgtgtgtgtccaattccacaataatccaaccattccatagtgtccaagtgatatgaatattcccaaagtctagagttataaaaccacctaatgtcgcctaattaaacagcgaagcatctacctaaattcatactagtggaaccatgaatagagtagccactagttggggttttgtttattctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgttcaaggatgatgtgacttaccttgctcgctttcccaaacgtcggcttcaacctccacgaagagcggatcttccgaagctgcagcgtctacacgaccaacaaaaaggaaaaaggcttttactctaataaactccatataacaagcaggaacaaagcacaaaaatgggttcttgacttctaaagaaaaaattagagacttgaacggtccaattccgagttcaaatggccaagttatggccatttgaagtttatatgctctttaagtgaatatttgcgaatttcttcatttaaattttaatttaaaaaggatttattgcgttaaccaggggagatggcgcgcggaccgggtccatgggagtggggcccacgcggcagcctcacggtccacggtggaccggacacacccgggctcacaccgaccggcgccgtgggccccacgcgtcagctgcacccgagggcacgggcggctgacggccgggccccacccggcggccacacggcgcgcccggaggcggccacgtcagcgtggccggcgggaggtgtcacgaccggaaataacccaacgggcgttccttacgtgcgtgcattaatccttgtcccaggaggcaaggtacaccaaaagttgatacaccaaaagttttatctagccctgtgccatgacatctcgactaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaatagaggcccgaagaccggtccttatatggccgaggtgctactatcaaaaccacgcaccccgagcccagcctaaaaccattttggggattttgaatagaaggagcggtgtgaagccaattccacaataaccaaaccattccaaagtgtccaggtgatatgaatattcccaaagtctagagttgaaaaaccacctagtgttacctaattaaaatagcgaagcatctacctaaaatcatgctagtggtaccatgagaagagtgtccactagttggggttttgtttaatctagggtgaacaaggtaataataacaataacaataataataaggtcataacaaaggtaaataggcatggctagataaaacagtgataacgcgggaatttaaataaagcgataatgtaataatttaaagcaacataattttataaactggaattcaatatgctcaaagatgatgtgacttgccttgttcgctttcccaaacgtcggcttcaaaatccacgaagaagccatctcccaagcggccaatcaatggtcaaatcatggccagta

SEQ ID NO: 78145 - DNA, 535 bp, Oryza sativa
tctcatccgtgtcgtttgagaagcactcacttagttgtttcagaaaagagttcaaataaaattaattgcaaaaacaccagcctttccttgaagcctgcattaaacacttatttcccatggcttgctgagtactcccgtactcacccttgctctatataaataatttcccccccagttgctgaagaagatgaagcggatcctactgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcatcccaacatgactgtacatctactctataataaagagacctctgttgctgtgatattctgtctccctgtgataccagcactgttccctgcgactggtatcgattaacaggttaatttggagcgtcacgggctagttccggtcgggactagttcggggcgtgacaccaagccgtcgccgatctcgt

SEQ ID NO: 78146 - DNA, 2826 bp, Oryza sativa
  unsure (1)..(2826): unsure at all n locations
cccctgatgacactcgcttgtgccatggatgaaaaaaggactttttagggtttttctttttgtaaaacctttttaactttgtttatttcttaataattattatttgtgctctgaaaattccactaaaatttatttacgcattttaggcttttaggaaatatacaaaaatcctccaagccttattcgacttttaactttgcacattttaattgttggaggctttcacacggattttaattattctaggcataatttcgaggatgtattttagagtcgttttgggacgcgacaggaggcggcgttcccgcgcccctatggtcgccggcgacggccataggcacggtggagcggcggccaagagaggggaatggaagggggaaaagaggcggcggtccacggctcaccccgggtcgacggcaacggcaaaggaggcggccggagtggagggagacggtggcgcggctcgggtggacgggaacggcggcgttccggcggtcggcgaggtcggcgagatggtggacggggtcggcggcggtgcggcaaagccggaggagacgacgccgaggcgggagatggtcctggcgagtggagagggccggctggaggtcgacggcgacggcggagagagaggatgacggcgcgagctcgattccggcggggagaaagggcggcgagtggcggaaacgggcgagggaggtgcggagagggtttaaatagggttgcgagtgagagggggcggccggcggggaaggaaaccggcgcgcgggatccggccgccattaatggcgctggcgagattaggggaggggtttccatccgaattagagagagagcgaggggaaaatggagggaaagggagaggggatcacggggaatatttcctcccacttaattgcacacgggaacgatcgggggcggtgggattcgcagcggtgncggtgctaggcgcgggcggggcggcaggagcggcgggaggaaggggatgacgggtgggccccacccatcagcgagggtggctggcgggcccgcccgtcagcggcgcgtgcgcggggagaggccgagtgggccgcggggagaggagagagagggggagggagatgggccgaattcggcccagagagagggaaggaggtttttagggtttttctttttataaaactttttcaactttgtttatttcttaataattattatttgtgctctgaaaattccactaaaatttatttacacattttaggcttttaggaaatatacaaaaatccttcaagccttatttgacttttaacttcgcacattttaatttttggaggctttcacaaggattttaattattctagacataatttaaagggtatattttaaggtcgttttgggacgtgacaccgggggccggtctgaccgaggcttcaccgccggtctgaccggtggtcgatctgaccgaggctgttcagccggtccgaccggtcgccgatctgaccgcgggacccactgcggtctgaccggtttcctcgagggaaaaccagatttttgccactttgattttgcaaaagcaatctctctctcctttttctgtttatgagctaatctgaaacaaaaatcaacaatatgtccatctttaccacaaaaagaacaagtatatttttcacgttgtttagacacattgttagcattagaagatttagcaacacaagcagcaacaggaggttttgcatgcacaacattggattttgaagaagatgcattcatggtagacatgataccagcagatttaaacacaattttattagtatcatgtttaatcaaaatctcaccacttctagcaccaacacctaacacaacaggaggatgtctagaattatgagcataaggatcaaaacctaaaccaaggttatgtgtgctaaccttagattgatccaaaatcatgttgaggttctttttaccatcacaaaatctttgcaaagaatttttccaaataagaaacctatttttccaaattagcacaattttcacaatctaccatgacacctttgcttctacgacatttggggcaagaaaaccacttcattgtttttcacaacatcttctatgtactcaacacgacctaaagcatcttttagtttcatcttattcaaattacatgctgagcaatccaaaacatcatgaggttgtttcaactttttagcagaaatcatgttaaacatcaaactagcatgaaaagcaatttgatatttttgcaacaactttttagttaaaatcaactcatccaatgtgcgtgtacgcaaggcaaaactcaagcaagagaagatctatttttcaaatcatgtgcagcattaatatctctaatttttgaaatctcattcattaaaacctcacaatttgagcaatcatcatcattacgaataagagattttaatctagcaacttcagatttaacagattcaatgataaattcctgttttctatatatcttctcacacttcttatttttttcactcaaaatattaatagcttcctcaaacgcacttacctcattatcttcaaactctatgtcagattcaccacgcgccatgaagcaaacatcggagatgttcttcctcttatcatcatctccactttcaccatctacatcacttagtggctcgaaagcagcacaaacttgttgaaaagccttctgagattcttcatcttcttcccttgngatgaactcttcgaccttgttgtgtagggcttgggtgtgcttgtcttctcaccatctcttgcttctctttttgctcttcccaagcttangacaatgcgaacgaagatgatcaattgaccacatttcaa

SEQ ID NO: 78147 - DNA, 4664 bp, Oryza sativa
aacctccccgtcccgtggcggctggagagaggagaggggagagagggagagatgaggaagaagggtagggtgggaacgacatgtggggcccatgtgggccccaccatttttaattattttttatgtaactgatatgtgggtcccaccagttttattatttttctggatgaattgccatgtaagcgccatgtcactgccatgtcatacgaagaccgagtcaaaatagccacgtaggcgccacatcagcgaaaaccgctatctaaaccaccgagggaccttatctgcaccggttttgatagttgaaggattcgttgtatctggttttagggttcaaggacgaaaattggattcgttgacaagtttagagacctcagatgaacttattccttttaattttggaaaaatacatcgaaagtctcttgtattgtcatcggattacaaaatcatcctccaaccataaaactagatatatgtcatcctttaacttacaaaaccgggtcactctaagttcttaggaagttttgaccccggttttatctgacatgacaaatgagtcggcgtgggccccacacgtcagctgctatttcccctccctctccacctctcttcctctgtcatcccatcctccctttcttggcaaccaaagtcaggggagaggagctgggcgcggacgatggctggtaggggaggagttgagttgaccctctctctttccatcttctatgccttcctcctctctcacttttctcgtcggtgtggaggaggccggcgggacgatacgggagaggaggaggtctggcggcctctcgtcgtggctgtcgcagcgattgttgctaaggaggagtaggcggttgctgccaaggcaaggctgtgtcgggcaggacacggtagcatggacaggggcggcggagaccatccgacaggcggtcaatggggagaagggcagccgactgcaatggtggacggatggatttgtggtgggaggagcgggcaagctcaccggcctccctgctcaccggcctccccgctcccctcgctggacccgtctcctccctctccatcactcgtcgttggcctccctgcgcccctcattggccccacctcccccctcgacggcagctttcctcgattgctgctaaggaggagtaggcggttgctgccaaggcaaggctggagggaggaggctgtgtcaggcaggacacgagcagcatggacaagggcggcgaaggccatccgacaggcagccggtggggagaagggcagccgactgcaatggtggatggatggatttgtggtgggaggagcgggcgagctcaccggcctcttcgccctcctcattggacccgtctcctccctctccgttgctcgtcactggccttcccgcccccctcgttgcccccctggacgacggctttcctttgtgcctgcggcctccccttctcctgtgccacccgtcgttgtgttgccggccgccgatgcccttctcctctcccacctcgacctgccgacctccttcccacttgccggcgagcctgcctagagaagagtgagagagagagagagagaggaggatgaaggggagaagaagggaaagagagggtgatgacatggtcaccctgacatgtggaatccacgctgactcagttgccacatgagacaaaatcaggatcaaaactgtctaaggacctgagtgatctgattttattagttgagggatgacatatatttggttttacggttggggatgattttgtaatctgatgacaagatgagagacctcatatgtactttttcctttatttttattttttatttttggatatgagggccatcaagtatatgtatgcacgtaggagtacagtatgtcagtataccgtagtggtacaggacttgctctgtaattagtactgtatcggctgtataattttggcaaatgtaattttaaaaaacgggcttccgcacgttgcttcaactcccacggaggcacccaacgtacataaaaatgtagataaatgttaatattctacaatcctgtattatacagaaaaaaatgtataacgttgtacaatcctgtaaataccaaaaaaaaatcaatgtttttttcacccttgcactccacttgatttttttttcacccttgctttctcaccatgcataaaattcgtaccaaacgtacatatttacatacttctttaaaaaaaataaaggtaagtaatagaatcgagaacctaaacattccggtgtcaatctcaaattctgaactctgtaaagcaacggtgaatagaaatctgactaggccgcgtagtcaaccaaaaaaaaaatcatattcagacataggccctgtttagatttccacctcaaaatttttcacctgtcacatcaaaacctttgaacacatatatgaagtattaaatataggctaaaaaacaactaattgcccagattgcgactaatttgcgagacgaatcttttaagtctaattgctccatgatttaacaatgtggtgctactataaacatttgctaatgatggattaattagacttaataaattcatctcgcggtttactgacggattctgtaattagtttttttttattagtgcccgaacaccccatgtgacaccctatataatatccgatatgacatgccaaaactttacatctctggatctaagcacccccatagtaactgaaccgagactttgcgcgcacctgaaaatatttaatcagtaataatattaagtgaaaacagtctttctagtggttcttttcaatattttccatcaaataccagtagctactagtaatttacccgtgctaacgctaccgcggtaatacatgtagaaacacaatgcatgtcatggaaacatttctactactccactattcatttaactgaactggtgagttgggtcaggtagactacttgagtatgcataatgtggtttctgaacatttgtaggaaaaaaagaagaagcttggagtacaactggggccaccgcttcctcaaaaggacttctgaacaattttgaaaatgtgcacttcaagtcttgaaaatacatactattatacaaaccaatagccatataatgacaaggaagaacttgtcggtgaatccgctcaatacgaccaccttctaacttcccaatgtttactggactaagcacaaaatcgcatgattttagccttttgagcagcagaggcgcgcggtgcgacagatgcctctttcctcctttgcctatagttagggctcttctgtatgtaccacctaaagggcaacaaaacaactccacacaaatattagcacatgatttgcattaaatacatgaaaaaaaatcaatgaagcatcacccaagctaaaaatggaatctgacacattgttaaattgtcagaatatctatagtaatttgggaattaaacacacataatcatattgacatgccatcaccaaagcatatggtttacgagcaatcagcttatgatcacaaacatgtttcttttctgttcctttagtaaatacactttatttaaaacccttcctttgtaccctcagaggagcagctgcccattcttttgaccacaaactgaaatatttgttgagtcatctcataaatccaggcagcaaatgtgattccttctagcaggtcctttttatgctttttatgaaccagacaaaatatacgattgtgtgcaccatcttaaaggataatgatagaatacatgggcatgtgcagcaggagcaccaggggaactcaaaaatattagcaatgcagtgttcatttgactataacatcagcagcaccagtgataaactcacacatgtaaaacctataaaatttggtcaccaattcagaattgcatggtaaacaggaatcccattaaaaaaaatctgaaaactcgacaatccaaataggaacaccattatgaaaaatctaaaaacttcagatcccatatgtaggagttaagggaatagtgaagaaactggttgtaccttcaattcagggaatgagatacaggaagggacagtagcagctgtttgcagtgatacgggaatggataatcaccagcgattccttaaggaagaaacaacggcgaggcaacgcccttgatagaagttgttctgcatatggatatataatgacatcatatttttctcaacggagagtcaagaaaaaaagcatatttgttatattttaaatgaacaacaattgacaggaaatttttcagtaactaagtttgcaaatttgttttgatcccatcactacctgcgtgacaactcgtacttatttttttcctactctgctcaaccttagaagcaaatcgcccaagcttatgttacactacattttgatttttcaaaccagtggtgacaaagaatgtctttttgcttctttaacaattaaatgatcaacacacataagcagtttgttttaacttccatttttttcacaaatttgttgctctgcaatcaatatagtaattctgggcagggttcaaatttgatactatggagatggacacttcaagcactgaattagattatcaacattagcatcaaatggcacaaaaatattgggccaacgaaatgattgcaaagtgaaaaaagggataacagaactgaaatattaggaaacatattagggatggggagacagagaagggg

SEQ ID NO: 78148 - DNA, 1000 bp, Oryza sativa
  unsure (1)..(1000): unsure at all n locations
ttaatgtcatcggtggtgagccttcnccgttaattaatggcganagatgatcttattttcctatgggttatatttgattaggcatgaaccttatatattggtttggttcagctaaatgctatatgtatgtttgcttagccatgcttagaaacattagctaattaaaggggattaaatataaattatattatattattcttattaaataagggtatatttaatggtagctcacgatgataattaaaacctggttaaggtgggttgtgagcatatggttttgatggttgtgctcatggtaattaaggaccggttcgcgagctactgttgtgaaacatttaccgtgccaaccacaagccagcatgggcaacggctttaccttttgtatagcatggttcattatagtgtgccagactgtgaagcggcgagaagtccgtgggggtcgctggggagtccatttgcctctggttttgagggggagattatgatccaggaacggtgcactgttttgagttgtgttgtgcaaagagtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacactactcatccatgttaataatgtgataattaatttgactcctggtttggaatgaataattcatggtttggaggtttgatctgtacgaccggggttggttgttcaggtttggttgggcctaagcagcatgggtgtgctgtttagtgttgattaaaattgatgattaactactctactgttttacttatcttaaatctttgctaaatgcggtagggcgagtgctgcaactcgtccgggtagcgctggtgaagagtgccgatatccatcacacgacgggcaatcaattcaaaggngctat

SEQ ID NO: 78149 - DNA, 11455 bp, Oryza sativa
  unsure (1)..(11455): unsure at all n locations
agccgtctgggtatgtcgttcgcccgctttaaatgttgcttttccacaacttatgctaattttcttcattttagcccccccttttttttagatacccgcagctcattgttcgaccgagcgaaccgtgagggctcgccttgacagctttaaaagtcgtcttcgggctaaggatgaagaactgggccgcaaggggctagaaatggaaaacctagccaacacccttaaggagacgaagactgagaataagcagctccaagttgagctggagaaggggagcgagcgaaggccgagatcgagcgcctcaaggctgagcttaaaaaagaacgagattagtccaccgccttgactgattactataaccttaccgagccgaagatggaggctcttcgtcaggaggtcagcaaggtagaagcagccgctaagagagacgcacaacggttcgcgcgggagatggtgaagaccactaagtccgcaaagaccgtgtgccgcacgctttgccttgcccttaccgacatgtgggcgaaggtgcgaggagtccccgacgaagatgcttctgcctttgacttctcggagtggactcaataggccagtggtgtggtctctgattgcaccactgcatacggcgattgctacgcgcgtgtgttagcggcctttaccatgggcctgctacaacaaaatgggtgcgagcatatcgccgagttccccaagttggtgaagggggattgggaagtcagttgtcaggatctttcggccgcacttcgtgcttggcgcaaacaattctggcaaatggacggctgatctactgccaaggcgcgcctgctcgagcacttggcaaaggcagaggcggcggatcaaggcgaggaggcagcgggcgaaggaggtggggcagatgcgggcgctggggtagacatcggccataatcacccagaggtgtgaggccctccgcccgctctttagatttttagattttttgcgttggccacggaaggcgaacgatgtaaatttggccgatgtttcccccttttgtactgtagccgaaaatggccttttttatatggaatagatgaaccaagtttcgccaattatcccgtttttagggctttgatatgtatggttgcatcattttgtacacgaataggggctacactttttgcccgctttatgagcttcgccctctcttaaccttgtgctttcccatttgcccctttttatgttgttttagcagggtcttcactagaaattgtgtgttcggcttcctttcagagattggcgtaaaaagaatgagaaattcatcacagttgaaggcttgctgaaatttaagtattcatgttgcgagatgataataaatggcaatagttacaaggttttgaaagtttccagctggatgcgggcacaccccgggcgaaccatggacgactacgaccgtgtccatgtggagcatcgggaggacatggctcgcttttggtgaaatcatcggaggactgatcgtcaggaagcgatcgcccaacgccgttacggtctagtttatgtctcgcccccttctcctcttagggtagtgtataatattagtagtgatgacgaaccaagttcgccagatcataccttagggcgtggagggtgttttgggggtggagatgtaatttttttgtaagttaggctgtaaagcccgttaccttctttcgcctgtaccatgttgtatggcctatattttttttcgaagttaatgaagatgtgttttatttccttttcgctattgtacgcatagtcacctttcatgattttgttaggtcgaaatatgtcggcccccttgcgtatattagcgaaatatgtctgctgacttttcagcttcctacttccgttttcgatctgtagtattccgcgctaaagaaatgctcgtgtttttcacatagatcgaatatgactgtgttcggttatttatttcccgaaacaagatgttgcggtttcaatgttcagcgagcgatgcttcggtcgattcatttcgcccccctggcgctttcgcttatcaggtgtttgccttagggtttttccacgaattatcatttacacaagtaaaaaggtgaaagacacatggattatatactggttcgggcctccaggatggataatagccctacatccagtttttttcctttttttattttcctctttttttgtatttttgtgccgaagggcctacataatagtatgtacatttttacaagttggcgaatggggtgccaccccttctagacatagaaacgcttaagagaagcagcgttccaggagtggtcgaactcttcgccttccagcgtcgccaagcgaaaagagcccgtcctggacctgttcttgatgaggtatggcccttcccacttcgattcaagctttccaaccgccattgggttcgccttcttccttagccaggcagcagctctatcggttgaacctttttgttgtaaggtgccaaagtgctcttggcatatttgcgcatgtgttctagtgcttcgactctcaccctttcgaggagttcgagcaacacctcgcgcccatcttctccttcagaaaacattacccttggtgagttagcctctaactctgttggggtcattgcttcgtcaccataaaggagcatgaacaggctaaacttggttggccttgtgggggtcgtccgaagggcccaaagaacagataacatttcgtccggccatttgcccttcaccgccccttcaagcctcttcttgagcgcctcaaggatcttgccatttgctcattcgactgccccgttcgattgtgggtgtgcgacagaagcgaacttgatttgcaggtctgggccttcgcacatctctctaaacttgtcagaatcaaactgcttgccattgtcagtgatgaattctttcggcactccgaaatggcaaacgatgttcttccacacaaatttttatacagctgccgaagtgatcgcaccaagcgattcggcttcgatccaacgagagaagtattcaattgctacaattgcaaacttgtacccatttcgtgccaccgggaaagggccaatgatgtccaacccccatctggcgtaaggccagactactgcgataggctacagctcgtactggggtgctgtctggcttcggccatgccgctggcagcttttgcatttcttggcttgctccacactgtcacgtcccaaaacgaccctaaaatatatcctctaaatggtgcctagaataattaaaatccgtgtgaaagcctccaacaattaaaatgtgcaaagttaaaagtcaaataaggcttagaggatttttgtatatttcctaaaagcctaaaatgcgtaaataaattttagtggaattttcagagcacaaataataattattaagaaataaacaaagttaaaatgattttataaaaagaaaaactctgaaaagtcccctttccctccctctccctcttgggccggctcggcccatccccttccccctccctctcctctccccgcggcccatccggcctctccccgcgcgcgcgccactgacgggcgggcccgcccgccaccctcgctgacgggtggggcccacccgtcatccccttcctcccgccgctcccgccgcctcgcccgcgccctagcgccgccgccgcgaatcccgccgcccccgtcctccccgcgtgcaatcaataggggggaattattccccgtgattccctctccctttccccccattttcccctctctctctcacgttcaaacgcgcggatttgcccccgcaaatctcgccagcgccattgatggagcccgagagcgccgcgccggtttccttcccctccggccgccctctcccccttccaactctatttaaaccctccccgcacctcctccgtccgtttccacctctcgccgcccttcgtcctcgacggaatcgagctcgcgccgttgctctctctctccaccgccgccgtcgagctccggtccgccgccgccgtcaccccggaccacctcccacctcggcgccgcctccttcggctttgccgcatcctcaccgacctcgtccacccctccgtttcgctcaccgaccgccggaacgccgtcgaccccgtcgacccgagcagcgctgccgccttcctccgcaccggccgcctttttcgttgtcgccgtcaacctagggtgagccgtggactgccgcttcttttcccccttcccttcccctctctcggccgccgctccgccgcgccggtggtcaccggcggcgaccatcggggcgcgggcgcgccgcctcccgccggctgcacaggcttggccgccctcgggcgcgccgagtggctgccgcgtggggcccggccgtcagccgcgtgggccccactcccgtggacccggtccgcgtgccccctcccctcggctgacgcaataaaccctttttaaattaaaatttaaatgaagaaattcgcaaatattcatttaaagagcatataaacttcaaatgactataacttggccatttgaactcggaattggaccgttcaagtctctaatttttccttaagaagtcaagaacccatttttgtgctttgtttctgcttgttatatggagtttattagagtaaagtccttttcttttctgttggtcgtgtagacgctgcagcttcgaaagatccgctcttcgtggaggttgaagccgacgtttgggaaagcgagcaaggcaagtcacatcgtccttgaacatattgaatcccagtttataaaattattttgatttaaattattgcattaccgctttatttaaattcccgcgttatcactgttttatttagccatgcctatttacctttattatgaccttattattattgttattgttattattaccttgttcaccctagattaaacaaaaccccaactagtggacactctactcatggtaccactagtatgattttaggtagatgcttcactggttaattaggcaacattaggtggttttacaactctagaccttgggaatactcttatcacctggacactatggaattgttggattattgtggaattggattcacacctccccctctattcaaaatccccaaaatggttttacgctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacagatggagatggacgaagtcggggatcgatggacatctctaggacaaatgaaggctacatgagctgtggcccggtagtcgagatgtcatggcacagggccggtgtcctgctgctcggggctcagtcctgcctacctgtcccaggggttccagccgtaggtggggttgggtcggtattcttgtctatggctaggatgggttggaaactatgtcacgtcttccgtccgtataccgtggtggtctgcggcacgtggttacacgtgaggaagatgtgtcttgtgggtaaagatgtacacctctgatcagagtacaatctattcgaattgccgcgccctcggttatgggcaagccgagcaatgtacccaagttagtgttttaattcttaaaacctgcttaacaactaaaatgtggaataattggcctgggttggcttgggacgagctgggacccagggtcgggttgccagttcggtctgaatcatcgtaggccttgggttaaggcaggttcgtgtgggtccacggccttgattaataatattgtatagctctagaatcgtgtttacaaaatagcttcgagcaactaagtgtcttttaatgctgtttactgcaaaccctaaccctttatattataacccccttgtactccctttcatttattctgcacttatgggtgtgtattgttgagtacggtggttgtactcagtcttgctcaatttttcccaaacccagaagaggagtccctggaagatgaaggctttggtgtctagctcgtgcctaccgtcaagcgcctgtggtcgtcgccctagtcttctgctgtttcccgtttgtctttgtgtgtgctgggccttcgccgcccatgtaataaattaactatttacgcttccgcttgttgaactctgaactgtatcaacttttggtgtaccttgcctcctgggacaaggaataatgcactcacgtaaggaacacccgttgggttattttcggtcgtgacacacacaaacttttagcacagtgggccaatatacactctggcaaaaaactttggaggcaaccgttcttgcggcttgatgcgcactgcacagcccctagtgtatttctttcgctatttcctcgcctttagcaaaggatatgcagcgaagcaagcgttggagcaccccagagcgatacaactgccctgagtttgtatcttgtggctctgagctgtaggcgcttcgcttctacttcatcctctaggagccaaccattcttgaggtacttcacgaacggtgttcgccagtcttctgggtcttcgcccagttctgcctggtcaattgccatgatgtccaggctctctgtgggcacacttggtgcgtacaagacttcaaaaaatatgcctggcgaatgtggtcctccgcaagcagcggatttcgccagggtgtctggctcctcgttctggcctctaggtaagtgttcgaccgttatgcggcgaaacacttttccatagatcgaacagcctccagatacctcttcatgccttcttcctttgcctcaaaagatgtaacgccccgattttcgttcgggattaaaacccattaaataatgcattttctagatttttaataaaagttaaagcaatttaataaagtgaaataatgggagaatttgaaattttccttaaaaatcatttggccggaaatattttgtaatattctctgtgccctaatgaactctctgaaatttcccgcgaattttcggagctcaagaaataattttaaagtcacaaagatcatttaataaaattaaataaaaagaaaagcaaataaaacctccccttcctccttgggccattttcggccccaggtcccttcctcctcccacggcccacgccccctctcttcctctctcgcctcggcccgtttccccttcccctcgcgcaaagtctaaataaccccctgggttctcctccctctctccctccccgacaggtgggcccagcgaccccacttcttctgtaagtattttacgcttttatttatgtttggaactatattttacttgtcgttttgtgtaccctggctggtcctggacaggaatttaatacacaaaatagtctagaaatttgggctaaatttctaggcgtgacaaaagacttgtcaacgtggcttgccaccagtttggagtctgttcggataagcaagcgccgaacccccaatgctttcgcttttcttaggcccatcagtacagcgtcatactctgtcgtgttgttgatcgtgtcgaactgcagccttgtggcatatcgaattggcacgccacctggcgaagtgagtactgccgcggcgcccgcccccttgtgcgaccatgagccgtcagagtacatcacacaaggttgttcgacaggctcaggttcaaaatgacacttaaattatatcctggtttggtcttgtaataatcttttagatttctaatattttcttccccatggattataaggatggatcgtattgtgggaatgatattgttattagtttaacttataattgtctgtcgtggatgtccgtatttacaggggagactctgccgtaatttctaataattttggaagttagtggtttgagtggtttttggtgtggcactcttggtacgtggttatctggtgtgttacaattggtatgtgagtgggcagtaggtccatgggaagtaaatatgacaacttaaaatattgatcatgttttccttaggatgggaaaaatagaagtaaaatttgagttaaatttaaaccaataaaatttgacacactggtgcacagtaggatgggtttgggtcattctttgcatcacacttctgatttattttatcgattactgatctctatctcattgtatttgtgatttctggagttatgttgttactatatatatatatatatatatatatatatatatatatatatatgctcttctacgaataagacctgattgcataataagtaaagctaggaggtataaaaaaattattcagttttgattcgttggtgtggtgtatagtgtggagattaacgtttgcgcataactatattcggaaagctattagggagaacaacatggggtgttacagttatacttgaggtgtgtgagtgtacatgataaagttttagtttccctagaccttagttaaactagtttgatcatggctctaacttgtgttaatctcttttatagaagtaattaatgttgtatcctataagactcaatggtcctttaagaataggtaacttttcttccgtataggcaatgcaaagtggttagaggaggggactttttctttattttttttcccaatgccaagtgaggttgtccgagtgtgagtgttaggtcgtgatacatctatcactgtaccgagttaatagtttgggtatgggatggattggcccccatgtcatctactcattctattcttttcttacagtggtgagatgtgtctacatgttatgcatgatgcaccaaggtagtgatgtcttcacccgaaaagcaaagaaaaaaagtaagaaaaaaaaaggatgttccatttttcagacttgagattcaaaggcgatatggcttattagtttctttttgtgagttctattatgtgactatggttgaggtaatgaaaaaaaaaaactttctcattcgtggtacacgttctgaaataattccaaaaggaaaacatttgactctgcattcatcacttggtgacaaatattctcctgatttctatttttttttactttcagaaaggaattaacactaaatatttattttagtttcacttttgtggctttcattcgcttggttgttcaaacataagtgttgtgcgattgctttgtactgataaattataaattattgatatgcacaatactatttgaaaatactaatttaaatcttgttatggagaacttgtattaaatttgaatttctttaccaagtgatttattttcattacatggctcagaactgtgtgcagtattgatattcttggattgatgtccacacttatttgattattaatctttatttgaatttttttatagaatggctttcggattcgctatttgagttgacaaacaaactccaaaactttgaattttggtttatgagtttatggtaaaaaaatatttcctttttgtttttttttaaaaaaatcaagttgaagaggatgcttccttctacgcattttcttcaaaaagtggttttatactcggtccatgttctaaatatttccattgtctttacgtgtgattcttgaatttattacagattgtcattatcctgatctcagatttcttaagaaaaccgtgtttgagactaaatattcatttttttatgtgtttgttttgttgcttgaccttccatatttgattatttctttccaattacatgcacccaacaaattgttttttattgagtggatttaattcatttactttggaatgtttgagtttcttagaaaattcaagatctatcgatgttcagagcagtttttgaggataatgctttcgttctagttactcagaatgttcattataagtggaacaagtgtggcctatggtccttgagattgacttcgtagatattgtttattacctctaaataatttgcaatcaaagatagacttttagttgttgaagatgagcaacatactaataagatgtgatgggtgtgagtgtttatttctttaaattttaaattaaaagcttgtgttgtattctcgattcccttgagcgtaaaggttgttttcacaatttgtttcattgctttgtagtaagattcttcatgatgtgttccaatgatttttgtatatgtcccaattgggtgttttagtatgtgcattgcacttctttggcaagccaatattcctgtctagtaggtccaagttggtttattagctgcttttgaattgttggctaccatactttcttatgctagttaattattatctaccatacctagacgcaagcagtgttgcgaatataggagatgtcctcgaaattgcttgagagtcctaactactttatatgtatgttttgtgtattcctttccatcttacggtttctcaagctctacagtgggcgaattcgagggcgaattcgattgaagggggaggaatgtaataccccgtatattaaaagatatttaggtttttttaagtttggattgacttgttaaaataaagatgttaacagaaataaacaaaagaaaaatatctttagaagtgggccaacatgtgaaggcccataaaccaagcctgctttcaagcgcgacttagaccatttaaatggcaaaataaaaatatgctttctacatgaaagttgtaggtattgttctgtagatttttaaaatgtatacattttcagtcatagccttttcatatttcaagatataaagatttgaagcagcagtcttgtttatagtccaagcggcgttccttgttattgagttttgatgggatggggcagtaggttcacctttttcattgttttatacgcatgttcgaatgtgtttgctgaggttttgtttgtgattaggtggtggaccattagatcatgcatgataccaatctttcgttggaggcaagtgcatgacgaactaattatgcgattcaaagattgtttgctctatctatctatttgcgttatatttctatgtggtatgtgactgcttatgttcagactgttgttaatgccatttatatttcaaatttatcttatgtcacgacattattcatgtttcattatttcggatgttttatttatattattcaaggaccatgcgtagtcatgggagtgtaatttggatccttattcatgttcctgtcagtaagcgctgatcacgcttacttggatttgccgacaaatgctaggatgtattcactattgtccgaaatggaaactactatttcaattcatgcctgcccaggatgggaacttctatattctttgacatggtgtttggaaatgtgtttcctatcaaagaaagaaagccttatgttcatgctttatcgtcaatgatgtgtatatgtgttttctagttccatattgtacttgctgagtatttttatacccactcttgtgcaagtagatgtgtatataagggtgctacttcccgcccatgcatgtcggtctcaatgcgtacctaaaaccaaataaaacacaagagtgatgagctncttgcagagnnggaatgtcactcaaatgccatg

SEQ ID NO: 78150 - DNA, 4103 bp, Oryza sativa
  unsure (1)..(4103): unsure at all n locations
cgataaaggttagttagataggaaggttcatggctagctacaaaagagaggagctcggagagagatgcgaggttgatttagaagaagtttcatacgccagagttccgtagaaggacggaggattagagctgatagaaaggtagattggggcagggagaagggaagtcaaacggggaagtagaagtgcgagggagattcaagggtatgacggggagaaagcctagggtgaaaaagaaaggcggagggggcgtgcatagatacagagtgtaagaaaggaaaatagtggctaagctgtgaggtaaataagcatagcagaaggtgggagcaccaagaatgcaacaagagccatatgaaactggagggcgctcgtgcaaagcataggcaataaggcatggacatggatttctttttttgaatgggaacacattttgaatcagcaagtcaaagaagatagtagttcccataccgagcaggcatgaattgaaatagtagtttccatcacggataatagtgaatacatcctagcatttgccgggaaagccgagtaagcgtgattagcgcttacccacaggaacatgaataaagatccaaattgcactcccatgactacgcatggttcttgaataattgaaaaccagaatcaaagaaccaaagtgaaacacatccatggcaagcagagaacttgaattatttaagcagaacaagaatccagaatattaaaacaagaataacattgtacacataagatcaacttgaaatctaaatggggtgaacaataatatgaacataagtagttacttatcacgttgaaatatatcagaaataaatagatagagtaaacaatccatgaatcacacaattagttcgtcatgcacttgcccccaacgaaggattggtatcatgcacgatctgatggaccaccacctaatcacaaacaaaaccttagaaaacacattcaaacatgcgtagaaaacaatgaaaaaggtgaacctactgccccatcccatcaaaactcaataacaaggaacgccgcttggactatgcacaagactgctgcttcaaacctttatatcttgaaatacctacaactttcatgtagaaagcataattttattttgccatttaaatggtctaatttgcgcttgaaagaaggctttagaatctgtctagaatttcagactgtccacactgaaacaacctaactggagttctactcgcccaatcagggtgtactttaccaatatgaaagctatgaaaaacctctacaactttgtctataggcggcctggctgattccactgtttaaccccttcaaaaacagttcaatctactactatccagattatgacacaaaaacaacagtcatattaaaaaaattatatctcctaaaccacttgagataaaatcgttccctttggtcagaagatatatccaaacattatctacaacttcctagttatacacttttgcagaaaataacatttagagccccgaaacatcaaaacagtgaaacactgcaaatctgcccacatgcagaactgcaacaaaccgaacagcaactacccaaactccttctctagccttccctaaccacgaattaatacactaaagccatgctataacaactgatacaacaaggggacaagcctcacctaggctttctttagagaacttgtgagaagacaataggggagactccagtctaaccactccttctactcctctcctcctcctcgttccgtttttctacttcgcttcttgatgcaagctatgaaggtggagatctagggagagcaatttgctgtagatgggagagatgcgaacacaataggaggggaggaaggaggcgccggccaagaagaggggtggcggcactatgagggaaggtgggatttggttcccctctctctaggttttagggaagaactaataggctgagtttatgggccttctcatgttggcccacttctaaagatattttgcacttatttatttctgttaacaactttattttaacaagtcaacccaaactaaaaaaacctaaatatcttttaatatacggggtattacactcatcaaaagtaacttcgcaagtctcaacaattttgttagtttaaaaaacatgtacacgatagccacatgaatgtgtggggtaaccaagaaacattccattggtagagtgtgccgcaaacttatccaaatttccagatttcaagacaaagcatttgcaactaaaaccacgcaaatgtgaaactttgggttgacgtccaactcgaagctcgtaagaagttttaccaggtttaaacctcaagaaaatccgatttgaaatatagcaagcagtgttaaccgcatcagcccaaaattttctagaagtatgatactcatccaacatcgttctagccatctcaaccaaagaccgattctttctttcaacaacattgttttattgcggaatatgagaagaagaaaattcatgttcaagacccttttcgttgaaaaatggttcaaatgaagcatttttaaattcaccaccattatcactttgaattcttttcaaagaactaggaaactcaagatccaatcaaagatacaaaccacgaaagtgttgaaaagcttcatccttagttgccatgaagaaaacccaagaatatctagaaaaatcattaacaataaccaacacataccactttcctccaacagattgcactctaactggaccaatagtgtccatgtgtaataattgtcccggtgcatctgtcatcacagaaccaataggagcatgtgaagaagcaatcatcttagcacgacgacacaatgtacaaaccagatcaagatctttcttaagtttagacaaaccacgaacaagatccaaaccacttaacctcgtgagatgatcaaatccaatatgtcgaagtttacgatgcgaaaacatcgcatccttattaaacttagaaaccaaacatgttatcataggtaaaacagaattttcaaaatcacctttaaacactcttccatagcgagagatattcatcataaaatcaccacaagaatcaaatactttacttacaattttcttaaagtgaacctcaaaattttcatcgacaatttgtgaaactaaaagcaaattatactttaagtcctcaaccaaagctacatttttcaattcaaacttgtcatttaccttgaccaaacctgtggcatgaacggcactagtagaagcatcaccaaagataatcgattcagtcttggatgcctattcgagggagggagaaccaattttattaccggtcatgtgccacgaacaacccggatccatgatctacatgttcttttttctcgccaccaaagcctacacacaagaagatgtcgaagccttagtattggggctagataataaaaatttaggaatccagtactgagatacacgaccattagatccaataggcatatatccctgtcacgccgggaatttctatccaaaattccaagcgcttacatgtgtgttaaaccctcgtccaggaatcaaccgaggcacataatgacaatttgataatagagtacaaataaataactatcgaataatcgcaaataataaattattacagaggtggatagttcctctcaaagaaaaacattctacgcagcggaaaaaaaaaactataacaaactacggaacagctatggcgactccactccacaggcatcttaaccgagaacaagcctaatccaccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaataaatatttaagagaatagtaaaacgggtgtataattaatcaatattaaataaacaccacacaacacacccatgttgcataggcccaaccacatttgaacaaccaaccccagttgaacaaattaaacctnctaaccaggaattattcatttcaaactaggaattaaaataattaccacattattaccattaatgagttgtgtgagactaatcacgaaa

SEQ ID NO: 78151 - DNA, 31098 bp, Oryza sativa
gtgaaaggggtgacacgacggcggtgcggcggcgcgaggcgcgaggcggcgataggacgcgcgcgcggtgatggaacggcgacagtgacggcgcggcagtggcggcaaggggcgcgaggcggcgatggaacgcgcgcggcgacgggacatcgacggcgacggcgacaacggtggcgcgcggctcggggcgggacgcgacgtgcggcgacgcgacgggcggcgacacgagatcgaggcggcgacagcgacggtgcgacggcgacggcggcacggggctcgaggcggcgacggcgacggcgcgcggcgatggtgacggcgcgcggcgagcggcgatggtgacggcgcgcggcggctcgggtcgcgaggcgacgcgatggcgcgcggtggtagcggcggagcgaggcgacggcgacggtgacggccggcggcggcgcggggcgcaatgacggctaggcgcggtgtggcagaggagggggatggctaggggacgcactcgagcacctagcgtgcaatgaatagtgacttttcctatttatcccgattttagactattttctatttaaatatagccctataaattctaatttttgcataaatgaagtttactcaatatttgtgttattgtaactaaaaattcaccctaaattaatattacccatattttatttttatataatttatttgaatttttaattagggtaattcttgctccatcgcacttaaatttaattattaccattatggtcgcgataatattttatttatttctatcctcacctaatctttattttaaattatatttattttgccaatttatttttagggtttattcgtaattaactattctttactcacaactaatgaatttcgaaatcaaatccaaataaaataggcgaatagaatcggcatgatgtagttaatttaaaaagttttcgaaggtccgcatttttagagttttgtttttattggtcgaattttcagggtgttacacttcagtcattcatcgatatcatcaatgacctccgagtacgtgggttgtcggggtatgaagtcgctgccgacttcattggtaggcggatccagccgctccaggctcgagcccacccagcctctgactactctgggtcggaggacgcgacccgggtttctcctcggggtatttttcttgcattctgggttcccttccttatgcatacattcctcctgacttatcaaaatctggttcttgatctataggtttgaacagcgaaaccgtggagcgccgtgttggccaggtgatgatgagcggccccacgatggcgagcaacgtccctgcccctctttgcgagaaaggggcagctgagggcgaagctgcaatcaacgtgagtgtactcgatgaccctttctctttttcttccaggatcgcatcgtgacttcatgtagtgcaggctctccctctaactgacgtcatcgggccgctcgtggaccaccaggcggcggcatcgctgaaggaggacgtcgccaaggaagcgtccgatgttgcccccgttgctgccacgaccagtggcggcaccgttccgaagaaggggaggaagttttcctccgtgctcggtaaccgtcggaaagcacccactccatcggtaagccgtctttggttattgattgcgtagttggaagatgttgtcctcacaccgtactcggtttacttaggcctcggatgcgtctcccccacctccgcgacggcagaggctggtgacacttggcgagaagtaagttgacgagtttgaggtcgtttgattcatcgaattcaggcggctcgtcttgatggccattacgggaatttttcatagggcggtgtgggcgaaggcggcacaagacgggtctggagggaactctagtgcgtctcctgcagtggccttgacagatgtcgtggtcgtgcccaggagccgtgaggcgacgcccagcggccctgccggcgaccttgtgcctgctcgaggcccacccgctgacgtcctcacctgggaggagctccaaatcgagatggggcgcatcctccaggctggcgctcgtggcataggtcgcgagattgcggcggcgagggcggcggcggcttcgtcggcgaacgaacgcgccgacaagttggcgcgttacctggcggaggttcgcgaggacctccagaagatgagggagctggtggccggcaacgagcggcaatggcaggggctcgagcaccgcatgtcgaagctcgagaacaacctgtcggacatccgtggctcgctgcgggttacctacaccggcctgcaccagctcaccggggagtgcagtgtcacgaccaccatcccggtgaatcccgatgagttctcgctgatgacttcgctcgcgaaactagcgatgatgatggaggcgatcccctccaagcatgcggccaggatcggggaggagacgtcaaacgggatctacaccgggacgtgtcacatcctcgcgtgcgtaaggttggcgcaccctgaactcgatctctagaggatcttggatcagggggcggctaacgacgcgcgtaaggatgtgatggaagaagtcggtaatctgggagagtctgttctcccactttttgaagagtaggacttcggttcgcctgtactccttaattaatcatggtttgtaaaacttttgtcggttccaactgcctttgtgcctttgtgtagtcgccgatcgaaagcgtgcatgctcggatgcgcttctcgtggtatcgtcgaagggcctgttggtagctagttactctgacggcaactcattctcgatgttcctcgagaaggttcacatcgtcgcctcgctactcctcctgatcctggcggagtacttctgtacttgtgtactctgatgttgcagttcagtgggaagcatggcttctgagccgtacacgaggaagaaaggtgtctccttgttggacgttgtcggtgtggtgcgcacggcccaaagtaccgaggggagttcttcgacccacttcttgtcatgtgacatgagcctgtcgtagacacgggtcttgattccttgtagtactatgctgtttgccctctcgacttgtccattgctttgagggtgagagaccaaagcgaagcagatcttgactcccagtccaatgtagtaatcctggaagttggcactgatgaactgggagccgttgttagttatgatgcggtgaggcaatccatatctgcaaaatatccctttaatgaatttgatggtgttgtcggccttaatttcccccatgggtgttgcttcgatccatttggtgaacttgtcgatcgccacgaacaggaacttgtagctgccttgtcctcgtgggaatgttccgagtatgtcgagcccccagcacgagaacggccaagtgagggggatggtttgcagtgcttgtgctggtagctttgtgtgtttgctataaaattgacaagcttcacaccgttgtaccatgtcgcaagcttctttgagggcagttggccagaaaaatccttgtcgaaaggcttttccgaccaatgtacgaccggtggcaagtgatccacagatcccttcgtgtatgtcgaggaggaggtgtttgccgtcgtcggacgagacgcatttgagaagtaccctgtttggcgccttcttgtatagatcattgctgatcatacaatagattttggcttgacgggttattttcttggcttctgcattgtcctcaggcagcgcgtcgctacttatgaatttaattagtgggatccgccagtcgtctgtggtctcgatgtcagcaacggtgcattctgcctctgttgccctcgagctgatgtcgggtgcgactgtgctattttcgtcgtttgcttctttcatcgatggttttgtcaggacgtccaggaaggtgtcgggttcgagtggctcccgtctagacgcacgccgtgccagattgtctggttcgatgttgtccttgcggtatacgtgtcagacctcgattccatcaaatcttttttccagcttcctgacttcagcgaggtacttggataactcggggctagagtacttgtagtctttgtgcacctggtttgcgactagttcggaatcccctttcatgatcagtcgcttgactccaagtgcagctgcagctcttatcccagcgagtagtccttcgtactcggctgtgttattggtcgccctgaagttgaggtgaattgcatgcttgaactgatctcccgaaggtgatgtcaagatgaaccctgcccctgctccttggctattgagtgcgccgtcaaacgccattgtccacatttcgttgtcggtttgactgtctaacctgttttaaggcatagtccaatcggctacgaaatcggcgagaacctgggacttgatggctgttcgtggcacaaaatggacatcaaactggcttagcttgactacccatttcgcaatgcggccggcaacatctttgtttctcacgacttcaccaagagggaaggaggaaacaactgtgaccctgtgggcttggaggtagtggcgtagcttttttgacgtcataattactgcatagagcagtttttgaatctgtgggtatcttgtcttcgcgtcatggagagctttgctgacgtagtagactggtctttgcaccttttctctctcgacaacgatgacagtactcatagaatatggcgtggcggcaatatagaggaataattcttcattaggttggggagcaacaagtacaggggggtttgacaggtagcgcttgagtgcgatgaacgcctctttggcttactgtgtccatacaaatttgtcttgttttttcagcagagcgaagaaggtttgtcctcgttctcccatcctagtgacgaacctgcttagtgccgccatgcatccggttagcttctgtacttccttgagccttgtgggcgacttcatgttctcgattgccttgatcttctcgggatttgcttctattcctctgccagagacgaggaacccgagcagcttgcccgatggtactccgaacgtgcacttctcaagattgagtatgaggcgatatcgtcagaggttgtatgtttcccgtagatcgttaatcaatgagtcgcctgtcttggtcttgacaacaatgtcatcgatgtaggcctcgacattattcccaagctgatcgttaagtgccccttggaccgtgcgttgcaaagtgtttcctgcggttatcagtccaaacggcatcttaacatagcagaatacactgaacggcgtgatgaatgctgtcttctcctcgtcctcttttgccatgctgatttggtggtagccggagtaagcgtcaaggaagcttaacaactcacaaccaactgttaagtccaccagttggtctattcgaggaagagggaagtgatccttgggggcacgctttgttgaggtcggtgaagtcgacgcacatcctccacttcccgttggccttccgcaccatgactgggttggctagccactctgggtggagtacctctctgatgaaaccagctttgagaagcttgtcgagctcttctcatatggcctgttttcgatctggtgcaaatcttcacaatttttgttttactggcttggcattgggtcgcaccatgagtttgtactcaatcacctccctaggtacccccggcatgtcggacggctgccaagcgaacacgtctgcattgtcgcggaggaaggtgatgagcgtgagttcctatttctcgcccagtgatgccccgatcttgacggtcttgtcggcgttggcgctggagagcggaacgatcttgattgcaccgtctggtttcggcgtcttgcttgctttgctcactttcttgggtggctcagctgtggcgggtgggctggcagtgtgctcgaccatgtcgaggctccgcttgtcgcattgcaccgccagctttgcattcccttgaatagtgattgttcctttcggcccgggcatcttgagcacttgatacgcgtagtgagatgcggccatgaacttcgcgagtgcatttctcccgatgatggcgttgtatgctgtatcaaattcagcgacatcaaaggtgatatgctccgtttagaagttatttgcttggccgaaagtcacaggcaacgtaattttgcccaatggcttggacgacgactgaggagtaatcccatggaagggttgattggtgggagtcaactcgcttcgtgggattcccatcacatccaaggtgcaggcgaagaagaggttgatggagctgccaccatctatgagaactcgcgcgactttgatgttccgaatagtgggctcgaccacgatcggatatcgtcctgggatgatagcagccttgggatggtcctcatctgagaactcgatcttctgttcggaccacttcatcttgggtgcggccccctgccatgtcgaacaaacttcacgctccattttcttgtattctcgctttgagtagtacgccgtggaacctccgaagatgtgcgagacatggagatcggaatctaggtatgccgagtccaagtcctgagtggttgcctcagtggccttctcgactactcgtactcgcttgcccttctccaatgccagttgcttttccagcgactttttgaagacgaggcaatcatctagagaatgtttgtccgacttgtgtatagggcaccatattctcttcgtgtcgctgccttgtgggtctgggtgcttgggagggcgcttgtattctgacgcgaggacttccgcttgagctttccttttcccacttttgctacttttcttcttgcttggttcaagtgcgtccttggctggtttcttctctccccccaacttcggcttgtcgttcttgcgtcaaagtgcgtcatccgcatgagcgcatcgatcgacgatctcgaaaaatcttcgagtagttgtgatccgtcttgttgccaactcctgggtagtatagcgatttctgacaccggttttgaaagcacgaatcacagaggcatcggtgatttcggggtttgtatttctgcactcattaaagccgattggtttatactggattatattgttatttcattacatcatcatcaaccgattgcctctatatcattatctacattggatatatagccgattgcttaaaccctatcgctatcggctggtatcggcaacggctattatcggctatcggctagaactactccatcggcttgtcagccgatcggctgttttgatctactatttgcatatcttgtcagttgcaggatcaaactgactcgcacgcccgcatctcattaagatttggacctgcacaggagctaagcaggccggtgtgttcgatttttttcgtcaacacaaattggcacgcccagtgggacacgagttttatatccacatgtctgaagaagaagtcaatgccaagatcatggtcacagtggagaatttaacggaggaacaacatcggcttagagtcagcatcggcttcgaagtcttgagattagccgatgagagttgtcaagccgttagttgtcggattcttgctatattcggttaaggaaattgatctactaaaggaagcttatccagaagagaccgagttcaaagagaatgcggcatggcaagttatctattaattaggaatagtttgttagtttccttttatctttaggaaagtgtgtttagtgtgctataaggactttatcttttccttttatctttaggaacgtttctttcttggccgacaaggacttgtatcaacccatgggtataaatatgtacacccggggtctatgtaatcatcgctacgatcaatacaattcggcgcatcgccaccctttttacttctacttttgtttttacgttcaggcggaacttggcacccgacgcggtgctgcattgtcttcgatcaacggcgcaaggataagtccaatgttccgtcggcccaggcaattatatcgtctacgtcggcgtcgttcaaggctgcatcaatacattcgacctcttggattgctctggtttggatgatatatttgcctaaccatttatcatatgtctttgttaatctagtcttagcatatcaatttagctctatcggctgcttctcgttttagggtttctgccggtatcggctaaatcgcgttgctatattagattagtttagacatctaccaccctgaaaatcagtcaacggcttgattgtctggatattatgattcttttcatacttagtgctgcatcagttaagtttgatctactaagtcatacttagaaccataatctctagcctgcttcttgattgccaataagggtttcatcggggtttcagccggtgagttatctgtatgttgcatcggctcataaggattgcatatacatataagttggatttagcccatgacaataaaggtttcactgtttaatctaatcttgtggatttcatgacattggacttccagccgatgtgtgctttaaccttcggatggatgcttatttatcatatcattatttgccgattggtttatactggattatattgttatttcattacatcatcatcagccgactgcctttttatcattatctacattggatatatagccgattgcttaaaccctatcactatcggctggtatcggcatgggctattgtcggctatcggctggaactactccatcggcttgttagccgattggctgttttgatctactatttgcatatcttgtcagttgcaggatcaaactgactggcacgcccgcatctcatcaagatttggacctgcataggagctaagcagatctcccaggccggtgtgttcgatttttttcgtgaacagtagggcgggaggtgcatcagccatgaacgcgcagaacccttcaatgccgtcggtaaataatttgccaacacgttgtcgtctgctccggcagcgtagagtaccgtggagtagacttgaaggaattcttctgggtcagtactcccatcgtacttctctgttgctcctggttagaatctctcaggccatcggacatctcgtagcgaacggttgaaagctctatacccggcgctgggggcggtgggttgtcggcgatcgtctgtccttcgcggatgtctatctgatgatgaggatgaagaggatgatgacgacgacgatgagtcactcggctctggcgtgcgattccgaggatgacgtctgggttctcgggaatcctgtcgtcgtccaccgttgttgtcccggcgtcaatctccgtcatcgtcatcgttatggcggcgtcctcgaccaatatcacccggcatccgctgttcgcgatcatcgcgttcgtggcggttgtggcggttatcacggtctcggttctcgctcgggtgtcctcctcgctcttcgttctctcgacgtcgtgaagagagacgatgtctggaacggttttcgttgtcttgcgcgcgtcatgcttctcgacagccatttaaatggtcacggagatcgctggtgccgcggggtggaggggtggcttgttgaggtgaggcccgctactcaggtggttcgccattggcaccgccagctggcggctattttgggtgtgctgtggcagcggcctcctcgaacgcgttgctgaggttggtcactgattcccgtagccgttctgtccaccgtgcgagatcatcatttagaacaggatcataaggggtttccctcagtattgcgttgatgcccccgatgtgctgagccggtgtaaccacttgattctctgcttccgcatcggcgcgcgcagacgcgctggtcccgccgatagcaaacacatcgcgtggtgtgcttgtcgacgatgaaccctggtcgtcgagcgagtgtaggactgatggctcgtggggatcaatgtcgatcaccccaacgaatcggtctgagatgaccgtcgctcctcgttccttgttcacatctctaggagagatttgtgagtgctggaccttaggaggctacgtcttcatggctttgagaagaatcttgcagcttgagaggtcgtgattctttgtcttgtggataggacaatagacatcatgagttggagaagtacgctaaattccactctctttgcaggcacggatgtcagcttgtgcgttgagaaaaacccagcaagcttgcaaggtgtgtttcctagttttgtgaataggacaccaggaccttgtcgcctcagaagttgtccttgtcagctcgtgattcttgtcggaaggacaagatttggccacactaggatcttcctcgggcttggatgtcgtcgacgttccgttctccgctactgcgggaggatccttcgacatggggtcgtccggggttatggccacgacattctcgcttccggtcattgatggaccagtcgagaccggcaccgtggtgtaaaccgggaagacgatttcaccgacttgagtccacaccagcattgttgtagtcggaactcctaggttgacgctggggtcgacgctgttgttgacgagacttgacgacaatagtagtagaaccttgagcaccaagtccccttacctggggcaccattgttaacgggggatccccgtagaccagatatagagggtattggggtacgctggtacgaggatctacgtaatatgacatcaagcaaatagaaaacagggattatactagttcaggccccttggtaggtaatagccctaatccagttgatatgggattatatgatggaaatcacagattacaaagggaacagtggaactcgatgataccgacgagaccgtagtcgagttggttcgactagatcacccggcgacttggctcctgtaggctccggcttcgtaggctatggtggttgtctcggcggtgagattcgatgccttaggtcctcccgggggtcccttttataccgcaggtcaggtggtttcaaagtaggacccagagacatcggaccatcggacctatacgatacagtgacgacccagtcctatccggataggaatctttccatctgtggactccgtgatgaatttccttagcgtatacagagaacgtcggtatacgcgcagatataccatatcgatgtatagcgtatatccaggggtagagggtataccttatttgtaacctgacagttgtgttatgggcttttcacctaattgcatattatttttttttaagaattatattctttctagtttttaatagatgccgttgttaacttttactaatatatttaaccattcacctcatttaataagttacgtgactatcatttatttattttgttgtaagttggtttatcgttaatggaacttttcacataacctacattttttatactttaaaaaaaatatttgaataaaataaatgatcaaatttatatctaaaaaagtaatagcgtcaatctatgaaaaaccggaggaactaattagtaaaatgtaaagcgtgaagatacatggctcgcactttttttccatttgacaataatcatagtccatacacaccttaaataattgattgaaatgtcaggatattaaaaaataaactaaaaataaatcgactcaacataaagttaaaaattatttgtacgtagtgcatgtccacgcatgcatatatgcttgcatgaagacacttcttgcagctggcagattgggctatatataacgatggaagtctatgcccttggccccgtgaggcgtcttgagagatatgaagtatctaatatactattttaaattactcatgttaacagaataatgctgcaaatcttaattactatagagaaaaaataggagggaggattacacacgcacgcgggtgaggcagaggagacgggcaacggcgccgcgaaagtatgtgtgggcggaattagggtattagttttcttggatagattaatctaatggtttataatagtagacccaccgatttaactgaaattaagggtagattttctgttttttataatttttaagaatttctctaataatttatttgagcgccatgtgacaactcgagagtgttttgagggaaccacgtggcatcttgagagcgtttttgggaggttaatggactgtttagtatataataatagaagataatagatagatagatatttttatgttttgtgtcacttacatgtgggtattagactattgactagtcaatttgaccaagtcgactttgatccctgctccacttgtcaatgataaagacttttaaaccccttggaaaaatatttagcaaattaattagaaaattttataccccttgggaaaatatttagcaaattaattggaaatactttggaaccacctatcagtgactagagttcttttgttttataaaaccaattcggacactaaaagaaaactatgcaaacagtaggttttcacaattgtttgaattaaattaaatttgaatctttaaacacccataactcactcatcctaagtccaaatctagtgaaacttacacctaaattcatctaaaatcaagatctatttattggcaatgattttgtatttttcgcattttaattggtatttattccttgttagttagtagtggaatattttgagttagtcattcgccatctatattacgtttgtgaggaagaacctttttgaccatgaggatgaagttttcatagctgagcaagctagcggggcacgtgcactgaagaatctttgcttctcgtctcgtttcacttttctttcgttcagtctcgctatcgttataaagtggaatcaaaccacacactccgtttggaaagaggatttaacagtcccaaagggcccaggcccagtgaaggaaagaggatttacagtcccatggccaatgcacttccataaccttttaattgcttgatttctatagagtaaatttcatattggaccactatattttacttaagttacaacttggactagggatagaactcagtttttactttggagcagaaaagtttacattaatgtttcactttgggccagttcttccactggcgctgttctcaagtgaatcttgccgacgcgcaccttgtgcgatgctccgatgctcctgttctgttatcttgcttcatctccatttattcttgatgctctagacaaacttcaggtgagaccgtgagagaggggaggctggatgagaagactaagcgcgctcaaactttgttagcgctgcagccacgctcgaccttcgccgagggtcgcgacgatctcgatcgatttgtgatttggaggaaattattaagtcctaggcaaatagaggagagctgacaatgcagtggctctgctccagcaccgttcgtacaatcacccattctcaggctgccctgtgcatgcattgattcaattattcaatctcattgttcttcatcttgtgtgctcgctagcacttgtgcaaggctgtagctggccgtgtaataggagttggagcaggtctgcaggggatagctggccggccgctatatgctggtactggctgaagagacaagctcagctcaccagtgtggatagagagttgggctcagggagttttgaggaagaaggagaaggaagatccaatgacatgtgggccaccggtacaaggtgcaaaattggtaacaatacctagttctaggtgaagaggcttactaatacggtaatgcctggtctaatgtgcaacataggtaactaaacctagcctaaagtggaattcactctttataaatttttatatgattctttgagcaactagcacgaaagccgttgcgcgttaacgcattctccaccacatattattatatgactttctgaagtgtgaagtgctcagaataatccaagtcgttcgacccctggatgtagccactaatgtggttcaccaggttaccaaagagatggttggcttgaagagtttgatgagcatagtcatcgaacttcactattgtcatgacatcttcatctaactgagtcattttgaagaataaatcaggggttttgtgctccttggtattaggcctataatcactttatagataagtgtcaacctcatattgctactaatttggcttgctagcgaggacttggaatttctgcttataatgaaaatggatttacagctaaggttgagtccaccgcccccttattcgaacatgttgaatcaaattgcgaaatgttttgtttgtagataaattgcatagcatgctatgttgaaactgtgttccgatattgttgctcaagcctatccattgatattgattccatgcaatactttatgtccctagtcgattattgacaaaatgccgtagtaatgcttgttaattgatttatattatatgttgaataatagatggtatgggaataatcgctctgggtagggagtagttatgtttatgcatgtggtgaaacgctacttgtgataaacatgtgaaacgtttgcgaaaaaccaaagttaatgaacaaaattgatttcgactgggtgacatggattgatttgggtggttcctttttgcatattggccagacactgatagtggaacccttatatttaacattctggaaaatgtaaagaaaatacccaaaccaatattggttgaacgattttagttgaaccaattccagtggattcacaaaattgttcaccttaattttgtaaattaaaaaggtacgcttacagtacaagaatattcctaaaatttcatgtatgaaatagttaatataaaatatgctccaacttataaaatttgtagaaaattcattttaacttcaaatgagttgaactaaaattatttagaataaaaaaatgatctggactaagacctggagtaactggtacatataatacatccacatttaggtaatatatatgtaaataatcgtcataattaatatgagaacttcaaaaattcacaggaaaatggttccaactccaaatgaggtgatttcagatttgttagattcataatatcacgatcttagttgctttgaattaaaatgtgccacatactgcaatgtaaactgttagggttacggataaggtataccctctatccttggacatacgttgtatactgatacggtatacccgcgcgtatccggataatttctatgtacgttaaggaaatctatcgcgtaatagaaacaggatcaacaaatggagggagtcctactcggacaagactgggtctttaccataacgtgagggatctgatatctccgagtcctacttggagagatcaactaacccgcagtataaaaggaacccctgggcaggacctaaggcatcgaatctcaccggcaacacaaccaccatagcctacgaagccggggccctacaggaaccaagtcgccgggtgatctagtcgaaccaactcgactacggtctcatcggtatcatcgagttccgatatttcctttgtaatatgtggtttccatcatataaccccataccaactagattagggctattacctaccaaggggcctgaaccagtataatccttgtcttttgtttgcttgatgttgtattacgtagatcctcgttccaacgtaccccaataccctctatatccggtctatgggtatcccccgtcaacagtggcgcgccaggtagggggacttggcgctcaaggttctactactacgacttcaaacctcctcgacgacagcgtcaaccccgatatcaaccagggagcttcaacctcaacgatgctggtgtgcactcaagtcggcgaaatcgtcttcccggtctacaccacgatgccgatctcgactggcccagaaatcaccaggatcaagaacgatgtggttacgaccccggtcgactccatgtcgaaggatcctcccacaggagcggagaacggaacatcgacaacgtctgcacctaagaaggattctaacgcggccagttcttatctttccaacaagaatcacgagccgacgaggacaacttccgaggcaacaagaatctggtgtcctattcacaagaccaaagggcacgacttgcaggcttgctcggtttttctcgacgtacaagctgaaatccgtgcctgcagggagcgtggaattcgacgtgcttctcccactcgtgatgttcattgtcccattcacaagacaaggactcacgacctctcgagctgtaaggtctttctcaatgccatgaagacgtcacctcctaaggtccaacagtcaaaaatctctcctagagaggcggacaaggaacgaggagcggctgctgtctcagatcgattcgtcagggtaatcgatattgatccccacgagccatctgtcttacatctggtcgaagatcaggcctcatcatcaacaagtacaccacgcgatgtatacgccatcggtgggactagcacgtctgcaggtggcaacacagaagcggaggatcaattggctacgccggcccaacatatcagaaccatcaacgcaatactgagggaaaccccttatgatcccgtcctgaacgctgatctcgatcagtggacagaacgactacgggaatcagtggccaacttcagtaacacattcgaagaggccgctgccagggcaccaccagaacaaccgccgactggcagcctaacggggaatagcctgaacagcgaatgccgcctcgtcaagccacccctccgcctcgtggcaccagtgatctccacgaccatctaaaaggtcgccgataagtgcggcgcacgcaagacaacaacaattgttcctgacatcgcgtctcttcgcgacatcgcgagaacgaagaccaaggaggacatccgagcgagagccgagaccgtgatgatcgccacaaccaccgtgaacacgctaatcgtgagcaacggatgtcgggcgatactggtcgaggacgccatcgtaatgatgacgacggcggagatcagtgccgggacaacaacggtgggcgacgacaaggttctcgagaacccgaacatgatccttgtaatcgcacaccggaaccgagtgactcgtcgtcatcatcatcatcatcctcatcatcctcatcatcttcgtcatcggacagacatccacgaaggatgtatgatcgccgacaacccactgcccccagcggcgggtgtagggctttcagtcgtgctctacgagatgtccgatggcctgagagattccatagtactctacgctgccggagcagacgacaacgcattggcaaaattatttgccagcggcgttgaagggatctgcccgttcgtggtttgttcacctcccgccctacttgatttcttcatgggcagatttgtggcagcagttcgtcgccagcttctaaggaacatacaagtgccacgcgatcgaggacgacctacatgcgttgacacagaatccggcaaatcattgagggactatattcggcgctttaatgagggcagaaatatgatccccgagatcactgatgcttccgtaattcgtgctttcaaatccggtgtccgagatcgctacaccacccaagagctggtgacgagacggatcacaactgctcgtaagctattcgaaattgtcgatcgatgcgctgacgcatacgacaccctaagacacaagaacgacaggccgaagatagggggagagaagaaaccagccaaggatgcaactgagtcaatcaagaagaagagtcgcaggagtgggaaaaggaaagctcaaacagaagtcctcgcagcagagtatgcggacccgcccaagcacccagacccacaaggcgacgatacggagaaaatatggtgccctatacacaagtcggacaagcactctttggagacttgtttcgtcttgaaaatggcactcgcgaagcaattggcattggagaagggcaagcgagtacgtgtagtcgagaaggccgcagaagcggctactcaggactcagactcagcatatccagactctgacctctatgtttcacacatatttggaggttccacagcgtactcctcgaaacgagaatacaagaaagtggagtgtgaagcttgttcgacatggcagggggctgcgcccaagatgaagtggtctgagcagaagatcgaattctcagaggcagaccaccccaaggctgctgtcactccagggcgatacccaatcgtggtagaacccactattcggaacatcaaggtcgcacgggtcctcatcgatggcggtagctccattaacctactcttcgccagcaccttggacgcgatggggatcccacgaagcgagttgacacctactgatcaacctttccatggaattactcctcatccatcgtccaagccattgggcaagattacgctacctgtgactttcggccaagcaaacaactttcgaacagagtagatcacctttgatgtcgctgagtttgacacagcatataatgccatcatcgggagaattgcactcgcgaagttcatggctgcatctcactatgcgtatcaagtgctcaagatgcctgggccgaagggaacaatcactattcagggaaacgcgaagctagcggtgcagtgcgacaagcggagcctcgacattgtcgagcatactcccaacccgcccgccacagctgagccgcccaagaaagtgagcaaaaccaacaagacgccgaagccagaccgcgcaatcaagatcgttccgctctccagtgccaaccccgacaaaactgtcaagatcggggcgtcactggatgagaaataggaactcgcactcattaccttcctccacgacaatgcagacgtgttcgcttggcagccgtccaacatgccgggggtccccagggaggtgattgagcacaaatcatggtgcgacccgatgccaagccagtaaagcaaaaactacagagattcgcaccagataggaaacaagccatatgagaagagctcgacaagcttctcaaagctagtttcatccgagaagttctccatctagagtggctagccaatccagtcatggtacgcaaggccaacgggaagtagagaatgtgtgtcgatttcaccgatctcaacaagacgtgtcccaaagatcacttcccccttcctcgaatagaccaattggtggactcaacagctggttgtgagttgttaagctttctcgatgcttactccggctaccaccagatcagcatggcgaaagaggatgaggagaagacagcattcatcatgccattcggtgtattctgttacgttaagatgccatttggactgataaccgccggaaacaccttccagcgcatggtccaaggggcacttaatgaccagtttgggaacaatgtcgaggcctacgtcgacaacattgttgccaagaccaagacaagcgactcattgatcgatgacctccgagaaacgttcgacaatctccgacgatatcgtctcatgctcaatccagagaagtgcacgtttggagtaccgtcgggcaagctcctcggattcctcgtctccggcagggggatcgaagcaaatcccgagaagatcaaggcaatcgagaacatgaagtcgcccacaagactcaaggaagtccagaagctaaccggatgcatggcggtattgggcagatttgtcgctaggatagaagaacgatgacaaccctcttcgctctgctgaaaaaacaagacaaatttgtgtggacacaggaagccgaagatgtgttcatcacactcaaacgctacctgtcaaatccccctatacttgttgccccccaacctaatgaagaattattcctctatattgccgccacgccatattctgtgagtatcgtcattgttgttgagagagagaaggtgcaacgaccagtttactacgtcagcgaagctctccacgaggcaaagacaagatacccacagatccaaaagctcctctatgcagtaattatgacatcaagaaagctacgccacttcttccaagcctacagagtcacagttgtttcctccttccccctcggagaagtggtgagaaacaaagatgttgttggccacattgcgaaatgggtagtcgagctaagctagtttgatgttcactttgtgccacgataaccatcaagtcccaggtcctcgccgatttcgtagctgactgggctatgcctgacaccaggtcggacagttagcccgataacgagacatggacaatggcttttgacagtgcactcaatagccaaagagcaggagcagggttcatctgacattacattcggagatcagtcaagcacgcatttcacctcactttatggtgaccaacacacagccgagtccgaagactactcgctgggataagagcagcagccgcagtaggagtcaagcgactaatcgtgaaaggggattccgaactagtcgtgaaccaggtgcacaaagactacaagtgctctagccctgagttatccaagtacctcgcagatgtcaggaagctggagaaaaggtttgatgggatcgaggcccgacatgtatatcgcaaggacaacatcaaaccagacgacctagcacggcgtgcgtccagacgagagccactcgaacctggcaccttcctggacgtcctgacaaagccatcggtaaaagaggcaaacgacgaagatagcacagtcgtccccgacatcggctcgggggctacagtgtcagaacacgtcgtcgccgacatcgagaccacagacgattggcggaccccactcatcaagttcctgagtagcgacgagttgcccgaggatgacacagaagccgagaaaataacctgacaagccaagatctactgtatgatcggcaacgatctatacaaaaaggtgccaaacggggtacttctcatatgcatctcgttcgatgacggcagacatctcctcctggacatacgcgaaaggatttgcgggtcacacaccaccggtcggacattggtcggaaaagctttccgacaagggtttttctagccaaccgcgctcaaagtcgcttgtgacatggttcagcggtgtgaagcctgtcaattccacagcaaacacacaaggctaccagtgcaagcgctccagactatccctcttacttggccgttcttgtgctgggggctcgacacactcggaccattcccacgaggacagggcggctacaggttcctattcgtggcgattgacaagttcaccaagtggattgaagcgacgcccatggggtaaatcaaggccgacaacgccattaagtttatcaaagggatattctgtagatatggactgcctcaccgcatcataacatacaatggttcccagttcatcagtgccgacttctaggactactgcatcggattgggagtcaagatctgctttgcctcagtttctcaccctcagagcaatggacaggtcgagagggcaaacggcatagtactacaagggttcaagacccgtgtctatgacagactcatgtcacacgacaagaaatgggtcgaagaactcccctctgtcctttgggccatacgtaccacaccgacaacgtccaacaaggagacacccttattcctcgtgtatggctcagaagctatgctccccacgaagttgcgacatcagggcacacgagtacagaaatactccgatgaggaccaggaggagcagcgaagcgacgatgtgcacctacttgtggaacatcgagaaagagttgccgtcaaagcagccagctaccagcaggcccttcgccgataccacgagaagcgcatcagagcacacacactttcgatcggtgattacgtcctccgacgggttcaaaaccaagcagggcgcaacaagctctcacccaagtaggaaggtgttaacaaccaaatttggtaatatcaccatcggaaaagaggattagatcgaagcggagtcaaaggcgaagaccgattcgggaacagagtaagaatcggctggagtctagatcagctacgattggatcggctaaattcgagtcggacttgatttggtgaagcagccgattccgacaagacgacttggtgtacaacatcgggttgagttgatatgcttcaagatgattgccacgcatggatagagtcctgagaaggcaattgtatctattaattaggatattttatataatttccttagagatatgtttgggcaaaagtctgccgtaaagacttatggtatcttagggtatgttagagataagagtcgtgttcgatatggacatagtttgtaattctcgggtataaatagaccccgaaccccatgtaattaaaaaaaacacacacgttcaatacaatctcggcgcatcgccaccctttttgcttttgttttatttcgacgagttcttgctttcgggttgagctgcatcggtttcgatcttcaacaagaggtaaaacttgttatgacggcttgcgttctcgggattagtgcttccatctttatgatactctaatgttgtttatgtaattcgtcaagttatcatatatcttacataatctctagcaatatcgccatctaacctacaatcggctaacatctgtcggtagagggcagccgattaggttagatatcaatgttgacttagattatataggatatctaccactctatgaatcttccagcggcttgattgtctagatattgttcttcttttcatacttaatgttgcatcagttgagtttgatctattaagtctgcttagaacatcaatctctagcccgccttatggttgccgattagggtagcatcgaggtttcagccgatcttatctgatttaactacatttgctttatgtgtgttattgacacgttaaatctgccctttatgtcaagatcttattgcatcttagtatattaagcttctgtttggtatattctgcttgttttaatatcttaacatagagttgtatcggagtattagccgatacatgctagatctatcagatcggctacgctatgaacatatatagtcttgttgttaatatatatttcgatctaagtgatttatactgtctcggcatagcgaccgatctatcccaatcacttgattcaagtatatatcgacaccaggattatatattgttaatatctacaaccgattgagtagatttagttctttattatcttttgacaaccgccgatcgatttaagcatgacatcggctcaaagataaatgatacgacatcggcatctagccgatcggctatgatttatggatttaactacgatttctttgtctgtatttcttgttgatttcaggatcaaatcaactggcacgctagcatatccaaaggcaagttttggacctgcactggagttaaacagatctcctaggcctcgtgtttttcatcaacacgcttttggcacgcctggtgggaccgattagaagtcagaagtcctctcatggacggcaaaccgccaacatcaccatcctcagctagtccgggttctgttaaatggaaggtccagcaattagaccaatctgacgttaatgagggcaacgtcatgaccattactccagacaaattgacacctaatcagaagaaggagtttgaagcaatgatgcagcaagcacggaaccagtttttgaactcatttatgcagacccgcaaggggacagtggtgcaaaagtatcaggtgagagtagtggctgatgtccccgggaccggttcttccaaggatggggagtgaaacaagctccagatggctcggctcaaccaagcaacaaaggtgctgcagatgattctcaaggaaatcaaggtgaccactctcagggagctcaaggagttcaaggtgatggtgcccagggagttcaaggtgacggccctaatcaagacggcgatgcaacacagttgcagttcaacaactttagcgaacatggtaaagtcaatggttgatggttcaatggccgagtatcaagctacaggactagtctacttaccaggacgggtgttcccgaattatcggccattaatcatcgataatcaaccagttgtccagccggccattaatccaccatcggttcagccgacggcaccattaccagctcctgcacccgctgtaccaccttcggccccaggccaattggttaatccccgattgttggtgagagaacaaccacaacacagtggacagaatgtgaatcggctaacccaagaccaggttgcatctatgttcttacctcctcaacatgccattgatccaacccagcaacagccgattcagcaaacaccgccaaggcagcaggttgtgcagccgattcaacaaacacccccagtccaacaggttgtgcaaccaattcagcagacgccacagagacggcaggttttgcagccgtaacatcctggaaattcccaataataaaaatcactaaaattttgaactttttaaaacttttgcatcatgctggttgttatgattgctattgcttgccaaaccgtaaatgatcacaaagaaagtaaagaaaagaactacatttaggcaatagatatatttaatcctacaaataattatgcacaagaaagcaagccaaatcaagtataagtcaaatattaatttctactataaatcacagatcaaatattaaatatttgaaccatgctgatggcttgatgccatgattagctaaaagagatagtaaaatcaaatctaattcatttgaatccaatctcacatgaaatataagaacacatgaaatgatgatcaccactataatgatcgcgcttataaataagtaattcaccagaatatatagattgatacttagaacattttaccgagtccctcatgacatgaaaatcactcatataaaataatggtcatataaataaattaagaatatgtgagtgtttaattaaacaattaggttaatgttgtactgagtctcaatttatatttatagaatgaatagacccacgtaaaatgcattgttatacaaataagttcattcaatgtgctattgcaataataatggccacattaggatattttaattaattttagaaccctcgaagcctccaaaattatctaggttaattttataattagacctcatttaaataatgcaatagaaaaatatatataaacataaaatatgggtaatattaaaaattgagtaaactttcatctaaattaacacatctattgggtaaacatcaattgtgtgaaatctagaattttatgggacaagttttaataggaaatatgccctaaaattggataaataggaaaaagtcactgttcattatggcctaggtgctcgatgtggttccatagccctgcccctccactgctgcaccaccctagccggcttcgagccctgcccgcactggcgccaacgctatcccgtcgccgctgccgcgccaccgtcgccgtcatgtcgccgcgccgcccgccattgcgtcgccgctgccgcctgtcacgcgtctccacgcgccgtcgccgtcgctgtcgccgtcgccgacgcgtcccgtctcgcgccccgtgccactgcgcgccgtcgccgacgcgtcccgtcgtcgctccgagccgcgcaccgccgctgccgcgccatcgccgtcgccatcccgctgccaagccgcgcgtcccgccatcgcctcgagccccacccctccgcgcgtcatgtcgtcgtcgccgtcacgtcgtcatcatcatcgcgccgctgcctgccgcgcacctgacccgtcggccctgtgcccctgccccaccgcgcgcctgtcacaccgccgtcgcgtcgccatcgccgtgcgccgtgagccgttgctgtcagcctcgcgccccgagccgccgcgcgcccgtcgctgccgccgcgcgccgctcgccagtcgccatccctcccgtcgtgtcgccgctccgagccccgcgcgtcgcgtcttgtcgccgttgcatcgcgtcgccgcgcatcgttgttgcgtcaccgctcgtctcgagcccctcccctcggcgcgcgctgtcgccgtcactcccgcgtcgcgccccgtgccgcgccgcctcgcgcccctgccgcgccgcgcgcgtcactgtcgcccgtcccgtcgccatcgtgccccacgccgccgcgccgcgtcgccgtcgtcattaagcaccgcccacccttcccctccgcctatataaaccctccccggccgtccattgcttcccacaccaccctcaccacctcccctccctttcccctctctttcccgtccctggcgttgccaccacttcggaagccgccgagcagacgcgcctcgccccgtcgccgcgctgcgcctcgtcgccgcgccgtgctctgccatcgaccccgccgccggtccggtgagcctcccccttccccaccgcttgtcgtcgcgtcgcgccgcccgccggttccagccgagccgtgagagagagaggaagcagagaggtagcggggagagagagaaaaagagaaaggataggagagattagagtgggccccacgtaattggtgaatagtaatccccttcttaatctttattagttgtgtctattatatgtgggtccgggtggttaaaaatctaattatagaagttttatggtctcgagtctatgacatgcgggccctaccgggtttaatggccggtttgaccctagtcaaaggagtcgggactacctgtcatttgcccatatggattccttcagaaagaaaaataaaataaaagaaaagaaaataggaacaccccacctgtcagtcactatagcttgtggataatattgtattaaaaataaatgaattaggaacagtaccatttcgcaattattagaattaattcaaatttgaatctttaaactagcgtaacttatttgttttagctccgattcgagtgaaacttgaacctaaattcatctaaattcataagatttccaatggtatataattcactatttacgaaaatatatttaaattatgaaatagttaataccaagatgatgtataatagttaacttaaaaatgtgctcataaataggattgatattgtacaatagagtagatgtcaaataattgtctttaacacgctttctcactataaaacctatgtaaactaattaggagcattgtttcaaattaattaaagcataggaaatactagtgccatttattaatatatgtgaatatataactatactcatgacgttcaaattgtataaataatgtttagcctcatactttgtgactaaatttgaacacacgtagatgagtcttcaacttgtttatgagggataataacatgtttatgagagataataacagagctagtgtgactaaaatcacccgcacgaagttagttaacggcatttcctatacagtagtatatgtttaggttggaaattgacccttaagttgtatagacggtaacccactcataaagccacttaaaatcacatgtactgagtagcttgtagtaaatagcaactattcaaataaatgattcaatattaagatagatattgtgcatacacatatactgtacatcacattatagctatatggtatagtatcaatttgcttgttgcatgtattaaattaaagggaatatatgataaacatgtatattagataaatactagttataaatcttgatctcatataattatagttcaactgtaaatcagtattatttattgtaaaattatgtgatgagataatccgtaaccataatatgattaacctaaactattctaacatacaaagcatgggtaattgttaaccttttataatttattttgacaagtaaaatatgtacataattaaaataaagcctccatcaataaaataataatacaaatgattcacaataattatttgaccgatcctaaatccatctaacaacagaacctctagtatataaccgtcctatttagatagatgcatacatagccataatccttccatagccatttgatagactaaaccaccgattagccaaatatatatgtatcccataaatgctatgttggttaactcctaaatagaccacgatgacaatagaaagattaagaagccttagccctagcatgattgaaatccattagcaaacacgaatagtatgagcaaccctaggatcaaccccaacaattatcttttgcttgtgcatatttgcttgttgtttgaatattggtttttctcgcgtattatagacctggtgtatcggttagtcgtgaggcaacgtctgcaacttccaggaggtgaaggttgatcaagattatatcgagaataaggactatcctaagtaggcaagtcatcactattccttgaacatgttgatcccaattgcgaaattgttttgtttacaaataaaattgcatgcaatgataaacatcctacttgtgattatgccatgccttgattattgtttacccttaaaatccttgtaaccatgattacgtatgagtccctagtcaattatgacaattgcttaggaatgctattctagaatcatgcatactcatatttatcaaatgctatatgcttgggcaattacctttgggaaggtaattgagatgcggcatgtggagacatgagcgccacattgccatgatattgatgacatgatttgtgaaaggaaaataaagttaaacaactgttttcgactgggcggttggaggatttgggtggtgtccggaaaaggctagtgccgtccctggtcagttaaggaccgagccatgaagttaagcatgaaacgacccccgtacaaccgcacttctcgtatgggtatagacctagcggagtagatagctgagcggaggcagtatccctgcatagtggttttcttttaggtgtgtgatgcggcaagcagtctgctggcggatgcccggttcggatggccaggtggatggcggatgcccgttccggatggtcagaggttggcttggcaatactacataaggatacccataagagaacaatcatgatggactgggttcaacgacaagaagcaacgtaggagtgtgtgtgtttttcccttctcgagagcgccagaactcctctcactgctagaaacatatgacgcctagagtgcatgagggctaaagttcatggagcgggtactgccaatgcgaggttatcgaaaagctttgccgtgacgcgtctcatgtgttgggatgaggctcatgtgttgggcagtcgcggagtgcgggtaaagtgtacatccactgcagtgtgagtaaaccgaatctattcgaatagcagagctcgcggttattgagcactgggacacgtattacacttggctagactcaaaattcttaacttgtgtgggatgggatattgcatgatgattttatgctgttggagccacttcctgagaggcgggaaggtggacgtcctcagaaaaccatgacgactcaatggcgggaagctatccttgggattacaatggatggtggacagaaccgtcgttgtttaatgtgaacactggtattaaaacttgatcagtctatgttaggtcttaggcttgtgaaaagaattgcaaaactagctttatgcaaaagaacctgaagccattccttgaaataccctctatcatatgcatcgttgctgtggtggcttgctgagtacggttggtactcacccttgctatttatatatcttttaggagagtgttgaagagaagcccttgtcggtacacttgcgtatccaacaagatgatcggagtgcggtcttgttctaggtctcgttccctagtcgactgcctgtggcatgttaaccgggcccttatattattttgtcttccgctgttgttctctgatagttgttggcctaccggccctaatgtaagtatttaactcttttagcctgaattcattcgtgatatgttgtgatccaactatgtatgtgtgtactaactactgatccagggattggtacggataaacacagaagatttccgattttcaaaatcgggggtctacagcagccgattgaacagacgccattaaggcaacaagttgttcagccgattcagcagcaaggctcagtgaatgcatcggctgggtttgcctgtgcagcctgtgcagcataccgcaaatcaagttgtcccggagcacttcattcatcacggtacgaccagatggcacactgactcctcagttattcctgagcatttggtgcgcaatattcagccggattttcaaaattaccaggggggcaatttgaattatcagtatcagccgccatcaccgcaagttcaataccggcaggcaggatcggctcaaccccagttcgttcctcaatacaatcagtttgagcccatgtcatagcagcctaagggaacacctcagcaatgaccatgggctgatttgattgcggacgtcatgaaggagcaatttgggcttaggccgaaagatgctggaaatttataccgacagccatatcctgaatggtttgagagagttcctctccctaaccggtttaaagtcccagatttttcgaagttctcagggcaagatagtacatcaacttatgagcatattagccaatttttagctcagtgcggtgaagcatcggctgtggatgccttgagggttaggttgttccgattgtctttgtctggatcggcttttacttggttttcttctttaccgtatggatcgattaacagttggggcgatctggagaagcagtttcacagctatttctatagtggggtacataagatgaagttgtccgatttgacagcaatcaagcaaagacatgatgagcccgtgcatgagtattattcagaggttcagagagatgaggaatatgtgctacagtttaagtttgactgatgctcagttagctgatttggctttgtagggtatgattgctccaatcatggagaaattctcatctgaagactttgaaagcttgtcgcatcttacacagaaggtaactttgcacgagcagtggtttgctgaagctaggaggaattctaggaaggttaatcatgtctgtccttatttgtgtggatcggatgatgaggatgatgattctgaaatagctgtagccgaatgggtaaggagcaaaaaggttgtaccatgccaatgggtgaagaattctggaaaagaggagaaggatgatatttgacattaccaaggctgacaagatttttgatttattcttacgagagaagcagattcaacttcttgccggtcacacaattccatcggttgaggaattgggcaagaaaaggtattgcaagtggcacaattctgggtctcatactaccaatgattgcaaggtcttcaggcagcagatacaagcggctatcgaaggaggcaaaatcaaatttgatgattctaagaggccgatgaaggttgatgg

SEQ ID NO: 78152 - DNA, 19703 bp, Oryza sativa
  unsure (1)..(19703): unsure at all n locations
atatttgagaagctgcatcttgaacttgcagttgtctctattgacccatttgctgtgtgctaataataagtcgttttttttccgcagatggagaaagacaaaactgaagataaaaaacgattagccgagaaagatgtagtattgttggtgaaggacaaggaagaagatgtaactagattaacaaaggataaagaagccatgggaaaattgttgaaggacaaggaagatataattagattgatgaaggagaaggaagaaatggtttggatgatgagggagaaggaaaacatggttagtttaaataatggcagggttgaagataaacatcaactgacagataaagatgtagctaattcagctaagtacaggaatgaaatcattaagttgatgaaggagaaagaagatagtaatgatacaattatgaaattaaatatagaactggaagctatgaaatcctcatatgaaggaacccgcattctgttagattctaagaagaaagaggtacttcagcttttgatggacaaggagagcattgaatatatagtatcacaacttaagcaagagcttgcaatagaaagaagctcacatcagacacatattcaagaattggagactagggcttttcaggcaaataataatttagacaaaggnataaagnaaatgagcttcatgctagaagactctaaacaagaagtaagagatcttgaggaattgttagaatcaagaagccaaatttggagcaaaaggaaatcaggctgaaccaatttattggtctacaaatacagaatattcaggtattgattggccatatcactttttcccactatatttcttttaagagtttgtgaagtcatcaatttaagcttaaaattgtcccttaccaggatttgaggttgtcttctgtttccatcaggcatgaaatcctacactgccagaaaagatggtctgaagaaatttgtgacctcggtgagaataaatgaaataagttattttagtccacatggaatagacatactgtagttatcattttataactttcatatcatttacaactctgcaggacaaagccttaaggtattgacaaatgctgctgaaaattatcatgctactcttgaagaaaacagaaaattattcaatgaggttcaggagctaaaaggttgcaaagcaaacagtattgctcatttatatgctgatatccttaactatcaacttcttatattatatgcttatttatcaggaaatatcagagtccattgccggataaggccttttcttcctggagaggatcagacatctactacaattgaatatgttggtgataatggtgaactaattttagcaaatcctgcaaaacgaggaaaggaaggacataagttgttcaaattcaacaaagttcttggcccctctgctagtcaaggtaagaataaaagcgacacttaagtgaaatttgttgtgctttagtgttgattatactaattgtccagagaaagtaccgaaattttgcagtgctaacatacagtttatgttcatttgtatattcattttctggctagatgaggtattcaaggaaattcaaccactaattagatcagttcttgatggctataatgtttgtatttttgcgtatggtcaaactggatcagggaaaacatacacaatggtatgatgctctcagcataagaatattgatctaatttatgtcattgagaagtactattgacattattaatgttcttgccatgccatttttacaaatatcttagactggacctgaaaatgcaaccgagaaggaatggggtgtcaactacagagctctgaatgacctattccatatctcacggagtagaagagacaccgtgatgtataaagtagtgttcagatgattgaaatatacaatgaacaaattcatgatcttcttggcaacagtggttcagagaagaaatatccttttggatcacaggctttaaagtgataaataatattatttattgacaattttgcacaagtagtttgtgaattcactggaaagttttatgcacatgaatttccagggcaacacatttccatttcatgcaactgagtttcatacattgtctgcaatacatcactattgtctcggtgacaatgaatgacgtgttgtagatatggatgaaacagaggcaaagtgtagatttatccttaatttctctgttgatgtagtcaacatcaaatcaccaggttttttgatttggttaacaaccccagcacaactgtatccactgcctagctatggactgtcagttgattcagttcgtagaaacgtgaaacatagttggtcaccattttaccacaattaaataaaatctagatatatgtccatcttgtaatgagacacctttaaacctccacaagaaagtgattccttatttttctttaacttgcgcacacttgggattttgaatgccagccaacccaatgggcttgctgttcctgatgcaacaatgcatcctgtcaactcaagttcagatgttattgaactaatgagaacaggacttgagaacagatctgtaggcgcgacagcattgaatgaaagaagcagcaggtctcacaggtaatttttttcgtttcatgtttctgataccatttcttttctgcttctaatcaaatataaatatataagcttattttgagtaatctttcagtgtagttactatgcacattcaaggtgtagatctaaaaaccggagttactttgcgtggtgcgctacatcttgttgatcttgctggaagtgagagggttgatcgctctgctgctacaggagatagactaaaggaagcacaacacatcaacaaatctttgtctgctctcggagatgtcatattttctttgtcacaaaagaatgctcatgtaccgtaccggaacagcaagcttacacaagtcctgcaaaattctttgggtgcttacctttgctaatcgattgtataacattgttttacatatttaagcttacacgagtactgcacaattcatggcgtacttacctttgccaatcaattgtataacattgttttacatattttgtttaacctaaacgttttcatgtgtaggtggcaatgcaaagacgctgatgttcgtgcaggtcaatccagatgtctcatcttatgcagagactttaagtactttgaagtttgctgacagagtgtctggagtggaactaggtgctgcaaaagcaaataaagagggaaaagatatcaaagaattcaaggagcaggtgacaatttgcatttgccttttgctgacagtgttattactctcgtttgaggatggcactaaataaggatttacctgcctctgatatttatatatgttttatacttgttctcatacctgaggtgcagtttacccttattttgtgcaaagagatatggtttacgcaaaattttacatcagcatgagatgaaataacagttattctcatcagatgctattctgagtgttaataaaaggaaaagcaattgcttactctaataaattttcaacctgcagctctcactgctgaaagataaaattgcaaagaaggatgaagaaatcagccgactacaactacagagtcataatactccaagggcgacagctaaacgtgccgattcattgttaaaacattcgtcatcctccccaggcatatcatcactaggaagcaaaatccagcaccgaagaacagcatctggtggaaggataaagatcgttggcagtagagcagggtcggatgttgacaacttctctgacatcagtgacagacattctgaagctggttccatgcaatctgtcgatgatatccagcagtcaagggagattatgggtctctctaagctctccatgagtgagatgggacataattctgttgaccctgagcttccttgctttggctatgatgattcagaggggaggctaagcgacatatcggacagcggtctttccatgggtgcagaaactgattgttctatgagcagtgtggttgagcttacctccttgccagatcaggatagagtctctggcactcagaaagagcaacacatggcaccaagcactccaaaagatcggttgtaagtactttttgttctgcagtaaattgataacaactaactgatgagaagtaatctaccaatcaaactatgtcgggtcaaggggatgaaagtatgtgagaaatctgtatgatcctaaaagaattaatgggagttagatatgttacttatatgacacttaatcttgcctatttcttgtacacttttatgtttctggcactgtagcatcgatattaacatatgtaagcacatgttcttttccaaacaggcataaggtggccactcgagcatcgaggacaactacaccaaaaacaccacaatcgcctaccttgtggcctaaactaagagatccacctcctcctagatctccaagtaagttcacttagcaagccttactttctttctaactgtgaatttcttgaaaagcatgtgccctccagggaaaaaaaagctgcacacataacttaaagcatgttatactgatatactcaagaagagaaatgtaattttaacggatcccactgacaagtaaatttgctgcgaagaataatcataagcagggtttacattatcgatagaaagaatttgaagtacttatcctaacttctaatattcctaccatcaattatttctcaaatgcttagttttgaatcaacaaaaatggtagttgtagattaaacttattaggttttatagacattataatgtaaaattgatggtcgcaatttaaaaagtttaatcaaattgtgtcctaagtttcaaatatttatgactggaggaagtatctaagaaagtctcttaatgggccaaaagccctgtgaagctagggctcaacaagcccaattatgtaatgcatgtgaaagattcctccgtggttaatccccaactccacagcatgcacttacctcctgagctcgaccaagcacttttcctcacctcttcattttttttctcaattttctaataatttttgctatattttcccccatttatagaaccaaaattaagtccaacactaatacctgtagcttttcgctaaatccgacgatttttgttttctaacatgtggttatcgcagcctcgaaatttcaaccatttcactcggtttttggtggatgtttaacggaaccccagaattcaaattcaaattttggtttcaaattttgtccaaaatttatcggtttcccagagtgtccatcagaaatgtaaactctgatcataagcattctaatgatttattagctatacagatgaccaaagtagccagggcccaaaaactagctgctattttgtgagagaaaatgtatggactagcagtacttcaagtgttaattttgcttgataaaatgatcatgtctgatagtacttcaagttcaactagtacagtaagggataataagttcaaaaagttccaagggaattaccacaaatgtaagtgctattgcaaactgttcactaattttctttttgcagtatctacaagcacaggaaaggtcagagtaacacaggcaacatcttcatcaagaaattccagtactcagaaaaggtggacgtaaaagctgtgcatccttgacgaacatcttgcaacattggtataacctttttgtacattacatctagaaaagcatttgttttgttatttaatagatactactcattgattctgcactctggttttctttcacaattgaagaactgcaaaaccagttggaatagattgttccctgtaaatgctcttgtacatatgctatgttcacaatacgataaacatttgatgtgtttattataagcaatgaaaagacggtgagcttaagacatgaggaacttagtatacgaaatactcaaattttttcttgcataaaacttcatgttgattttcccaaagattagtgacatgcccatgcattgcagcgggtcagacccaaatgattggggatgggctgggagggtggataagtcaactactgtagtagaagaatcactccaaatgaaaaaaacaaagaaaaatgaccaactatgtaatttacggcaaaacagatcttctgaacccctaacattagaatttgcaagcaaggaacatacatattaggcctaatttagaatgtgggaagtttttcccatctttgtggtattgagttcattcctgtgaagaacatgcaaagtttctatgaaattcttgcattcgaaaggagaacaggaacttgcagcattttcacatggaaaattcctgcatttgaaacaggaccttataatcatttataagaccctgtggtcactacacttgatttctattgagaatttgttgtgacaaaagtaatccaatggaagaataggccacgaacaaaatttctgacaacaatgctcttataaagtttacatttccaaagctaaaaggtcatatgaaacctcgccacatttggcgatgtatggaatacagaaaacctaccagcatatttacatggcatatatagaccacaaaaatgtgaggataaaagaagatattatctgtggggaaaggacaaaagaagatttggttcaaaaccaaaaaaaagtttccaaccagattttgcctgttgtttcaatgcccctatcgatgttggaagttcaacttcttgatgcaaatggcatacatgaacgcgaaaaacacagcgaagagcacgagcaccggcgcaacaactggcataaatttcctgtgatatccaaaatgatgagtaacatagtagctgattgtctggttggattggccagggactgagatgatttgttctaggtctccatactgtgtcactatgagcccatacactgtccatgccaatgggcaaagccagtagtaccagatccaccatttgggaatcctctgaaataaaacatgaataacaccattactttgatcttccaagaagaataaaaagttcaaagaaacggtttgatccaagaaaactcactggtctcggaatgaagaatcctgagaataggttgaacaaggaatagaacgccgcggcaaagatggctgcaacctcatggtttggtgagattgccaccgtcatcataccatagtaggtgaagtagagaaatgagaagtaggagacgaagaagaaccagaagaacttggctgctgtccactggaagctcatcatggcataaacaatgagggtataatatgcagtttggacgaacacatagggtatctccatgacaacctacaacaaattatcaagagttgagcaactcctggaaacaaattataccttaactgccttagctaccaccataagttacctgagcaatggcatagggcatagcagagtacatcccagcagccctctctcggtagaaaactgttctctcaatcgacacgattggctgcacagtcgcacaattgttgataccgataaacatcactgctgtatacattgctccaatgaccattctaagagaattggcatttcccctgatcataagacaccaaaaacgtcagatactggaacattaagattaaggagtcaaagatgaaaaagagaggaagtatttacatcttggtgccgatcttccaaaagatggtgccgagtagcaaggctgtgaacagagtgaaggaaaatctaacaagattgtaatctgggctgcgccaataggtcagccattgcttccagaggcaggccctaaattgccctatggtggattgagagtattttgtaggaaaatgcagatctgatgttcctggctctggttgacttagctgattcaccaataccttgttttgcctgaaaacacggcccatctattccatgagaattgacacacaacaactaaaaactttaagaagaaagataagagtttaaaagtagaagaaaaaaaaatgtttcgcttacttgtacaggtctgatgtcttatagtactcagcaaagtccatatttaagcgtacttccgcagcaactgaactgacctcaagcatccatgtagctggattgtacttatctttgattttaggcacaccaggaattgcctggtaatattaaatagcagattggttagaaaagtaaatttattctagttattcataacacaccttccacttagcaaaagttaaccaccatctgaaactatctgtacctcgaaatattcaatcattttctgggaattacgacccaattgcccagagtatatcacctgccctcctcttttcagtagtagcagctgcacgagagttcaagctcgagttactatttagttactaaaaggtggaattactatgtaagtaaactattcatagtcacctcatcaaaagcctcaaatatgtcaatgcttggctggtgaattgtgcaaaccactgtccgtccagtgtcaactgtgttcctcactgttctcataacaatggctgctgctcttgcatcaagacctgaagtcggttcatccatgaagatgatcgagggatttgcaacaagctccactgctattgtcaatctcttcctttgctctgttgaaagccctgtgattccaggcaggccaactaacgcatccttcagattgtcgagctccactagttccataacttcatcaacaaattgctggaaacaattgaacttgtgagtttgacaaattgtgacgacaaatcctagtaatcagaaattaaccacccaatattcacaaaaaattaaaacacctgattgacaataatgttttgtgttagcaacaaacaaaagtaaatgacttataatacaccctgatgatgaaaaaagatgcagtgttttgacaaggaaaaagacatgacttacaatcttgatatcatcagtgatttcttgatctcctattttttctggaaggcgcaggaaagcagagtatatcaaagactccctaactgtgacctgaggtgaatggatatcgttttgctcacagtagccagaaattcttgcaaatgtttcttggttcttaggataaccagaaattctcatatctccttcaatgtaaccaccagtctttcttcctgccaaaacatccataagagttgtctttccggctccactgactcccatgagtgctgtcagcactgcaggcctaaatgatccagtaacgtcacgtaacaattggagcctatcatccaccactccttgctgcttcatttcctatgtataaaacattaatctcaatcaaatattacaaattttcgattgaggatacgacagggaacaggacaagatgccaagagaagttaagcataggtaaactcactgcaggcatgtcgacatagtagttcacatcatcaaaagacatggatagaggagtaaatggaagaaccattcctcttcttggaccagcttcattgctaccaatggacatcagtcgtgaaactccattcgatgaactattgctcagacgagcactcaatctcatctccctcatttcttctgaaataattgccttattattcctcagttttaaaaacttccaattttttcagatttaattatgacttgaagagtttcttactgtgatttccaccatttgattttgtgctgccatttcttactgtatgtcttgcatccccattgccttccgcttccttcgcagtttcttcagatatgacagcttgtggtttgcccagagctaacaatcaaagaaccagcaaatcacgtattggtccaataactataatcacataagcatttagattttaattcagatacttacgattcagataaacgagtgacagagtgaaaagcacattgaaaaacatggtgaaacccaggagccctgctgctccaatccagaaccaatttttgtcagtgaagatgttggcaccttccatcagagctattcctagtcttttaggaacgccattgttatcctgtcaagatgcatgcaaacattgtcagaaaacatatttgcaagggattttaaggttcttgaggcggtactacaaggtaagccttttctgttgtaccttgtgatacttcctcaaggactgtaaagaacctctatacgcaaacaagtgaaaaggcagtgctataatgagcttaccagtacaaacttgttcatccaccgaggagagtagaattcattgactgctagagcattatacccgtacatcagtggtgaaacccagtaaccccagatccaccattttgggatgaatgctgttaacagtcaagggcaaagtaatattcaatagagctgcaacatttatgtgcagaaaaaacgtggagtgaaaataattagataagtaaaaaaaaccttttggcagaagaaatcctccaagaacgaaaaatatgagaagggccagggctcctccagtttgagcaatgatcatggatctgcacagaccagcagttgctctgaaaaggccacctgccatctgctggatcaagaacactagcagcaactgcttgaaaaatctgtgcagaaagatgataggtaagtggacagaaaccttgctttcctgaattcatgtttaattctttttctgctttttgtgtacctgtcagcctctggggcaaatcctatagtgtagtatgtaacaatcacccagactatagattcgatgatggaaaatgggattctcagaataacattcggtagagtgaagatccaagcagggtagaagaggaggtcccggtgcttgaagaacactggcaaccttgtgatggtcaaagagagctcagcgaaaccattgaacatgttcacaatcagactgaaaagtagtgctccaatgtacacaaagccatcatctaaattccttgtgtgcatctgggtcctaagaaacactgtcgacgcgacaagggctacaatgatgagcttcaaagttcaccggcagaaggtgtcagtcgattgcattgtgtattttgagaagtggcaagactgaacaggaaactttgctcacctgtatggtcttgaagatgtacacaaatgagttgcgcttaatgaggagccactccttggcaaaggatgccttgaggagctctgttgttgacaccgattgcttcgagaagacaagagcagcctgatggctacgagttttatcaaatgggactgagagatgattctcaagttggagcccaacatggaaccttttaaatctctgtgcaaattctgagactgaaatgtatctgtatggcctatgcttgtcggcccaatactgctcctgatccttctttgatgtcacctgaaaaattggcaaaataaagctgttcaggtaaattcacatattgaagctttcagaaacatagattctaataattagacaactgcatgatgttacctcctgaagaaagtctgcagtacccttacgctctgggcagcggaatccgcatgactcaaagaactcaaggacgtattcgcggggtccctgataaacaatctggccttctgacagtaggataatgtcatcgaatagctcaaaagtctcaggggctggttgtaggagtgacatgaggatggttgcctcgcccaagtgcacgatttgctgaaggcatttgacaatctggaatgtggtggagctgtccaatccagttgatatctcatccatgaatagaacctttgttggaccgacaatcatctcacctgcattccaaatgagcaaatttgttcattgttagcatccttacaattttcggggaaaaaaagggtcaataccttcaatactttatagttcatactgatcatttgttgaattgctagtttttgtgcttttcacttcttaacatatttttacaagaaaaataattgcattctagattttagccatataatgtaattatgcaaaagaaattgtacaccttttcttccagaatatatgacattttggaagggtttggtctctaaaatccatctttgaccgatatcttttgtgtgaaacacttatgagaaatagaaaataataatatagtatgaaaatatttttatgtatagtcatgttaaaagaaggcaatggtggggatgggggtgaatctgcctaggggaatatcgggagtggaaacgtgccggtgccaatccagaactgataatttagattgcaagcaccaaacataacacaatatcttcatgcattagacttgttacacgtctagaagctaatactataattggaaccatgtaaagaatttcaagtgtttcttgttgcaaaaatgttcttttttagggcagcaacagaactgttcttaagtgaatgtatttaatggaaaagaaaagcacagtaatctgttttgaacatgtatgattcatttttatccgtagtatttagcacttagcaatagcttttccaaccaaaatcggtatgacaacaggatccagcaaaacttgaaccctcctataatgcaatagtcccaaaagtaagtactactcggtcatatctctctgcccccatgcacttttggttcattctaatagctatcagtatcacactgaacccaataacctacaatgcggtactgtctacagtataggatgcggaatgaacaagctacagctcttcctcacactctcagaggataagagtggtcactggacaagtgaccatccaacaactatgcagtgcattaaccataagatgcctgtacaatacagcatgcaccccagtcaagtggtcatgcacttcttcatgtgtggacctcagaggcacacatatatctcatgatcaccacacctttttccagtaggaaccacaagatgtagacaccggaattgcattgtctcctacacatcatagtcttctagaaagacttaaaaaaaaaatttgcaagttcctttcaggcccttctaagtttaaatttagtttaattcgtacatctgtgccttctaccccctaaaccagaaaggaacaaaggcacagagcagcagctcctttcatgggctgaaatgagcatgacacaatgctgacggaagcagcttaccggtggtgacgcgtttcttctgaccaccggagatccccctctgcatctggtcgccgacgatcgtgtccgcgcatatatccaatcccagtatctgctcccaagaaaattcagtcaaaaagaaataattttcaccagctccagttgctacttgcaaccgtcgggatcaagacagtttaaattaacatgactaattcctgctaaccccatgtcaagcatgggcttaatgcccctgaaagctactgtcacctgccccccccccccatccccaaaaaaaaaaaaaaaacacacatttcaaactttacctaccatccatcctgcccaatgtaattatgttactacgtggccagtgctcggaaactcgcagtaaagctgataagaagcagaagctttggctgggcatatcaacaaacatgtggtgggcatcatcaccacgggtgcgcgccatttccaccaggccaagtgggtgcaccaaccccccaatccccccttccaaagctacaaggatgccccaccaagaactcaattcgagctccatctcccaattagcagtaggtgaggaggagggaggaagaaaaagagggaagaaagaaccatcctttgtggtcaagacacaagagagtcagcaaacaaacccactccctcctgcctgctgctgctgctgctactaatcagtaggagaagtatgtgcccaagaatcatagtagtggacttggtggttgattggatccttgaaaaaaaaaagaaaaaaaaattccccttttcccatttggtgtgcagtgttcaccaacctgggtcatggttagtactagttgtttgcttgtggacaaatgtgcaaccaagtcctatatgatttgcccatgattgattggaattgggatggtttgtcccttgtgttttccaatgtcaagactgaatctttctttctttttttttttgccggtttgatgacataatggtgaggaaatcttgcgctaatcgcttgttaatccatgtgtgaatgatgttgctatcagcttaattttgtagtgtttctcccttgtgctttctctatcaaggctgaaccaatttttttttattggagaacataatgatgaggaaatcttgtgctaaattgtttgttgttaaatcatattatgtcaatgatgttactatcagcttaatttggagtattatggaagcgaaaaataataatagcaaattcaacaaagtcgtgaaaagctcattactctgagggtgtaatctgtctgaaggctgctctcgactccttccatcgaagtagcctgcaaggaggaattaatcattcgtcacgtaaacaaatcaaaattaattatcttcgaaacaaagcatagtttttcctctttttttttcgattgaaacaaagcataatcagcaactactatcaccactattaacaccccatgtggtacacgtacgtctaaccgattgtgagatgtcgttttcgcaaagatcgtgtttgtcattaaccctgctcgaatctcattttcataatttcatgtcctttacgaaggtacaaattgcacggaaaatatatagttagattcctgtggaaatttccagtgaccactgtatataataatacaaggaccatctgatttagaccctgcaaactaaagtgagtgtacttgtaccatgtgcggctttaattaagctgctaatcgaaatagtagtaattaatcactcattatcaacaaaaaaaataatcactccagttaattaattaattaccttcatgaagaggtcgacctcgggctccggccggatgccggcctccttctccctccttgccagctctgtcagaagatctgcacggtccatttcccatccaaccgtcaggattgatcgatcgaattaatcttgaaaaattaattaattatgggacaattgtcaggtataaatatagtattaattataatttggttacattatagctacaatacaatttatatataacttccaataaaaatcccgcagtgacacgctattttcgtgaaacggaggtcgtgagactgaatctcctcacccatgtgcgcgttattttttttcccctttctaacttgcatgaatcttaagataaatccaacggtttaaaattatttaaaaattaaattattgttaaatgtaagttataatataattacactcaacaataaaaaattatcgataaacgtacaacaaaattattaatagatcgttcatcatcatcatcatgatgagggtgcgagtaattgcacgtaccgtacttggtgccgacgccctggcacctggccgagaagtcgagcgtctccttgacggtcatctcgccgacgtgcacgtccgtctggctgatgtacgccgccgtcttctgcgccacgaactcctccagctcgaacccgttgtacgtcacctcgccgccgcgccggagcgacgggtccagcttcccggcgagggccaggaggagggtcgtcttccccgacgacggcgggcccagcagcagcgtcatccgggagggccggacggcgccggagacccccctgaggatggtcagcgtcgcctgccgccccggccggacgccgacgagccccagcgccgcctccgcgatgttgcgcgccgtgttcagcagcgtcggcagcgcgcggctgcccacgtggcacctcgcctgcaccatcagctcctcgaaccgcacctccaccgtcggcagctcgatgcccaccctgcacgcaccaatttttttctcacatttttcttaacaataagggaatgtttttttttttaaaaaaaacactcatgagttagttgaagtttggcatttcaccctataaagtcaatttgttgtaaatgcttactcctacttaattttcgttaaaaaaaatcaccttaacgtgcacgtgcttaattgagttaccatgtttttataaattatgaaccatcaatatagtctttaccaaaactaaatactttaagatcattatagtcacttttttttcaaaatgaaaaaaaaaactagagctgaaatattgccgggttaggttcctccgtatccatgaaaaatttaatgaaatataaaatcaatttgttgtaaatgcttactcctacttaatttctgttaaaaaatcaccataatatgcacgtgcttaattgagttaacatgtttttataaattatgggccgttaatatgttttttttttaccaaaactaagagtatagctagtcactttcctcaccatcgtacttctatacgttaaaaaaaaaaccacactagccaaagacaagtgtttttagtaaaaaaatggacccactaaaaaatgggatatatagaaaaactcaaccctataaaaccattcatccgtttttctccaaatcctattacagcacataggcatgataaatctctaacgttgctatagtctctggaagggtatccacgtatatatgtattaaataactgtttttcatattttagtatatttaccaccgaagtttagtccaaatcattgtgtcctctacctaaaaagtagtttaggtcaagaaaataatatttttatctgattggtcaacggagatatgtcactggctaaacggaaatggttggtgtgtgttacggttgatgctaccatgattggcattgactcattccatttggagcacgcaaggggatcagttgcaatgttagtttgggtgtcaactttagtttcagcaaacctactgccagggaccagcgacaggaagattgtgttcatttggaagtgcataaaaaggaggatcatacacatatgtgaaagctagttgctctcctaccccacataaaatggcacttttggtcaagaaattaaaattatattactcaatctaactgcttgtatagtgccatcgtatctgtaactgataaactaaagaatgtgtgctaaaactgaaattaatacatactttctccgttgcacaatttaagacttttagcattgtccacatttatatagatgttcattagcatatatatgaatataaatatgtgtaatgctagaaagtattacattgtgaaacggaggaagtatgtgtaaccagtaaatattaaaaggcatgtaataactaattaactaccagtgatactaatatgcacacacatcaccgggctatctatttgtcaactgactgatttttttctctcctcatgatctattgaattcctttttcaactactgaattaatatccaacaaataacatgaatatgcctttttttttctttcctcgtggaagtaaaagtgtaaagcaagcaatttcaaacttcaacctaaaaatttgtactttgatatgcacggttgccaatatgaaagtcaaaagtatactaaagttagccacaaattgtatataggttcattaatttgggaaataataatcaaatcaaagttacaatgagttcatattaagtttgcagctttcttaattgtgcaagaaaaatcaggcgaataataatagcaaaagtaaaataaaaaatcaatttgatttaagtgaacctactagtgttccaaaaggagccatgcacccatcatgttggaggccgaaaacagtcacaaaaaagggaattggcaaaggaaaaagagggcacacactggtgctgatatcatgcacacgtcagctgacttcattaaccataatatccagcacatgctgtttttcttcttcatcatataatttctcatcttttcatgattttgttttgcaggcagaaacagaaaccaaacatgttgattattaagaaagacatgaaaattaataattgaaaaaggtagtaggatcatcatctgctgctgcccagctgctcctgcgcccttcattccatcaaatcaatcaatcgctctctgcttcttggtgtattgccttctaaattagcttattcctactcctagtagcaactctctcaagtcccaaccacaattatgtatgcatttattcctaatacgatgtaattagaccgtttaatggagctatcccaactaaccctcccagcatctgtgagtcgcaaagtgcaagaaaaagcagtagtctgaattgaagattatattcgtcttgctgcatcagaaaaattaaagataaaacaaaaggaggcgccggccggccggctagttgtctggctgaaattgaatatgttctttttcttcgagattttgggtgttcaaatgtatctttccaaacgcatgcctatatatcttggcttgcaatatggtgaagatatggttggctcaatttcggccatagaaaaagggtgcaaagcttttgtgtggaagaaaagccaactacctgtataaatcatgcaacaacccatgtgtactcgtatagctacgtatcataactttatacctacatgcgtatttgtcctaaaaatatacgtttaattggtacttcctcttatgtagattgtagaagatggattaattaatttttctattattaaaaagtaaaccctttttgtcccctcgagctgagctgccttggactcggaccatcattgtttgactagtagtcaagaaaaattcacttcaaagctgcacaagctgtactcctatgtaatagaggattacctctgttttttaatatagacgttgttgattacatatattttttaaataaaatgaactgccaaacgtattttaaaagataaacggcgtcatatattaaaaaaaagagtaatttctttttcatatttcaaagatttttctttttacaaaatcgattaagtagctagcttaattaggtttgagattgtacccctccgtactataaaaagctaacataatatactgcatgtgatatattttaatacgttatactaaaatgtgtcatatctagtcatagattcgtttttcgtgaaacgggagagtaccttacagcagcatgcatgatgcatgtatggatgatatgagattatcagattaattaatccgttggagatgattaattaattactacatatgcgttaataataattagcgtacctgtcgatccggttgcgtagcttctgaaggaatcgctggttgtcctcctcggcgacgcggaaaacgcgctcgatgaactcttgcctctcgccgacgccgagccgccggacgtccacctccttgtactgctgcttgcctgctccggcggcggcggcggcggcctcttcttcggcgaagaagagaatgncggtgcgcatgcggctgtaggtggggaggcgctcgatggcggcccaccggagcgcctcctcgtcgtcgtcggcggtgccgccgcggccgctcctcctcctccccctgctgcccccgccgccgccggagttctgcggcatgaaggcctcgtcgacgccccacgcctccatccccatccccctcccgatgctccggctcatccgcctccccgactcccacaccttctccatcgcgctctccatatctctctctctctctctcagtttcgccgccgcgtcgcgccgcgccggcgagctgatgacgagaagctgtagctaggtgagagtgagacgaagcgcgcgtgtcatgtggtagtgatggcgccggcgagcggcggcggcggcggcggccggggcggcgcgggggtgggagtggtggagagagtggaagaggcgaggcgaggcgcgcgctttttatcaactcgcgcgcgggcgcgggtggttttctctacgtgggggttgtttttttctttttcttttttggggtttataaatagaagaagcggggtaggtgtatagctgttcaagaggntgtcatctaggcccg

SEQ ID NO: 78153 - DNA, 121260 bp, Oryza sativa
gttcgatgactatgctcatcaaactcttcaagccaaccatctctttggtaacctggtgaaccacattagtggctacatccaggggtcgaacgacttggattattctgagcacttcacacttcagaaagtcatataataatatgtggtggagaatgcgttaacgcgcaacggctttcgtgctagttgctcaaagaatcatataaaaatttataaagagtgaattccactttaggctaggtttagttacctatgttgcacattagaccaggcattaccgtattagtaagcctcttcacctagaactaggtattgttaccaattttgcaccttgtaccggtggcccacatgtcattggatcttccttctccttcttcctcaaaactccctgagcccaactctctatccacactggtgagctgagcttgtctcttcagccagtaccagcatatagcggccggccagctatcccctgagacctgctccaactcctattacacggccagctacagccttgcacaagtgctagcgagcacacaagatgaagaacaatgagattgaataattgaatcaatgcatgcacagggcagcctgagaatgggtgattgtacgaacggtgctggagcagagccactgcattgtcagctctcctctatttgcctaggacttaataatttcctccaaatcacaaatcgatcgagatcgtcgcgaccctcggcgaaggtcgagcgtggctgcagcgctaacaaagtttgagcgcgcttagtcttctcatccagcctcccctctctcacggtctcacctgaagtttgtctagagcatcaagaataaatggagatgaagcaagataacagaacaggagcatcggagcatcgcacaaggtgcgcgtcggcaagattcacttgagaacagcgccagtggaagaactggcccaaagtgaaacattaatgtaaacttttctgctccaaagtaaaaactgagttctatccctagtccaagttgtaacttaagtaaaatatagtggtccaatatgaaatttactctatagaaatcaagcaattaaaaggttatggaagtgcattggccatgggactgtaaatcctctttccttcactgggcctgggccctttgggactgttaaatcctctttccaaacggagtgtgtggtttgattccactttataacgatagcgagactgaacgaaagaaaagtgaaacgagacgagaagcaaagattcttcagtgcacgtgccccgctagcttgctcagctatgaaaacttcatcctcatggtcaaaaaggttcttcctcacaaacgtaatatagatggcgaatgactaactcaaaatattccactactaactaacaaggaataaataccaattaaaatgcgaaaaatacaaaatcattgccaataaatagatcttgattttagatgaatttagctgtaagtttcactagatttggacttaggatgagtgagttatgggtgtttaaagattcaaatttaatttaattcaaacaattgtgaaaacctactgtttgcatagttttcttttagtgtccgaattggttttataaaacaaaagaactctagtcactgataggtggttccaaagtatttccaattaatttgctaaatattttcccaaggggtataaaattttctaataatttgtaaatatttttccaaggggtttaaaagtctttatcattgacaagtggagcagggatcaaagtcgactgggtcaaattgactagtcaatagtctaatacccacatgtaagtgacacaaaacataaaaatatctatctatctataatcttctataataatatactaaacagtccattaacctcccaaaaccgctctcaaaatgccacgtggttccctcaaaacactctcgagttgtcacatggcgctcaaataaattattagagaaattcttaaaaattataaaaaacagaaaatctacccttaatttcagttaaatcggtgggtctactattataaaccattagattaatctatccaagaaaactaataccctaattccgcccacacatactttcgcggcgccgttgcccgtctcctctgcctcacccgcgtgcgtgtgtaatcctccctcctattttttctctatagtaattaagatttgcagcattattctgttaacatgagtaatttaaaatagtatattagatacttcatatctctcaagacgcctcacggggccaagggcatagacttccatcgttatatatagcccaatctgccagctgcaagaagtgtcttcatgcaagcatatatgcatgcgtggacatgcactacgtacaaataatttttaactttatgttgagtcgatttatttttagtttattttttaatatcctgacatttcaatcaattatttaaggtgtgtatggactatgattattgtcaaatggaaaaaaagtgcgagccatgtatcttcacgctttacattttactaattagttcctccggtttttcatagattgacgctattacttttttagatataaatttgatcatttattttattcaaatattttttttaaagtataaaaaatgtaggttatgtgaaaagttccattaacgataaaccaacttacaacaaaataaataaatgatagtcacgtaacttattaaatgaggtgaatggttaaatatattagtaaaagttaacaacggcatctattaaaaactagaaagaatataattcttaaaaaaaaataatatgcaattaggtgaaaagcccataacacaactgtcaggttacaaataaggtataccctctacccctggatatacgctatacatcgatatggtatatctgcgcgtataccgacgttctctgtatacgctaaggaaattcatcacggagtccacagatggaaagattcctatccggataggactgggtcgtcactgtatcgtataggtccgatggtccgatgtctctgggtcctactttgaaaccacctgacctgcggtataaaagggacccccgggaggacctaaggcatcgaatctcaccgccgagacaaccaccatagcctacgaagccggagcctacaggagccaagtcgccgggtgatctagtcgaaccaactcgactacggtctcgtcggtatcatcgagttccactgttccctttgtaatctgtgatttccatcatataatcccatatcaactggattagggctattacctaccaaggggcctgaactagtataatccctgttttctatttgcttgatgtcatattacgtagatcctcgtaccagcgtaccccaataccctctatatctggtctacgggtatcccccgtcgacaatggtgcaccaggtagggggacttggtgctcaaggttctactactatgtcgtcaagtctcgtcaacaacagcgtcgaccccagcgtcaacctaggagttccgactacaacaatgctggtgtggactcaagtcggtgaaatcgtcttcccggtttacaccacggtgccggtctcgactggtccatcaatgaccggaagcgagaatgtcgtggccataaccccggacgaccccatgtcgaaggatcctcccgcagtagcggagaacggaacgtcgacgacatccaagcccgaggaagatcctagtgtggccaaatcttgtccttccgacaagaatcacgagctgacaaggacaacttctgaggcgacaaggtcctggtgtcctattcacaaaactaggaaacacaccttgcaagcttgctgggtttttctcaacgcacaagctgacatccgtgcctgcaaagagagtggaatttagcgtacttctccaactcatgatgtctattgtctatccacaagacaaagaatcacgacctctcaagctgcaagattcttctcaaagccatgaagacgtagcctcctaaggtccagcactcacaaatctctcctagagatgtgaacaaggaacgaggagcgacggtcatctcagaccgattcgttggggtgatcgacattgatccccacgagccatcagtcctacactcgctcgacgaccagggttcatcgtcgacaagcacaccacgcgatgtgtttgctatcggcgggaccagcgcgtctgcgcgcgccgatgcggaagcagagaatcaagtggttacaccggctcagcacatcgggggcatcaacgcaatactgagggaaaccccttatgatcctgttctaaatgatgatctcgcacggtggacagaacggctacgggaatcagtgaccaacctcagcaacgcgttcgaggaggccgctgccacagcacacccaaaatagccgccagctggcggtgccaatggcgaaccacctgagtagcgggcctcacctcaacaagccacccctccaccccgcggcaccagcgatctccgtgaccatttaaatggctgtcgagaagcatgacgcgcgcaagacaacgaaaaccgttccagacatcgtctctcttcacgacgtcgagagaacgaagagcgaggaggacacccgagcgagatccgagaccgtgataaccgccacaaccgccacgaacgcgatgatcgcgaacagcggatgccgggtgatattggtcgaggacgccgccataacgatgacgatgacggagattgacgccgggacaacaacggtggacgacgacaggattcccgagaacccagacgtcatcctcggaatcgcacgccagagccgagtgactcatcgtcgtcgtcatcatcctcttcatcctcatcatcagatagacatccgcgaaggacagacgatcgccgacaacccaccgcccccagcgccgggtatagagctttcaaccgttcgctacgagatgtccgatggcctgagagattctaaccaggagcaacagagaagtacgatgggagtactgacccagaagaattccttcaagtctactccacggtactctacgctgccggagcagacgacaacgtgttggcaaattatttaccgacggcattgaagggttctgcgcgttcatggctgatgcacctcccgccctactgttcacgaaaaaaatcgaacacaccggcctgggagatctgcttagctcctatgcaggtccaaatcttgatgagatgcgggcgtgccagtcagtttgatcctgcaactgacaagatatgcaaatagtagatcaaaacagccaatcggctaacaagccgatggagtagttccagccgatagccgacaatagcccatgccgataccagccgatagtgatagggtttaagcaatcggctatatatccaatgtagataatgataaaaaggcagtcggctgatgatgatgtaatgaaataacaatataatccagtataaaccaatcggcaaataatgatatgataaataagcatccatccgaaggttaaagcacacatcggctggaagtccaatgtcatgaaatccacaagattagattaaacagtgaaacctttattgtcatgggctaaatccaacttatatgtatatgcaatccttatgagccgatgcaacatacagataactcaccggctgaaaccccgatgaaacccttattggcaatcaagaagcaggctagagattatggttctaagtatgacttagtagatcaaacttaactgatgcagcactaagtatgaaaagaatcataatatccagacaatcaagccgttgactgattttcagggtggtagatgtctaaactaatctaatatagcaacgcgatttagccgataccggcagaaaccctaaaacgagaagcagccgatagagctaaattgatatgctaagactagattaacaaagacatatgataaatggttaggcaaatatatcatccaaaccagagcaatccaagaggtcgaatgtattgatgcagccttgaacgacgccgacgtagacgatataattgcctgggccgacggaacattggacttatccttgcgccgttgatcgaagacaatgcagcaccgcgtcgggtgccaagttccgcctgaacgtaaaaacaaaagtagaagtaaaaagggtggcgatgcgccgaattgtattgatcgtagcgatgattacatagaccccgggtgtacatatttatacccatgggttgatacaagtccttgtcggccaagaaagaaacgttcctaaagataaaaggaaaagataaagtccttatagcacactaaacacactttcctaaagataaaaggaaactaacaaactattcctaattaatagataacttgccatgccgcattctctttgaactcggtctcttctggataagcttcctttagtagatcaatttccttaaccgaatatagcaagaatccgacaactaacggcttgacaactctcatcggctaatctcaagacttcgaagccgatgctgactctaagccgatgttgttcctccgttaaattctccactgtgaccatgatcttggcattgacttcttcttcagacatgtggatataaaactcgtgtcccactgggcgtgccaatttgtgttgacgaaaaaaatcgaacacaccggcctgcttagctcctgtgcaggtccaaatcttaatgagatgcgggcgtgcgagtcagtttgatcctgcaactgacaagatatgcaaatagtagatcaaaacagccgatcggctgacaagccgatggagtagttctagccgatagccgataatagccgttgccgataccagccgatagcgatagggtttaagcaatcggctatatatccaatgtagataatgatatagaggcaatcggttgatgatgatgtaatgaaataacaatataatccagtataaaccaatcggctttaatgagtgcagaaatacaaaccccgaaatccccgatgcctctgtgattcgtgctttcaaaaccggtgtcagaaatcgctatactacccaggagttggcaacaagacggatcacaactactcgaagatttttcgagatcgtcgatcgatgcgctcatgcggatgacgcactttgacgcaagaacgacaagccgaagttggggggagagaagaaaccagccaaggacgcacttgaaccaagcaagaagaaaagtagcaaaagtgggaaaaggaaagctcaagcggaagtcctcgcgtcagaatacaagcgccctcccaagcacccagacccacaaggcagcgacacgaagagaatatggtgccctatacacaagtcggacaaacattctctagatgattgcctcgtcttcaaaaagtcgctggaaaagcaactggcattggagaagggcaagcgagtacgagtagtcgagaaggccactgaggcaaccactcaggacttggactcggcatacctagattccgatctccatgtctcgcacatcttcggaggttccacggcgtactactcaaagcgagaatacaagaaaatggagcgtgaagtttgttcgacatggcagggggccgcacccaagatgaagtggtccgaacagaagatcgagttctcagatgaggaccatcccaaggctgctatcatcccaggacgatatccgatcgtggtcgagcccactattcggaacatcaaagtcgcgcgagttctcatagatggtggcagctccatcaacctcttcttcgcctgcaccttggatgtgatgggaatcccacgaagcgagttgactcccaccaatcaacccttccatgggattactcctcagtcgtcgtccaagccattgggcaaaattacgttgcctgtgactttcggccaagcaaataacttctaaacggagcatatcacctttgatgtcgctgaatttgatacagcatacaacgccatcatcgggagaaatgcactcgcgaagttcatggccgcatctcactacgcgtatcaagtgctcaagatgcccgggccgaaaggaacaatcactattcaagggaatgcaaagctggcggtgcaatgcgacaagcggagcctcgacatggtcgagcacactgccagcccacccgccacagctgagccacccaagaaagtgagcaaagcaagcaagacgccgaaaccagacggtgcaatcaagatcgttccgctctccagcgccaacgccgacaagaccgtcaagatcggggcatcactgggcgagaaataggaactcacgctcatcaccttcctccgcgacaatgcagacgtgttcgcttggcagccgtccgacatgccgggggtacctagggaggtgattgagtacaaactcatggtgcgacccaatgccaagccagtaaaacaaaaattgtgaagatttgcaccagatcgaaaacaggccatatgagaagagctcgacaagcttctcaaagctggtttcatcagagaggtactccacccagagtggctagccaacccagtcatggtgcggaaggccaacgggaagtggaggatgtgcgtcgacttcaccgacctcaacaaagcgtgcccccaaggatcacttccctcttcctcgaatagaccaactggtggacttaacagttggttgtgagttgttaagcttccttgacgcttactccggctaccaccaaatcagcatggcaaaagaggacgaggagaagacagcattcatcacgccgttcagtgtattctgctatgttaagatgccgtttggactgataaccgcaggaaacactttgcaacgcacggtccaaggggcacttaacgatcagcttgggaataatgtcgaggcctacatcgatgacattgttgtcaagaccaagacaggcgactcattgattaacgatctacgggaaacatacaacctctgacgatatcgcctcatactcaatcttgagaagtgcacgttcggagtaccatcgggcaagctgctcgggttcctcgtctctggcagaggaatagaagcaaatcccgagaagatcaaggcaatcgagaacatgaagtcgcccacaaggctcaaggaagtacagaagctaaccggatgcatggcggcactaagcaggttcgtcactaggatgggagaacgaggacaaaccttcttcgctctgctgaaaaaacaagacaaatttgtatggacacagtaagccaaagaggcgttcatcgcactcaagcgctacctgtcaaacccccctgtacttgttgctccccaacctaatgaagaattattcctctatattgccgccacgccatattctatgagtactgtcatcgttgtcgagagagaaaaggtgcaaagaccagtctactacgtcagcaaagctctccatgacgcgaagacaagatacccacagattcaaaaactgctctatgcagtaattatgacgtcaaaaaagctacgccactacctccaagcccacagggtcacagttgtttcctccttccctcttggtgaagtcgtgagaaacaaagatgttgccggccgcattgcgaaatgggtagtcaagctaagccagtttgatgtccattttgtgccacgaacagccatcaagtcccaggttctcgccgatttcgtagccgattggactatgccttaaaacaggttagacagtcaaaccgacaacgaaatgtggacaatggcgtttgacggcgcactcaatagccaaggagcaggggcagggttcatcttgacatcaccttcgggagatcagttcaagcatgcaattcacctcaacttcagggcgaccaataacacagccgagtacgaaggactactcgctgggataagagctgcagctgcacttggagtcaagcgactgatcatgaaaggggattccgaactagtcgcaaaccaggtgcacaaagactacaagtactctagccccgagttatccaagtacctcgctgaagtcaggaagctggaaaaaagatttgatggaatcgaggtctgacacgtataccgcaaggacaacatcgaaccagacaatctggcacggcgtgcgtctagacgggagccactcgaacccgacaccttcctggacgtcctgacaaaaccatcgatgaaagaagcaaacgacgaaaatagcacagtcgcacccgacatcagctcgagggcaacagaggcagaatgcaccgttgctgacatcgagaccacagacgactggcggatcccactaattaaattcataagtagcgacgcgctgcctgaggacaatgcagaagccaagaaaataacccgtcaagccaaaatctattgtatgatcagcaatgatctatacaagaaggcgccaaacagggtacttctcaaatgcgtctcgtccgacgacggcaaacacctcctcctcgacatacacgaagggatctgtggatcacttgccaccggtcgtacattggtcggaaaagcctttcgacaaggatttttctggccaactgccctcaaagaagcttgcgacatggtacaacggtgtgaagcttgtcaattttatagcaaacacacaaagctaccagcacaagcactgcaaaccatccccctcacttggccgttctcgtgctgggggctcgacatactcggaacattcccacgaggacaaggcagctacaagttcctgttcgtggcgatcgacaagttcaccaaatggatcgaagcaacacccatgggggaaattaaggccgacaacaccatcaaattcattaaagggatattttgcagatatggattgcctcaccgcatcataactaacaacggctcccagttcatcagtgccaacttccaggattactacattggactgggagtcaagatctgcttcgctttggtctctcaccctcaaagcaatggacaagtcgagagggcaaacagcatagtactacaaggaatcaagacccgtgtctacgacaggctcatgtcacatgacaagaagtgggtcgaagaactcccctcggtactttgggccgtgcgcaccacaccgacaacgtccaacaaggagacacctttcttcctcgtgtacggctcagaagccatgcttcccactgaactgcaacatcagagtacacaagtacagaagtactccgccaggatcaggaggagtagcgaggcgacgatgtgaaccttctcgaggaacatcgagaatgagttgccgtcagagtaactagctaccaacaggcccttcgacgataccacgagaagcgcatccgagcatgcacgctttcgatcggcgactacacaaaggcacaaaggcagttggaaccgacaaaagttttacaaaccatgattaattaaggagtacaggcgaaccgaagtcctactcttcaaaaagtgggagaacagactctcccagattaccgacttcttccatcacatccttacgcgcgtcgttagccgccccctgatccaagatcctctagagatcgagttcagggtgcgccaaccttacgcacgcgaggatgtgacacgtcccggtgtagatcccgtttgacgtctcctccccgatcctggccgcatgcttggaggggatcgcctccatcatcatcgctagtttcgcgagcgaagtcatcagcgagaactcatcgggattcaccgggatggtggtcgtgacactgcactccccggtgagctggtgcaggccggtgtaggtaacccgcagcgagccacggatgtccgacaggttgttctcgagcttcgacatgcggtgctcgagcccctgccattgccgctcgttgccggccaccagctccctcatcttctggaggtcctcgcgaacctccgccaggtaacgcgccaacttgtcggcgcgttcgttcgccgacgaagccgccgccgccctcgccgccgcaatctcgcgacctatgccacgagcgccagcctggaggatgcgccccatctcgatttggagctcctcccaggtgaggacgtcagcgggtgggcctcgagcaggcacaaggtcgccggcagggccgctgggcgtcgcctcacggctcctgggcacgaccacgacatctgtcaaggccactgcaggagacgcactagagttccctccagacccgtcttgtgccgccttcgcccacaccgccctatgaaaaattcccgtaatggccatcaagacgagccgcctgaattcgatgaatcaaacgacctcaaactcgtcaacttacttctcgccaagtgtcaccagcctctgccgtcgcggaggtgggggagacgcatccgaggcctaagtaaaccgagtacggtgtgaggacaacatcttccaactacgcaatcaataaccaaagacggcttaccgatggagtgggtgctttccgacggttaccgagcacggaggaaaacttcctccccttcttcggaacggtgccgccactggtcgtggcagcaacgggggcaacatcggacgcttccttggcgacgtcctccttcagcgatgccgccgcctggtggtccacgagcggcccgatgacgtcagttagagggagagcctgcactacatgaagtcacgatgcgatcctggaagaaaaagagaaagggtcatcgagtacactcacgttgattgcagcttcgccctcagctgcccctttctcgcaaagaggggcagggacgttgctcgccatcgtggggccgctcatcatcacctggccaacacggcgctccacggtttcgctgttcaaacctatagatcaagaaccagattttgataagtcaggaggaatgtatgcataaggaagggaacccagaatgcaagaaaaataccccgaggagaaacccgggtcgcgtcctccgacccagagtagtcagaggctgggtgggctcgagcctggagcggctggatccgcctaccaatgaagtcggcagcgacttcataccccgacaacccacgtactcggaggtcattgatgatatcgatgaatgactgaagtgtaacaccctgaaaattcgaccaataaaaacaaaactctaaaaatgcggaccttcgaaaactttttaaattaactacatcatgccgattctattcgcctattttatttggatttgatttcgaaattcattagtcgtgagtaaagaatagttaattacgaataaaccctaaaaataaattggcaaaataaatataatttaaaataaagattaggtgaggatagaaataaataaaatattatcgcgaccataatggtaataattaaatttaagtgcgatggagcaagaattaaccctaattaaaaattcaaataaattatataaaaataaaatatgggtaatattaatttagggtgaatttttagttagaataacacaaatattgagtaaacttcatttatgcaaaaattagaatttatagggctatatttaaatagaaaataggataaaatcgggataaataggaaaagtcactattcattgcccgctaggtgcacgagtgcgtcccctagccttccccctcctctgccacaccgctcctagccgtccttgtgccccgcgccgccgtgggccgtcaccgtcgccatcgccttgctccgccgctgccgccgcgcgccgtcgcgtcatctcgtgccccgagccgccgcgcgccgtcgccatcgccgccttgagcccgtgtcgccgcccgtcgcgtcgccgcccatcgcatcccgccccgagccacgtgccaccgctgtcgccatcgccgtcgatgtcccgtcgccgcgcgcgttccatcgccgcctcgcgccccgcgccgccgctgccgcgccgtcgctgtcgccgttccgtcgccgcgcgcgcgtcccatcgccgcctcgcgccccgcgccgccgcgccaccgtcgcgtcacccccttcacttccctctccccccttatcccctctctcccctatataagcccaccattctcccctctccaaactccattccctcctcctctcctctacccactacaccgtgtcgccgttgtgccaccacgccaccgccttcgcgccgccgcatttgagccgccacgccgccgacctcggtgacgccgcaccgcaccgagtgccgcgccacgtcctgcgccgccgtcaccgtcgtcgccgccaccaccgccgccggtgagctgtctcctccccccctcgcgcacaccgccgttgccgcccgggtgagcaagagccgagagagagagaggtagaaagaagccgggagggaggagagaaaaagaaaagaaaggaaagggagaaaaagaaaagaaagaaggagagaaaaagaaaagaaaggaaagaggagaaaaagaaaagaaagaaaagaggagagaaaaagaaaaggaaaaataaatagaaattagtgggagattaaggaagtttagaaaatttaaaataattagaatttaattatagattaattatagtcgtagaattgcaaaatttaatataattatagattatttttgggtaatctctataagtaatcgattcacggtagaaattcggatttaattactaggaattttagccgtgtattatatttaatcatttagtcatagactaaattaaatcgtgcaatattataagataattttaggattttgtccgatatttagctcgcgatagaaatttctaacctattatatggatgtaatacccgggcggattaaattaaaaacttgtgctaataaaatatttatgccacaaaatagtttggggatggatagagttaaatagacggagtagctctatttcacgaacgaaaatagataatgtatgaaaccgacttccgcgctcgatatcttcttggatttacttggatctttatttgaattctaaccgaattcaaattgtttcttcgcatgtaattttagagcccgagggagttgcggatccgagcgaggaccaagacccgcaaagcttcgagcaaggcaagtcatcactattctttgaacatgttgatcccaattgtgaaattattttgtttacaaataaattgcatgcaatgatgaacatcctacttgtgattatgccatgccttggttcttgtttaccccttatgcctttgtaaccatttacgtatgagtccctactcagttatgacaattgcttagaaatgctattctagaatcatgcatactcatatttatcaaatgctatatgcttgggcaattacctttgggaaggtaattgagatgcagcatgtggggacatgagcgccacattgccatgatgttgatgacatgatttgtgaaaggagaaatgaaattaaacaactattttcgactggggcggacggaggatttgggtggtatccggaaaaggctagtgccatccccggtcaattaaggaccgagccatgaagttaagcatgaaacgacccccgtacaaccgcacttctcgtatgggtatagacctagcggagtagatagctgagcggaggcagtatccatgcatagtggtttcttgttatgtgaggcaggggctctatggtggggcagccattggtaggaccgcgaggcgggtgtctacagtggtgtcgctgtcggtaggactgcaatgtgagaatctaaacgtaattataacttaatgcatgtgtgagtcttcccttcccgggtgcaccagaactcctctcactgctagaaaccgtgtacgcctagagtgcatgaggatgtaaagttcatggagcgggtactgccaatgcgaggttatcgaaaagctttgccgtgacacgtctcatgtgttgggatgaggctcatgtgttgggcagtcgcggagtgcgggtaaagtgtacatccactgcagtgtgagtaaaccaaatctattcgaatagccgtgctcgcggttattgagcactgggacatgtattacacttggctagactctaaattcttaacttgtgtgggatgggatattgcatgatgatttctatgctgatggagccacttcctgaggggcgggaatgtggacgtcctcagaaaaccatgacgactcaatagcgggaagctatccttgggatcacaatggatggtggacagaaccgtcattgtttaatatgaacactggtactaaaatttgatcagtctgtgctaggtctcaggtttgtgaaaagaattacaaaacttgctttgcgcaaaagaaccatagccatcctttgaatacccctgtcatgtgcattgttgctgtggtggcttgctgagtacggttggtactcacccttgtaatatacaaacttaatcagaggtcggagatgaagcttcggaggatccctacgcttactaccaggagggtgatggagacgatggcgctcagtaggtcttagttacggtcgttgcctgtggcaatggcgtgccgctgccttgactccgctgccttacctacttctgtttttggaatgtattctagaccgctcggtccgatgatttgagactatgcctgcgggcttatgatgtaataattcgcactagactctcgtgtatgtgcatttggtatttcagctatgaactcgtgtataccagactacttgatccagggaaatggtactgattacacgatagattcctgttataaaaacaggggtccacagagttggtatcagagccatacgactgtaggaaaagaccaaaaggcgccccaccccttttctaagattggccaagggagaaattcccatttagtaatactttcaaaaataaaaactctatgtttacaaaactctgtacgattttcatcttactcttaactactttcttcacaaaacaagttttactctcagctgactttgggtttttcttaaaattagatggcagatcaagattcacccaccacctgggagatgggcgtaccccgctcagagggatacgtcatagagctacatcgggtgatgaggcgccttcggtaccccagatttccgatctaccgagtgagacaatgtggacccttttgggagggccggattgaggttcatccgcgagtcccttcagagtcagactacagcttctcgacacgccaccgtcgtgacttaccggagaccgcgatgcaggacgcagcccgggaggccttcctctgacttagttctattcactgggcagagttagcgagtaccgagtttgctcaccatccgtttcgggaggagagcaactctgtctgcacagttcaggacataccttgctgctataacccgatggtgactcgactgtcccgatgggctgaggctgtggacgacttctacgaggaggccctgttggagatcgacgaccagcagaggcgtatgggagagttggagaccaaggtaactgacctcacagcacaacagcttcagctagaggaggagcatcaggcttggggcagcgagatagactcgctgaaggcacagctccaggtccacagcgaccagttccagcagctatctgatcagtacaatgatcgccgcgggatgatggatacactcgaggagcagctgagagagagtcaggagcacgtcagccagcttgaggagcagcttcgagcagctacagtcagcaccacaggagcttctacttccacaacagtagggcgtgaccgctacttcttccttactccgccgtacccaccagcgttccacgctcttttgggagaggttaatatggtagccaccgagtcagcaccttacctggtggaccagacagtgacacagccacctgctccagagattaggaacaccccactgatctccacttcttcaccgcagccagggtccagtttagagactccgattcaggtcgactccgagacagaggggaccgacaccgagccagagatagagccggacatcactgatccttcagaggacgcgactcctgtcccccgcattaccttcatcggaggccctcgtaccctcagcaatgcccgcaagagcacacgacctccgggcaagaagcccaagccagatttagaggccactacttccgagccgtggggactcaagtttgcacgagccagcgaccaccctcttcctgccccaggatcctgcggatggttggatgactagactggaggacttttgcagcttcgatctcgcttcagatggtttttgggtagcatgcgagacacacacacccccttacctagattgacgagtagcttgatgattagtcgatgtatcttttggatgaactttatttggactgcgtatatgtgcggtcgattgcatcatgatttatgtactatctgtggaactctgcgatgttctttatgatgttgttactgttgtgttatgaatgagtttattccaccatgcttgcaaaacaaacttcacatcaaaacaactcccttaatgggataaaaccataagagctagttagaaaattaggatacttacttaatcggcctacacagatggcaagccgacgtcgggcgtcaatcagcaatgaagaaactcaaacacctgacctaaccaccctggccggagttatggccactcaaacccaacttctgcaagccattgcaaacaaccaaggcaaccgcggacgatcaagctttggagagtttatgaggaccaagccacccacgttcactacggcagacgagcccatggaggcagaagattggctacgcatcatagagaagaaactgactcttgtccgggtacgcgaagccgacaaagtgatcttcgcagtaaaccaactggagggacccgctggtgataggtgggatacttacaaggaagctcgggaagaggatgctggagaacccacttgggaagagttcactgcagcatttcaagagaacttcgtgcctgctgcggtaatgcgtatgaagaagaacgagtttagaaggatgcgacaagggaacacaacggtgcaggaatatctgaaccggttcactcagttggcccgctatgcaattggagacctcgcagatgaagaggaaaagatcgacaagttcatagaagggctgaatgatgaattgcgcggacctatgattgggcaagaccatgagagcttccagagcctgatcaacaaagtcgttaggctggagaacgatcaaaggactgtagagcacaaccacaagaggaggcttgctatgaatcgcccacctcagggagtgcctcagcgactcaagggagccacttcgtctgggtggaagccccctattgtggcacccaaccgtcccgccgcgcctagtaatttcaacaggccggttgtgattcagaaccgcacccctacaccaactctggctgcccctggagccaagaagaatgtggactgcttcaactgcggggagtatgggcactacgccaacaactgccctcatccacgcaaaactcctgtccgtactggcgctaatgcaatgactgttcgtggaactactacccctgctgccggacgaggtctattcaagactccgcaaactaacaggaccgctaccggatttggacgcggacaagtgaaccatgttcgagctgaagaggcccaggaagaccagggcgtactaatgggtatgttctctatcaattccaccccggttaaagttctcttcgattctggtgcatcgcattcattcatatctcggaaggctagtcaaaagcacaacttaaccctagtgggacttagaaagcctatgatagtacactcacctgggggcgagataactgtgagtcatgcttgcatagacgtacctattcgtcttagggatgtggtgtttccctccaaccttttggttttgatacctcagaccctggatgtcatattgggtatggattggttgacgaagaacagaggagtaatcgactgtagacgtagaaaagttaccctgaccacaccctggagatcggatatgagagcaaccatggatcaagatcctagactaatcgaacgtgccggaggcatatttaccatgctacccctgaaaggaatgcccatagtgcagcgatttcccgatgtgtttccagaagatttacctggaatgccaccagatcgtgacatagagttcattattgacctgatacccggaactgctcccatatccaagagaccttatcggatgccagtcaatgagttggaggaacttaaaaagcaaatcagagagttgcaagagaagggatttgtacgtcccagttcgtcaccttggggagccccagtgttattcgttaagaagaaggatggtagcatgaaatgtgtgtggactaccgctcactgaacgaagtaactatcaagaacaagtatccacttccacggattgatgatcttttcgatcaacttaaaggagctaaggtgttctctaagattgaccttcgatcaggataccaccaattgaaaattaggaccggggatgtacccaagactgcgttctcaacacgctatggattatatgagttcacagtaatgtcgtttggattaaccaacaccccggcatactttatgaatcttatgaacaaagtgttcatggattacttggacaaatttgtggtagtattcatcgatgatattttaatctactccaaagacgaggaagagcatgtggagcacttgcggttggtactcgagaaacttcggaagcataaattatatgcaaagtttagtaaatgtgagttctggttaaaagaagtcgcctttctaggccacgtaatctcagccggtggagttgtagtggatcctgctaaagtggaggctgttacggaatggaaagcacccaaatctgtgactgaaattcggagttttctaggcttggccggatactaccgaaggttcattgaggggttctctaagataacccgaccaatgacacaactactcaagaaggaaaagaagtttgtgtggtcagaacagtgtcaggaaagctttgagcagctcaaagaaaagctgacctcggcgcctattctagttcttcccgacatcaggaaagactttgttatatattgtgatgcatcaaggcaaggactggggaggagtactgatgcaagaaggaaaggacgtggcttatgcatcgcgacaactgcgaccacacgaggaaaattaccctacccatgacctagaactagcagtcgtggttcatgagctaaagatttggagacactatttgattggaaaccattgcgatatctacactgactacaagagtctgaagtatattttcacccagtcagatctcaacttgaggcaaaggcgatggttggaactaatcaaggattatgatctagaggttcactatcacccaggcaaagcaaacattgtggccgacgctttaagtcgaaagagccattgcaatcatctgaggatggaagggataacccctgaacttaaggaggaaatagcccaactgaatttacatttagttccttatggtcaaataaacaccttggacatccagccccttttgaggacccagatagaggaagcccagaaggacaacggagagatccaagaggtgaaggagcgcatagccgctggttgtgcgaaagaattctcaattgatgagaaggaaacactatggtataagaagaggatttacgtacccgaacagggtggactgaggggattaattctaagggaagctcacgaatcagcatattcattacaccccggaagtacgaagatgtaccaggacctgaaggaaggatactggtggcccaacatgaaaagggatgtagcagaatacgtagcactctgcgacgtatgccagagggtgaaggccgagcaccagcgaccggcaggtttgctgcaaccccttaggattccagaatgcaaatgggacgagataggtatggactttatcgttggattgcataagaccgcaactggttacgattccatttgggtaatcgtggaccgactcactaagactgcaaggttcatccccgtcaagacaaattatagcggagccaagctagctgagttatacatgacaaggatagtatgtcttcatggtgtgcctaagagaattatatccgatcgaggcacacagtttacctcgcatttctgggaaaaagtacatgaagccctaggaagttaccttgcttttagcacagcttatcacccacaaacagatggccagacagagagaacaaaccaggtcttggaggacatgttgagagcttgtgctttggattttagcaaggattgggagaaatgtttgccctacgccgaattctcctacaacaacagtttccaagcgagcctaaagatgtcgccaaatgaggcattatttggtcgacgatgtcgtaccccactaatgtggtccgagactggagaacggacggtatttggacctgacattatccaagaagccgaagaaaaggttcgcctaatccgtgaccgtctaaaagtggcacaatcacgacaaaagagttacgctgacacccggagaagagatctagaatttaaggaaggggattatgtatatctgaaggtttctccgatgagaggtacaaaaatgtttaaggttaaagggaaactagcaccaagatatgtgggacctttccaaatcatcgctagacgaggagaagttgcatatcagttacagctaccagaaaatatcgctgatgtgcacccagttttccatgtgtctcaattaaagaagtgcttacgagtgccggaggaacaagctccgttggaagaaattcatattagcaatgatctcacgtatccagaacacccagtccggatattggatgaagcagaaaagaggactaggaccaaagtgtggcgtatgtacaaggtacaatggagtaatcatactgaggatgaagccacttgggaaagcgaagaattcttggagacagaatacccgcatctattcgaaatccgataagaaatctcgggatgagatttatttaaggggggtaggtttgtaacaccctgaaaattcgaccaataaaaacaaaactctaaaaatgcggaccttcaaaaactttttaaattaattgcatcatgccgattctattcgcctattttatttggatttgatttcgaaattcattagttgtgagtaaagaatagttaattaggaataaaccctaaaaataaattggcaaaataaatataatttaaaataaagattaggtgaggatagaaataaataaaatattatcgcgaccataatggtaataattaaatttaagtgcgatggagcaagaattaaccctaattaaaaattcaaataaattatataaaaataaaatatgggtaatattaatttagggtgaatttttagttagaataacacaaatattgagtaaacttcatttatgcaaaaattagaatttatagggctatatttaaatagaaaataggataaaatcgggataaataggaaaagtcactattcattgcccgctaggtgcacgagtgcgtcccctagccttccccctcctctgccacaccgctcctagccgtccttgtgccccgcgccgccgtgggccgtcaccgtcgccatcgccttgctccgccgctgccgccgcgcgccgtcgcgtcatctcgtgccccgagccgccgcgcgccgtcgccatcgccgccttgagcccgtgtcgccgcccgtcgcgtcgccgcccatcgcatcccgccccgagccacgtgccaccgctgtcgccatcgccgtcgatgtcccgtcgccgcgcgcgttccatcgccgcctcgcgccccgcgccgccgctgccgcgccgtcgctgtcgccgttccgtcgccgcgcgcgcgtcccatcgccgcctcgcgccccgcgccgccgcgccaccgtcgcgtcacccccttcacttccctctccccccttatcccctctctcccctataaaagcccaccattctcccctctccaaactccattccctcctcctctcctctaaccactccaccatgttgccgttgtgccgccgcgccgccgccttcgcgccaccgcatttgagccgccgcgccgccgacctcggtgacgccgcaccgcaccaggtgccgcgccgcgtcctgcgccgccatcaccgtcgtcgccgccaccgccgccgccggtgagctgtctcctccccccctcgcgcccaccgccgtcgccgcccgggtgagcaagagccgagagagagaggtagaaagaagccgggagggaggagagaaaaagaaaagaaaggaaagggagaaaaagaaaagaaagaaggagagaaaaagaaaagaaaggaaagaggagaaaaagaaaagaaagaaaagaggagagaaaaagaaaaggaaaaataaatagaaattagtgggagattaaggaagtttagaaaatttaaaataattagaatttaattatagattaattatagtcgtagaattgcaaaatttaatataattatagataatttttgggtaatctctataagtaatcgactcacggtagaaattcagatttaattactaggaattttagccgtgtattatatttaatcatttagtcatagactaaattaaatcgtacaatattataagataattttaggattttgtccgatatttagctcgcgatagaaatttctaacctattatatggatggaatgcccgggcggattaaattaaaaacttgtgctaataaaatatttatgccacaaaatagtttggggatggatagagttaaacagacggagtagctctatttcacgaacgaaattagataatgtatgaaaccgacttccgctctcgatatcttcttggatttacttggatctttatttgaattctaaccgaattcaaatcgtttcttcgcacgtaattttagagcccgagggagttgcggatccgagcgaggaccaagacccgcaaagcttcgagcaaggcaagtcatcactattctttgaacatgttgatcccaattgcgacattattttgtttataaataaattgcatgcaataatgaacatcctacttgtgattatgccatgccttggttcttgtttaccccttatgccttcgtaaccatgtttacgtatgagtccctagtcagttatgacaattgcttagaaatgctattctagaatcatgcatactcatatttatcaaatgctatatgcttgggcaattacctttgggaaggtaattgagatgcggcatgtggggacatgagcgccacattgccatgatgttgataacatgatttgtgaaaggagaaatgaaattaaacaactgttttcgactggggcggacggaggatttgggtggtatccggaaaaggctagtaccgtcccctgtcaattaaggaccgagccatgaagttaagcatgaaacgacccccgtataaccgcacttctcgtatcggtatagaccaagcggagtagatagctgagcggaggcagtatccatccatagtggtttcttgttatgtgaggcaggggctctacggtggggcagccattggtaggaccgcgaggcgggtgtctacagtggtgtcgctatcggtaggactgccatgtgagaatctaaacgtaattataacttaatgcatgtgtgagtcttcccttcccgggtgcaccagaactcctctcactgctagaaaccgtgtacgcctagagtgcatgaggatgtaaagttcatggagcgggtactgccaatgcgaggttatcgaaaagctttgccgtgacacgtctcatgtgttgggatgaggctcatgtgttgggcagtcgcggagtgcgggtaaagtgtacatccactgcagtgtgagtaaaccaaatctattcgaatagccgtgctcgcggttattgagcactgggacatgtattacacttggctagactctaaattcttaacttgtgtgggatgggatattgcatgatgatttctatgctgatggagccacttcctgaggggcgggaatgtggacgtcctcagaaaaccatgacgactcaatagcgggaagctatccttgggatcacaatggatggtggacagaaccgtcattgtttaatatgaacactggtactaaaatttgatcagtctgtgctaggtctcaggtttgtgaaaagaattacaaaacttgctttgcgcaaaagaaccatagccatcctttgaatacccctgtcatgtgcattgttgctgtggtggcttgctgagtacggttggtactcacccttgtaatatacaaacttaatcagaggtcggagatgaagcttcggaggatccctacgcttactaccaggagggtgatggagacgatggcgctcagtaggtcttagttacggtcgttgcctgtggcaatggcgtgccgctgccttgactctgctgccttacctacttctgtttttggaatgtattccggaccgctcggtccgatgatttgagactatgcctgcgggcttatgatgtaataattcgcactagactctcgtgtatgtgcatttggtatttcagctatgaactcgtgtgtactagactacttgatccagggaaatggtactgtttacacgatagattcctgttataaaaacgggggtccacatgaagggatggggtcaaggcaggcttggcggtccaaaacggaatcttgtctagttgttcctcagggacaacaaagattggatccaaattttctatctgaagatagaaccacctcgcccgccatttgctacgagaagaggggcacttgaaggggatgtatcgcgacttcaggccatcccgaagtcggaaactaacacacccggacacatttttacgttccatccagcgcagctcgtagtagaaacgaaagagatcaagaaacagctctaccccaatgtagacctcacaaagatgggaaaagatgctgaggaaggccatggagttggggttcagatggagcagagaaagaccgtagaaattcaagacgagaaggaaaaactcagaaggcggcgggagaaaaccgcagagaatgtagtcctcaaccgcaaccatgcggcccaggacaggttcaggttcaatacctcctggttccctctccatggtcccgcgaccggggagagcgccttcctcctgcaacttcttcagggacgcgctggtggaagtggacttgtcgaggtccattgccgccggagatcaccggaggagggaccaagatgagcaagctagggtttgtgcgggagcggagaagacgaagagcgcttggaggctaggaagtttttgcaacaggcgggctccaaaatggatccccaaaactcccttaaatagacgcactaccgacgatgcgaattccaaggaaaggagagagatggccgccggaaatttctgggtccgttacacgcggcagtttttggacttcaatttaaattcactcacgaccgttgaacttcgcatggcgtcgtcgattactccttgtctctacggtcctcacgccgagatcgaccagtcgagaacgacaacaaacccgacatcagaagtcgcgatcggttacatgagttcatttaagcagaagtcaggggctactttcagggttacgaataaggtataccctctacccttggatatacgctatacatcgatatggtatatctgcgcgtatacggatgttctttgtatacgctaagaaaattcatcatggagtccacagatggaaaggttcctactcggatcggactgggtcgtcactgtatcgtgtagggtccgatgtctccgagtcctacttggaaaccaccttacctgcggtataaaagggacccaccggaaggacctaaggcatcgaatctcacagccgagacaaccaccatagcctacgaagccggagcctacaggagccaagtcgccgggtgatctagtcgaaccaacttgactacggtctcgtcggtatcatcgagttccattgttccctttgtaatctgtgattccatcatataatcccatatcaactggatttagggttattacctaccaaggggcctaccaaggggcctgaaccaatataatccatgttttctattagcttgatgtcatattacgtagatcctcgtaccagcgtaccccaataccctctatatccggtctacgggtgtcccccatcgacaacaacataataatcaccgggtcttaattgctagcgaggcttctttgtaaatactaaattaacttattgaaccacatgataaaacccactcttgataattagctgtcagttgtaaaaagtaaacaaaaatcgaagatactaattaaatttgaattcttactgtagtatttgaaattaaatacattgcaaaagaaacaaacaaatatacgcaaaggaaataaattagttccaaccaattacttggatgatttgttggcttatataccaaaattcctaggttgagatcataaactattcggtaaattggtcagattcaataaacttcaaacattttaggacaaaatttgacttctatagagtataagtctatctttaattagatgacgtagtcatattagcaatatgtttaataaacaaatatcttcaactaatttatcctaaaatcgaaaaacatctacagtataaaaaacatcatacaaaccaattccatggttgtgattgcgacaccatattttctcataaataaattcaagacttcacgatttcacatgattttagtttacaatttatatgatgcaagggtaattagaaaaaaaaatcatttccaacgtaatcccaaataaattagaatagagtaaaaaagatatttcaataaaaatatcactcacgcatatatatttgttataaaattttgagtggtgatccgatgctctctactgatactattatatcaccagtagaaatgatctgatccattcgttatttactaatacattgattaaggctaaccttttcatttatatatttttttcgggctagattgatcaatctgtggttatttattgtgctggcatcgctcatattccatcgaaataagccaaacaagaataaaactaggtttagtgactactaaatgataattataccccttacgcactttttttatagtaatgtctctccatgtttgaactactgctatttagggtggtagtataaatagatctaaatcattcgatcaaataagatcaacggattagattactttctactatcaatagagagaatcgtagtgggtctcaaattttaaacgtgttaaacaagatgcccgcgcatgtgcacgggctaccttgttataattagattttctaaataactagtacccacgtatcaacctacagattttctatcgtatcgccataacagtgcacacgtgtacaaataaaaaacgaaatcaaactaccatatctaactgtaggccattcggccattgacaacaattttctatttccacgctgaacacgagccacagttgacagttgaatcgctgagcctcactctatttaaacccgtcactcgtacccatgctaatacaacaaacataccacagtcgcgagaagttaatcgcgatcgagatagctagctagatttcaatttttaatggcaggtcagcctcccaacatgttggcaccaccgaccgacgacgagctgctgcacgcgcaggccgacatgttgcgccacagcctctacttcgtcacgtccatggcgtttcagtgcgccgtcaagctcggcatccccaccgccatccaccgcgccggcggcaccgcctcgctgcccgaccttgtcgccgccctctccctcccgcccgccaagctcccgttcctccgccgcctcatgcggctgctggtcaactcgggcgtcttcgccgctgccgacgacaccgccaccgggtgggccgggatgtaccgcctcaccccgctgtcgtggctcctggtggaaggcgaaggcgcagcgcccgtcgtcgacggccacccgagccaggtgcttgtggtgctcgccgcgacgtccaggcacttcgtggaggcggcgatggggctcgcggactggttcgggaaggacctgccgccgtcgtcctcggcgccgccgtcgccgttcgaggaggtgcacggcgccgcgctgttcgacgagagcatggcgaaccttgacccggagtctgactcgatgttcaacgaagctctagcggcgcacgaccactcagacttccccacggttctccgggagtgccgtgaggtgttccagggggtggagtcgctcaccgattgccgcggtggtgacggcagggcggcgaaggccatcgtcgaggccttcccacacatcaagttcaccgtgctggactttccccgggtgattggcgagacacgaactggtgtggtgaactacgtagcgggcgacatgttccgtgagatcccacctgctcaagctgtgatgctccaggtagtattaactgaaataaattaaaattaaaagtgattttcagcgcacgtatatataccagtgagagtttgatttattattttttataacttgtgatgattgaatttgaatttggatgtttttaaagtcatatatcatatatcgatatatcttgttattttttttataatattaggataacatgcaaatacggaagacatcgtcttgagtcttgagtaattaattagaatccatttcctatatagaagaacagttaacgactagtgcgccacgaagtgtgtaattcaaattgcgcatttgttaacttttctatgacttttttgtgcatggtagcttgtgcttcaccactggaatgacgaggattgtgtgaagatcctagctaattgcaagaaagctattccaacccgagaagatggagggaaggtgatcatcatagatatagttattggtgctccttcaggactgctgctagaagcccagctcctcatggatgtggctatgatggtggtgaccaaaggccgacagcgagacgagaatgattggcgtgatctcttcagcaaagcaggcttcagtgactacaatattgtgaagaaactgggagctcgaggcgtctttgaggtctacccatagcagtggttccaacactaattgtgtgggtcccctctgtggaggatgtgatctaagtgaataaaggaaggaagggcatattttctgaaacaaattgttatatatgtgatctatgtcaagcttggttttgtgaattaatacgtgtaaaacttctgttgaatgtttcatgtgagttaatgtgtccggcttgcttatgtaaaatttcaatatgtaaaatcacttaggccatgttcaatgcgtagccccaggtcgtccccctagcaccctccgtccgaagccgttagccgtttcgcccgaggcgatggaacgcgcgcctctgctgggggacacgtccctcgctcgcttttggcaggggcatgcagcggaacgacgcgttgtgtgccggtgagaggagagggagacgagcggcggatccggctgccgttacgccagatccggttgccggcatgccagatccatgcgctgctcaccgttgaccaccgcgctcataagtcgtcggccaccagcaacggcgttgctccagcggcggcggcggccctcctcatcgcccttccagccgccggctacgggttagagaaagaggcgagcggaggcggagggagagagatggagagggagtaaggcggcggtgtctagacgaggagggaggcgacggcggtgtctgtggcggtgcggcgcgagactcccgggaggacggcgacgggcgaaggaagtgagacgaggcgaagaaaagaagaagaggaggggcgacgaagaagaagcaggagcaaagaaaaaagagaagagagagaggggggagaagagaggggtagtataggaaaacacccaccctgggttttttggttgggacacccattgtggggttgagtacctttattcggttgcttcagattttgaagagaccacttagatgtaacctccattgagagatgagtgcccctgggcactctaggtgtggctttgattgtagatgctgatggagggaatactttaaacatgcaagtcatcctagatgaataacaattcaacatcacccacaaccaacttggtctccccagccttaagtatactggacacatgtttgatttcttttgcatggacgaataagtccatgtaacctcacaattctatttagagggtcatgtccctacactaataatacccgaaatttttgcttggacaaataagtccatgtaaccttgcaactctaccttaatctactggacatgatttgcttaatggggtaggtttgtaacattctagttaagaaaaagcattaaggtttcaaagtttttaaaacttttgcatcatgtcgtgatcattgcttgagttgtatggaaatttattttaaaacaaacctacgaataactaaattccaaagcatacgaagaaaacatgataaaatatttcacgaatcacatgtaaagcaaagacaagaaatcaaatagattaaataccaatttaaattataatctaattatacaacaaacatttgaccaaatatatatattagtaataaaaagaaacatttgaccaaattgtgcatttgttaattttttttggtgactgttttgtgcatggtagcttctgcttcaccactggaatgttgaggattacgtgaagatcctagcccaatgcaacaaaactattccaaacggagaatatagatggaaggtgattatcactgacatagtgaatggggctccttcagggccacttctagaagcccaactcctcatcaatgtggttatgatggtcgtaaccaaaggtcgacagcgagatgaaaatgagtggcgtgatctattcaagacagcaggcacagcaggcttcagtgactataagattgtgaagaactgggagctcgagctatatttgaggtctatcgatcccaagcagtgctcccaaatactattattgagtgggtttcctctatcactactaggaaaatgtttcgcatacgaggtccttttcactaagcatgcatgcacgatttttgctcccaaacgtccaaggcggaggcttaactacgaaaatgtatcattccaggcagagatttaagacgtccgacatgaaagatagtatattatcctagacggacatctttagagctttgtctgcgaagatatttcttcgtgggaggaaccttaagtcgtccgtctgggataatttttttatgaaaatagatgcacaacggagacacgaattttacgtggaaaaacccttgcgggaaaaaaccacgggcaccgaccgacaatgatcaatattgagaagttggatacaaacgcagggggatgcattgggttgtcacacactcctcataagggttacaagagaaatataggagtcttaataggcgaagacacaaagtccaagtaggaaactaatcttataatatagagtcctattagaaaactaatctaaatatactgtagtcctaatatttggatcacatgtttaacaatcttcaccttgagaccaattttcttgtagcataaaaattgtcaatatccaaagaatctcacatagataaaatcattgtgcgccaaacaatctctatgactataatgtaacaccctcgattcagaagaagtagaccatactctcaccattgggaataaatcctgaatctgctagtataaacctgtgtgaactaagcagcgacgcgaaacatgatgcccaaacttcaaactcgccatggaaataaaatcttgagtctactagcatgaatttatgtaatcctagcagaatcatgaacttttgtatacaaaacgaagtacttagatctcatgataaccagtttcgaccatcaatattatccaatatatgaagactagctatgcttgcaatgcataattcctaaataaaataattacttccactatatgctatgctactaacatgtatgcaggagaagcactcataaatgaagagaaggaggaggaaatatatcgatcaattagtcgaaagtctgccggtgatgtgcaattgcatgagaaggcctaaatgtccaatttaacaatcacaaatgggcctagaatgtatgtcactgatttaggggccaacatgggagtctactggagaaagctggggccagaagagccagcaaggggtcggccgacccaccactgagcccaatcagcccccatcttacacaggctactcactacctaaggtcgttatgaccggttcccgcgctattaccgacttcaggaggacagatggcatgaggagaaggaagatgttcgttggatgctatggaggatctccaccctcccaagtcatctccacctataaataccccttcacttccttcattccaagcacacacctcaagaagaagatcaagagctctctcaagtattgtttagtagttctagtgctagtggagtaggaaatagaatagtcttcatagtcctcaagtcttcaggagatttctagtatggctttaatagctttactttcttattttgtaagacttattgaattaatagaatattcttctttatacaagttcggtattttattccattcatattacttgagtgccgactttactttatacttgaatcaatatagtcgtgtaactagctttccagataggtgtattggtgtgggtttaatgtccgattattcggttgctctatgtcggttgcaaggatgtagagtagtatttagtaatgtaagcgcggtgcttagattattagataccattaattggggtaatatacagtggttcagatgctggccgctgatggtgacagcttagtacgggtgtcctctgcatgtgtatattgtcctaagttaatttcctggggagggtactcctccgtatttagccccggttgtatggtcatgacgggctgtcgtaaggaactcggcagtcaggggtggcttctcgaaacaccaggaggacactgggtatgaggtattggttgcatgactgtatactagcaagtatagactaaagatgtatgtatactagaagtacaggaatgatatttttcttattctttctccacttagcttaaactatattttagtgagagtagttcttagttctttcttctgtgtgtcaccctaccctttgaactgaattaacccctgcatagactttgatgtatataagtaatatatgaattgttagcatagttctctcttatcatatcttctcttgcgataccttggaatactcccgggtgaaatgctacaatgatatatccatgcgcttgcggatcatatctgtaaccataatataccaggattatttctagtgctactgctgggaattagtcgctaagaaataccaacaatatcatgttagcaaaattcaccgaaaaatttgatcaccttgtgatctagataggagcaaggctctctcttgacaacttggatgtgcttcttgttttctgcatgcttctcctcttagatagatgtgccaacttgcatcttcacttgccataatgagaatattgcatctcaatctaggagtggtcgataatacttcaaactcgccttgtgaataaaatgcagaaacacaaaacacattcagagtgcaaaaactaagtatttggatcaccgtataaacctcttggtagacttgggttgttaatttagcaattgaacatgaatttggatttaccagaacagaatagaaatcgctgcaaattgaatttatttcctggtacgaaggatgtgtgcacatagtattgatcgcacgtgaaattaaattcatgtagatagggcaatgatggctgattgccttgacctggctagcagatgtgcacaacagtcaacttaattttactccggttacaagcaaatgcatgcggtagatgcacctggcaatatggtagtcctcgatccgatgtggaagcgctgtggctttggttttgatatatgtgaccagttcgatctcatcgaatagaccgaatttatgagaatcgacaaacgtgatggccacaggtaagagatagatatctcctaacaattgaactcgacgaaatgatgggaggatgcgcgcctgccgccacctgttagattcatcgatggacgggccgatagctggtatagatagaactccaacactctgataccacttgttatgaaaatagatacacaatggagacacaaattttacatgaaaatacccttacagggaaaaaactacgggcactgactggcaagggtcaatattgagaagttatacaaacgcaggggatacattgggttatcgcacactcctcgtgcggcttacaagaaatatatatatgagaaatatacgagtcctaataggcaaaggcacgaagagctagtaggaaattaatcctataatacgtagtcatattaggaaaccaatccgaatatattgtaggcctaaaattcagatcatatatttaacaaatttccctatatagctttctttctccccaaccgctattcagttcaaccaaagatctattggtcacagtaaaaaaaagatctattagtcaaatttgtaggattcttcatgacttatagattttctatgatccattaatgttgatgcgacatacatttcattatcttcttggtaatggtttggggttaaactaatttttaaccatatttctagttgtgaatggtgaactatatatgtgcaccctatgtattgtcacatgctaattttctgacatacacgtattatgattccattcttcatatgatgtaggcttataggcctatgcaacattagtttcgtcccattttatctcaaacaaatttcaaaagagtaggctttctttcttcatttgatgatatttgtatcatcatcttggtttggggcttttaatacttgtatgccaatacccaatccaaaatttcattaacagtccgctatcaaaggatcaacttgtgggttgatcctttagttgatttttcaacttctacttgactgctaatgaattttactatgtaaataaacattttccataataggtcttaatgccaacttctattgtccataatacaattttcttatgcttcttgttctcgcttaatgcttatttgcgtaggcatggttctttaagtgtgccagcattggtatgtactccaactgcttgttctcttccttgatggaaagatgtggcatgtctattctgaggtttcataccatttgccaggtctcaacttgctctccctcaattatggggtgtacatttagtgataataagtatgaaagttacatttgttccttttcaccagatgtctctaattactttaaggatttaaggagctggagttcttggcatattattttcgacgtctctagacaagatgatagatacctttacattccttatacctttacattccttggtatttcaccctcgtcttgttcattacattagggtagatgcaatttagtcatgctcttataatcacaaaagtaattaaggacgataggaaattctgacaatacatctgttcttttgatgccttgcattccttagagcttgattgagtatgcaataatcctttgtttaaccatttttctcacaagaatcatctaagactgggtttggctgttggaatccctcacgcacgcaatacagaatgactcattagtgcatgattaattaattattagctaatccttcttgaaaaatggattaatatgatttttttaaagcaactttagtatagatttttttttttgcaaaaaacacattggttagcagtttgggaagcgtgtgctagaaaaatgaggtagggtgagttgggaaaatagggtaaagagcacaacttaagggttcattttctcctcctcaatgtctagaaacaagtctccttttagtcaaggaatttaggctccatacatacctccattcaagcttcctaactttcgaaaagagctcatactgtggtcgtgagatatgcacatgtaccagggaccaccacttggattcttgagtggatggcacatttcaaatggttcaaatgttgataattcgttgcttttgagactgcatgtccattcaagatgcgggaatttgaataacattgtggcgaacccttttaatccatccttagtatttactccatttttgtggatatccagtacttagtgccttttcttagtgtgcttatgacaatatgtgtgttcttgctatatcggtttggcaagagcatagtgtcaaaaataggtaagcacgttatttcccggaatttgtctgcagatattactagtttctttctattttgggtatacctttcaaggtatgtagggtatggatcaatttttctttggttcaagacatggtggtgcgtgcttcatgcacgtccaaggttcgacggtatgcgcaatcaaagtggcacgaggtatgcgaccagtgtggttacggtgtggctgacggtgtaacacgcatggctaatacggcacggattggctggcatgcggtacaacggggttgctagtcggtgcacagtgcaacgtccaacgcgtagcgctggtgctggcctcggtgtgcgtcacggtgtgacgtggtgcatgccgatgaatggctgtaacataccaaaaattagctattttcaaatcttgcatcatgccgggtcttatgttcttaataacctctttaaacctaggacattataattagcgagacctcctaaagctaacctgcataaaatccttctttgatattcaaaagcttttgtgattttcatttaaaattttatcttgaaatattccttgatttggttttaatctaaaaccttctttcgcctaaaacttcctttatttaaatttagtttgaaaaaccctttttactattatgaattatggtccaagaaaccatcctatactgtgctagaacctaaaccaaagcaattccaattttattggaattaattgttaacccatcctttgatcttaaacctatcatttgattctcgatccaaatattcgagtttctccttttaatctagccaccattttaatccctgtggcttgattccctcttcggcacaagaaatattattattacaaatattgtgagtaattgctcttgtgctaagagaatagactttatccctccgccccaaattcaaaacctcatttagcccatatctaattctttaaatttcataccacatattttgggctagaattctatttactctattccctccatattccctccactcaaaaatattcaaatctagagccatattatttatggttttgaatattttgaatttctatttgagtatattaaataaactcctcaaaccaactggagaaatatttcttttggaaattatattcaaatataatttccttctaaactctctctcagtcatttttccttcaaattcaaattattcaaatcctttttcaaaatctagccatccaaattcctctaaatctattatttgaatctctaggaaaattagacttcctccttttcaactttgggcagaattcttcttctctctcgcgcggcccaagtcggcccatagcaagcgcgcgtgccgtgcacgcgcacgccgccgccaacgccttccgtcgccgctaaggaaccggccgccgccatttggtgcgccgtcgccgttgtcctgccttcgccgccaagttgcgccgccaccatcgccgtgccgtgccctccttctccgccgtccaactctgccacggccgccacgtacgcgcgccgcaaatgtcgaccaatcggaagacaaagccggcaccgtcatcctcctctccacgccactgccgccgtgctccccttctccttttcctccgaaaccgtcattagccaccgcctttagtcgtctataaatagacggcaagactcgccattcctcttcagaactcaagctctgagatctttttctctctctcctcccatggccgatcgtcgacatcgtcggtcgatctccccatccgtagctcctcctttcctctcctcgcaccaccggcttcgcctccatctggcgagtccgttttttccctttcccctcttccctacccacttcatcaagccaccacagccacttctcttgccgccggagataagctcttctactcgctgttccggccatctccctcgctccctctgcttgccaccgacctccccggatgcgcagtgagcgggaacatgcgtggccgatgacgtcgccgccctccagccaccggagcgccgccgccccgctcgccttctcctctctcttctctcggctctctctggaaccgagaaaaggaagacgagaagaaggaagaagaaggagaaaagaaaaagaaaaagagaaagaaaggctgacaggtgggcccatgaacagtacattttcgtcttttctagatttaattcaaattccaatctttagaagcccatatctcctaaaccgtagatctgattctagtgaaacttggacctaaatttatctaaattcaaaccctacttttgataccaaatttgctatttaaagattttatttgaatttctttaatttattcaaatatcatttgaataaatatttgatttaaacttataattgaaacttatattcacctttcaattatttccttttattttcaaaataccctttagccactaaacaaccaccgtttggaactttacaccttccatggggacgttcgcacggtctactgaccccgacgtcaaaacgttggttgtaaagtctgacaaaacccaaacctaacgtcaaagtgttgcttctgacaccttacgcctcaatgcgtataacgatcagagcttcactattccctcgacctccactgtacgccacacagtttgctctcaagctctgtgtgatcctagccgctccgccgccactcacggttgttggagtaacacttccacccctctaaacctacacaaacttcctatccctctagccataacattgtctgctgacattggctagacaccaaacctagtcgtcatactacccaattctatgacgactagtaaatacccaaaacccttgccgatgtttatcctacctcgatatcggcttaatcaaatgaaaccctagccagcctgctatccaaactccataccaactatttaccctccaaactacccatagcttaaacatgaaatacgagccgatatgctatttcagcatcgactcgagaacaactaaaccctagccactattccaccaaagcctaatcttgattccctctataacctagcctccaaccccttagagcctacgtataaaatactagctcaataacccattaaggagatatttatacccccaaacctagcctttctcgctcttcatcgttttcttgttattttatggcttttattgaatttggttctctctcttctttaatagagtctattttattctggatggcaacctgtggtatttcgagcatcggataatcaggttgcctatcttggatttatttgtgttggagcaaggcaagttatcattactctcctttgagcataattatcctatactctatagttttattctatgcattagccattcatgattttgaatgcataacttgaacatatagcaaactagatatatgctagattttgcttagccatgcctagttagattgcataaaaatataacaaacttagattgggacaatacttaagatttggttgatttccgggtggctagtactgtctcgatcgatataattgccaccaaatacttatgtcaaatgagtacgactgcagcttctagaatggggatagacctagttattaggttaattaacaatgtggtacctctgtacagtggttcttatatgtaagtcctcgcgaaggaggcaaacttatgccgcgaagggcaaatgtgatatttaccgaggcgcaggtaaatatcttgattatattgcgatcgctgtgtgtgtatattgtgaaaacctaattgagatgacgtggggtctctcaaccagttctctctaaaaacctcgggaacgccagaactcctctcgctgctgataacgttacgttcagagcgcatggggactagagttcatcgaacaggtgccactattgttaataacctaaggctgggctacgactaagctaatgaatattggcaagtcgtggattgcgggtaaagcgtacatttactgcagtaaagtataaatgaatctattcgaatagccgtgctcacggattgagtatcgggactcatatggtatttggttagaaacctaattcaagactttactaaatactgttgcataaagacatcccaggctttcttcctctatattctcagctttctgcaattgaatctagctctactcaaatattaccatttcatacattcattgttgattaatataatagcttgctgagtacgttgtactcacccttgcttcaacctcctttttcagagtccattagatgttcttgccgaagtcaggagttcaatcacataagttaattccctttttacttaatcttcaagtctaggttatttacatggtttaagtctatagtaaaacaacagagttaggtcattctaaaacttctgctgtaatagttagccacaatctcgtaaataccctattactttatgtaataatatcttcttcaaagctatgtctaaacgtatgcaaagacgatccagattgttgaagctgtatcaacttactgatccagggcttgatacagttaaatatgtcggtttccgaattattagttttgggacccaacaatggcgcgatgcgcatggtcagtgtgcgtgacaaataatgtctcatcgttgcgttcgggcatatgatatgagatgtatttgtcttatcgttgcgttcgggcatatgatacgagatgtatttgtactatatccattgcaattttcatgattcttaagattcaacaaaaataactaccaaaatagtcttcttttagcctagatttcttagtgacgaaattgatttcacattctttctaatgattatgctttatgtgcaaatgttttttttccaatttttagggatattgacatatagtcgtttctctagggaaacaatattgtcaataatcgctgtgtgcgattcgaaagatagttcaaatcttttcacagattgaacttgtcttgcatctctcaattttgtattttgtgatgcttcttttcacaatgtttatttcctcttcaacataggctatacaaattgtctatggaaataaagtaaaacatcactatttcataataaggagtaataatttataatataactaagtgtaataatatcaaaaataaattctagccatgcatgacaaatcacggaataaatgttgtactctcatagagcttataaaaccattatttaaagttgttcataatgcaaccaagccaaatcaaaataagcacattatgccctcaaacagaataaataagtgtttagcaccacaaacatttgctcctgcctgacattctcttcacgtgttatgcctgttgcagcggcaaagatgtggagtggagtagtagtggagggagttgccgtggcgatgacgatgacgtgcttggccttcctcttggtctagaatatgtcgatgatgtgctcgggctcctcacagatacggctccagcagccccatgtgccacacctgtagaatgtgtggtcttgctagttgtatggcttgtagtcgtgggatgtcttggcttcatgcatgcacttgccttcctgtgctccctacgcatctggatcattttctgttgtagccgacggcgctccgtggatgcgcatttgaggtgagaaaaacattatatatgccggtttttactattccggcactataacctatagcgccgtatcctttatttgttttttagtagtgtttctctcttattctctctctatttttaagctatgctatgtggtagattgagagtgttttaaaaacatcgcacgtcagcttaactgggtattttatattgataatattttttgaacaaagaatcctatatatctatacaattgatccccactaagtatcaatgatgctattttccagccctatggtgaagccacgtcacttcaattaattttagccatcagattagatttgtctgtccgagatttcttctttctccaccatgcacaacctatatggccttttctgtatcccaatgaacattgctgcgagtaggacagcccagcaatttcccaccaggccatttattcctcagtttctctcccctaccaaccgaggaagccgaggagcttcgcgttaggccagtcacaatgggtgtttcatttgagtgtcatgcgcatttaatacagtgacaagtcagcaaaagagcaatatttgcatgaaatgggtaggagagagagtaaactcgtttcaccatggtgacacgagatagcgccgtttcccaggtcactgaaacggggtgaaacagcattgagagttcatcgtttcacctccgggatcccgtgcgagcgctgctcttcgccatcttcgcgcgcatcgccggattcttcccgcgcgagtcccccatcttcccgcgcagcacctccatgttcccgcccccaaagcactggctcgaagcttttttccccaatctcacctgcaaccctagcgccagactcagtccccatcgccccgtccgtcccataccctagcgcaagaaccacgagcggagattgcggagctggatccacaagtaggtggtgaatcctgtccatctgccgccgtccgccgtccagcagccatggatccacaaggaggtggtggatcccgtctgagcgccgccggcagaggagggaataagcgtgggggcaagcagctgggcctgaagaggtcgtcggcgcctgctccatcaccggcaacagctcagccaccgctgcctgcaagttcccctcctgaagctccatcgccggcaacagttcagccgcctactccatcgtcaagtcctgctgttgctgcccccagttcatcccctgctgtaccgatgtcaaccatgcccccatggccaccgcaaggagcaggatggggctctgtaccccccaattttgcttttctgcaaggaaaccaacaaggcccaagttcatggtattttctccttgtcacagattattcattgtacactatgatacatgatatgactctcttcttcatgcattagtaattagttcctgtttatgctcaatgaaatttgttagaatcagtatgtcagtacattggtaatttgatatatgcctgagtaatgaatagaaaaaatgtagtattcagtatggattgcagtaatactttgttagtgaaaattcagtattcagtatgcagtatggattgcggcttgtataacagaaattgaaagcaaaagattcagtttgcaatctggacagtgtactgtacaacatgtaattcacatacgtaaagcttgttaaatatctccttgtcagtacattggtaacaaatgctttgagtgtaaatgccaagggtatcatcctaacattggtatatatttttagccttctgtatggaatgcagacatggtcttctttgcaaccacagcaacagcttgccctacactctgtgctgtcgtcatagctaaccaaataacctgttagtactgatatatatggtcttctttgcaaccacagcaacagcttgccctacatggtcttctgtatgcttgactaaacttgttacttgacatatatgcttgactgaacttgttgcttgactgaattattccttacacatactgtagtacttgcttgactgaactatgtcaggatcttattaaaaaaaatctatgtcagcactgctactatgtcaggatcatcagtatgatgcttaagtaacctgttagtatgtcagtacttactatgtcaggatcatcttctggaacttactatgtttgattttcttatgctgccatcggtttcaattggatttgcttcttatgttttcaggttgtatcctacagaaggcttcgtaaattttctccaacagaactgtctgccgcagccacaagaaggtgaaaattttcaccttgttggtcagactaccaacacaatgtctactccaccaccaacaccccaagctgcagctaacaatacagtccaaattgatattcatgaagatgcaatcaatgatgcaagtgctaaaaagagaagtttgagatattggactcatgatgaggaagagagattggctagtgcttggttgaatgcttctaaagatcccattcatgggaatgaaaagaaaggtgatacgttttggaaagaggttactgatgagttcaacagaaaagggaatgggaagcgtacaagggaaataaatcaattgaaggttcattggtcacgcctcaaatcatcgattggagaattcaatgattactggactaaggtaactcaaatgaatacaagcggatatgacgatgacatgctggagaaggaggcacaacagatgtatgcaaatacatttggaaagccttttgcacttgtgcattggtggaagatactgagaaaagagcccaagtggtgtgcaatgattgagaaggacaaaaacaaggctgaagtggttgatattccagatgaacaaaagcgtcccattggtagagaagcagcacaagccgagcgcaatggaaaacgcaagaaggacagtatgtcagaaggaattgtcatcctaggggacaatattgaaaaaattatcaaagtgacgcaagatcggaagctggagcgtgagaaggtcactgaagcacagattcacatttcaaacgtaaatttgaaggcagcagaacagcaaaaagaagcaaagatgtttgaggtatacaattccctgctcactcaagatacaagtaacatgtctgaagaacagaaggctcgccgagacaaggcattacaaaagctggaggaaaagttatttgctgactaaggttagatatctaatctaatctgagctgcactattatttataataattaaagaatgctgcaatatttagttatattgtctgtatatctgtgctgcactatgcagtcagctgcatatcacgaatttgtcaaatctgagctgcatatctgtgaatggtgcaatatttagttatattaattacccagtgtgaatgatgtattgctgtcagtttcacatatagtatgaatgctgcactatgcagtcagtttcacatgcagtgtgaatgctgcactaggcagtcagtttcacatgcagtgggcgcctatttatgcagagtttagccatctctctactcctctcagaaactcattccctcttttctcatacgaagacctcctcccttttatctttactgtttctctcttcttcaaagatgtctgagcaaaatactgatggaagtcaagttccagtgaacttgttggatgagttcctggctgaggatgagatcatagatgatcttctcactgaagccacggtggtagtacagtccactatagaaggtcttcaaaacgaggcttctgaccatcgacatcatccgaggaagcacatcaagaggccacgagaggaagcacatcagcaactagtgaatgattacttttcagaaaatcctctttacccttccaaaatttttcgtcgaagatttcgtatgtctaggccactttttcttcgcatcgttgaggcattaggccagtggtcagtgtatttcacacaaagggtggatgctgttaatcggaaaggactcagtccactgcaaaagtgtactgcagctattcgccagttggctactggtagtggcgcagatgaactagatgaatatctgaagataggagagactacagcaatggaggcaatgaagaattttgtcaaaggtcttcaagatgtgtttggtgagaggtatcttaggcgccccaccatggaagataccgaacggcttctccaacttggtgagaaacgtggttttcctggaatgtttggcagcattgactgcatgcactggcattgggaaagatgcccagtagcatggaagggtcagttcactcgtggagatcagaaagtgccaaccctgattcttgaggctgtggcatcgcatgatctttggatttggcatgcattttttggagcagcgggttccaacaatgatatcaatgtattgaaccaatctactgtatttatcaaggagctcaaaggacaagctcctagagtccagtacatggtaaatgggaatcaatacaatactgggtattttcttgctgatggaatctaccctgaatgggcagtgtttgttaagtcaatacgactcccaaacactgaaaaggagaaattgtatgcagatatgcaagaaggggcaagaaaagatatcgagagagcctttggtgtattgcagcgaagattttgcatcttaaaacgaccagctcgtctatatgatcgaggtgtactgcgagatgttgttctagcttgcatcatacttcacaatatgatagttgaagatgagaaggaaaccagaattattgaagaagatttagatctaaatgtgcctcctagttcatcaaccgttcaggaacctgagttctctcctgaacagaacacaccatttgatagagttttagaaaaagatatttctatccgagatcgagcggctcataaccgacttaagaaagatttggtggaacacatttggaataagtttggtggtgctgcacatagaactggaaattgagaatcagtaaatgtaattattttatttttcttgtaatttatatatctatggtccacttgtaaatttctgaatgctcatcgccatattttttaatctctgcaggttccaatctatttacaggttccctaaaaaaaaatctatttgcaggttccagtctgttgtcttcacaatgtaagttctgagaatcaaatcactatgtttttctcttttttggtagctacagggtgttagaacatgtgttattttctttactatgcaattgtgatcctccaatatttatctactgcatgtgtaaacctgtttgtcatgtctgaactactttcatttgtacagggtgaaagaatcaatgaaatctatgggtgcatcgtcaatttgcctccagttacctgcttgtcatcgtcatttgtagcttagttctgtcatatttcacctcgagttaacatctattcagttatctaaactttgctatgtagtgaacttggttgaatggtcatttaaatttatcaagtgaacaatcgtacctatctgtgctgaatgcatgtattttgttttgtgttcaagtggctacacacgtttgtgttacatacgatcccactatgtggctggaattaaatgccttgaatttgcattggaaacgctagagtgaaacacagcattgagaaggtctgtttcattgtacgtttcaacttgtttcatcttcgtttcagctgatgtggcgtctgggaaacagtgtaatgaaacactgcattgtgaatggccttactaggccgccgctgctagcatctttcccgtcgtttcctctacaatggaatccgagacgacagcctcacctgaaactgttacacacgccttcacttcaacaaactgattgggggcatttatttaccgaagctgcagcggcgcagtaatggccttcagccttcttctcaatctccctcctccctgtcctcctcagcttctccacatgagaagtactaatcattaagttatcctcttctttataaactccctgaaggcggctccattgcatatgccgaaaatctctgtctgtctatctctgaactaatgcaaactggattgcaaattttcatttcactgacaaattttcacgttggaggaatttccattccggtgggcttttcttgctggtgctgcaggcgcctggatggttaaattttcaatgatatttttggtatatgtagaagaaaatgcataatccacgttgtttttctgaagaattgcaccgctcctgtcgtcctcaagcattctgtgtttgtaccttggtatgtgcttcctaccgaggatggatcatatatgcttaaaattcatcctccttgtccaggttttaatgagttctcacacctatttggctattttattagattgattcagttgtccgtgccagattatatgcagattttactgtgcgtctaagttgtttttcacatattgtaggcttaaaggagatgtagacgtcttcgtcactaaagttaatgcttacaaatatattctcttaaatccctaatctgtttttactcagaaggactagctagctactcagtattttttttatttagggttaccattagctgcatatgtaactctgattttgttgagatttactttaccgttcaatattaaaactggaatactgtggagggttccaaagcagccctagctgcaactacaccgatggatataaaaggtttctttgcaaaaccccaggacctgctttcttaatttgtatcacgagcaaaaccgaaacatcaattttcacatgctctgccagtataatgagcgatgtaatggatcgagtgattattcctataataacagtacacagggttcaatatttcagaatggaacttctggaatttcacccctgcaataggatattacggccaaaaatttgagtatttttagttaacgaaaattcattcaactttcaactttttcagccagaaatttccacaatttcgcttctatcagttcccactgaaatatttagattttcaagttgtagattttttattttttttgcaatttcaaacttgcagtacacttggttagttttgcaagcttaatttgactataaaataatttcgattttaaatatgttgaaagatcttaacaaaattttaaatttgttgaaagttcctgttttcgtttaagaagaagagaggtggcctagtttttagggaaaaccgggcccgaaaacctcacaagtgcgtggttaattaagggaaaccggccaaagacccacatgaggaactactgaagttcgaaacaaaagtcatcgttgccaagctcagaggagcagctccgacttcttaagaacaaactacgaactagctaggcgaccacaatgacaacgtagggcagggtcttccaaacgaaacctccaaggaaaagcgtcagagaacacaaacaacgtccgtccaagaatcggaataaagttttcacccgaagaaaaggagagcaagcaacaacgccttcaggaagggaacggcgcccacaggcgtcgacgttatcagccgtagtccaagaccaagcagggctttcacccgtgctcttgctccctgacaaccacgaaaccaaggccgccacaatgcttcacaacccttagacgcttccaaggacgagagaagggggttattgttgccgagcttgccactgcaagaagctccgactccacccccaactcaaccacacggttgcgccacaagagcttcgagcaccacacacctcgctgctgcaaggactttgaaggcgctgacagagtggacggtcttccgatcttcaccaagcagaaccttccaaccaaacccgtgtctctctccttaacatggggcaccccacgactgaagtaggccagtctaagaggtgtagggtctccaatggacgggaggagggaacaacaaccagttgggaggaaccctcgccgtcgaccaggacactgaccacactgctgatcatcgtgtcccacggctttccaacaagcaaaactgcagcaaacgatcggcctctccaagtggcgactccacctaacggcacctgctgcgcctctccggccatcttctttttcagcctctccaccggccacctctactagcaccttctgccggcctcccccaactccactggcctcccccaactccttatggccagcctcctccctccgagcatggaggcgaccagattcggcataggccggattgaccgcctcctccacctgccggctaccagcttctcccaacagccagccaactccaccactgcgcctcctccaactccactcccgtcggccttccccttctggatccaaggtgaaggcagccagatccgaaaccggttgaccgcccctccatatccggccacacccacaccgccacatgccgattccaactcgccgctgcctcttctcaccgcctccaccccgctgctatcgctggagcagctcgccgccgggacgccgcagctgccgctaggacgtcgtccctcatcccctgcgcaggagaggactcgtcgcttcacggctgcctaccccgccgccgccgtccttgctcgccgagccatggctcggccccgcttgctctggcgggggcgaggtggaggatggagggggaaagcggcggtggctagggttttttccgcccgcccagtcgcccgcgatgggagcgacgcaagcaggaaagacaagttttttacaacgcatggggaaagcaatcaatctttataacagtccgcagtaacacatagggaattatctagttttatttatagctaggtttagcagcgaggcctctaaattatagatccggtctggtagggagggggtcaattgatcaatatggctgatgctccgattctctagtgccagtttcatatgaattcgtgtgatactcaagatgaagtgaagtgactgctgaaatagaaagaactcgatccgtccctagaaatcacaggaccatagagataagcacagggaacagtacgtcgagtgcagaactgtcgctgcttttactcgtagatggcttcttttgggctctatcgtatcggcgtatcgccatgacggtgcacacatgtaaaaataaataaataaataaattaaaatcaactaccaaatctaactatataaacgccattaattcggccattataagagcaagtttaatagtacagccaactactagctccaaatcatctatagccaatattataatcaattcatacaatagttgcttactatactattaatatctgatcctacctgtcatacacacagtacgtcttgaagtccgtgctgcagctggctacagatttgtagcccgctgcttatctctctctttctttatctctttaaaatatgtttgtagctggcttatagcctgctattgtacctactctaagcaatatattttctatctccacgctgaacacgagccacggtagagtcactgctcacagcttcactgtatttaaaccccagatgctcacacccatgctaatataacaaacagaccacagaccagagtgaggctagtacatctcatttcaatggcaggtcaggctcccaacatgttggcaccaccgaccgacgacgagctgctgcacgcgcaggccgacctgtggcgccacagcctctacttcgtcacgtccatggcgttccagtgcgccgtcaagctcggcatccccaccgccatccaccgcgctggtggcaccgcctcgctgcccgaccttgtcgccgccctgtccctcccgcccgccaagctcccattcctccgccgcctcatgcggctgctggtccactcgggcgtcttcgccgccgccgacgacaccaccgggtcggccgggacgtaccgcctcaccccgctgtcgtggctcctggtggaaggcgaaggcggggcgcccgtcgtcgacggccacccgtgccaggtgcccgtggtgctcgccgggacgtccaggcacttcgtcgaggcggcgatggggctcgcggagtggttcaggaaggacgtgccggcggccgcgccgccgtcgccgttcgaggaggtgcacggcgcggtgctgttcgacgagagcatggcgagcctccacccggaggtcgacacggtcttcaaccaagctctcgcggcgtacgaccactcgggcttcgccacggttctgagggagtgttccgaggtgttccagggggtgcagtcgctgaccgactgccgcggcggcgatggcgcagcggcgaaggccatcgtcgaggcgttcccacatatcaagtgcaccgtgctggactttccccgggtgattggcaataaacgcggtgatggtgtggtgaactatgtagcgggtgacatgttccgcgccatcccacctgctcaagctgtcatgctcaaggtaatttgtaaaattaatgcaaccgttatctttcacccacaaagaaacttgcacatattgtgagccagctagtgctccctccattccataatataatgcacaactattttttaaaaatgttttgtaatattagacatgcatccatacaattaactaataacttatatccactaaattattatttttaaatcatccaccctcaagatctataattttattgggtgcatgcattatatttattagggtaaaataaactaggatgtgataataaattatttcttgatgtttaggttaagtgtgtttatgccttatattttggaatggagtgagtactatgacctattacttcctcaattttcaaattaattataggcccatgcgttataacggtttttctatttagtttagtgataggattcgcactgggtgagttttttttatatactatggttggttcttttatagaaatacgatttttcacagttacatgagggaagaggtttttatgaggaagtggaggggaggacgattccctctttttaagtatagatatatgactatactgatttctagcatgatgtttgaccactttttttatttaaaaatttagtataaatataaaatataagtcatgcttataaagtacctttaatgagaaaaatcaagaaaatttataaatgatacaattttaaaatgagataaacagtcaaacattattttctaaagtcaacaatgttatacatataataacagaggtagtatattcacgatagacttgagaagtaaacaagtaatagttgaaaaataaaaggttcatcttttgttgctatgtatttcaattttatagttcctgcagaagttgtcaacaaaagtttgcgacttcaccataaagaagaacggttaacgactagaactaaaaaaaagaactgtgtaatgcaaattataagtttgtttaacttttttgtggcttcatctatggtagcttgtgcttcaccactggagtgacgaggattgtgtgaaaatactaactcaatgtaagaaagctattccagcccgcaaagatggagggaaggtgatcatcattgacatagtgattggagctccttctggaccactactggaagcccaactccttatggatgtgggtatgatggtggcgaccaaaggccgacagcgagacgaaaatgactggcgtgatctcttcaagaaagcaggcttcaataactataagattgtgaaaaaattgagagctcgagctgtctttgaggtctatccgtagggtgctcctaaataccatggaggatgtgatctaagtaaataaatgaagggagtgcatactttatgaaataaagttttatatacgtgagcctatgtcaagcttggattgttaatatgtgtaaagcattctgtgttgaatgtttcatgtcagttatgtccagttgctttgtttcgtgtgagttaatatgtccagttgcttacgttaatgtgtaaaacttttgttcatatatctgtggatggatggaatactttcagcatgcaaacatgacaatttgacatcaccttcaaccaacttcgtccaccgaccatcagtatttgggacacaaatttgttcgataacactgtcttcaataaaattataccatgttggaacatatcatatatcattgcttgcttgcttactaacacgatgtaattcaaatggtaaaaaaacaaagctccgatatagtttcaattagtacatttttggtgacattttaccttatgtccgtggttgacggctgaccagaattatcctacttccaatattataagcagaggcggagctagagcgaaatgaagggtggtgccacttgtttaatttactctattttagatcaagtttaagctgatatgagtgcctaagtttgtattgagggggtacatatatacatgctaaaaacttttcttgaccgagttcataggcaccccctaatatacgctagctccgcccctaattataagctgaggtttctgtttgttgaatttaccatacaagattttgcatttatttcctctaatctattcctgtttcaaaattttacttattgtaatcagttcatcaaaacgacttgaaaatttttctagtccggacaaattttaagctttaaattaaatacattgatttagggcatgtttggttgacacgccgaaccccatgcctgagaaaaattgaagcctgaaggtggcctgagaattcatgggttcttcttgatcaggccatcttacgcttatgtgtttggttggaagcctgagcctcataagtcaaaaaatatggtttatgaacgagaaagcatataatactcaataaagaattgcgtttccttaacccatcttatatgaattatacgaagaacagagaggggcaccaagtgagctcgccggcagggaagttcggcctcagaagtaccaacaaccatcaaaatggaataaacagagcaattcgactctaatggtggttgtttgcacttcgtggagcagccgatgatgggcatgcttgtagtatcgaacaccgcaggtcttgtggtagcaataaacgtgtaaagttttgatgaaattagattgtgggttttgattagggatgttttggctgcaaggaattggtgctcggtggccggacttgagaggaagaaggtggtgctcggtagctgaaacccacaattaatgtggggaaaatgcttaggagatagggagcagtgcacacatagaaggaatttttgtttgttttcctgtcggcgacgaattgaaagggttttgcgagcaacttgaagctcattctagtgattttttatctgagtgaaactaacgatgcttgatgttggaatctcctgaaaatgaagatgaaaatagggttggtaataatatgtgactaattaagttttaattattacaaacttaaaaaatggattaatctgatattttaaagcaactttcatatataaatttttcgcacgaaacgcaccgtttagcagtttgaaaaacgtgtcacgagtatccaaaatttatgcttgcagaagaaacgaacagggccgtcacgcctgacgacctgagtcaggtgacgtttttcactcgcctgagtcgtggaggaacccatgatagcaactaaacaacccccaggccttagcctttagtgactacagaagaatttgctttcatttatactttagtcggatatacagtaccaaatatagatagaatatttttatgaggactcgggttagattctaaacttgtatgtcaagaaaataccagggatcctagtcggttacgattgtattttatctgtaatcccatattccgttaggatatggactgtactttgtaatacggatccctttccctatataaggaggggtcagggttcctctcgggacgattcttttttctcccaatcatacaatcaataacacactcggtggaatcatccccggacaggagtagggtattacttcttaaataagaaggcctgaacctgtataaaattccttgtctccaaacccatccactttcctagcttgatagccacccccttttattattgccgaaatcttgtttcgacagttggtgcgccaggtaggggtagcgtcaagttctcgccgactaagtgcgatgggtttcgtttctggcatcgacaacttcgccttccctcccgggcaggcgttccggttcggcagcctcaacttcatcaccaacgacttcggcaagatctctctccttgactcggattcaaaccagtcggggagagaccaggtccccgtgccattcggtattccgaactcggccgaggcctactccaagatcatctctcccgagtcggcttcaaaccactcggacgagatccaatctactcttccgcgaccagatcaagacgacgggttctatccctcaatcctgatgaagcttcctgatgacttggccgccgtcttcaccgccaagacatctcctactcgaagatctaggcgagctccggcttcggccctgatccaatctagatctagagaggttggcgttatactccaacctcttgggacagtctcgacggaagagttggatggttaccttagctcccccggcgtcaattctcgaccaaccgagatcctcgactacgacgacttcggctaccactacgaccacggtgacctcgacaacttcgacgacagctatgaggataactacacgcccctcttcttcggcgtattcatggctgacaacgaaacggaggagcagcgccaagcccgagaagcggaggaagagcgcatacgacaagaaaccgaacatcgccgactggaggaagagcgacagcgacaggagcgagaatgactacagcgcgagcaacaagatcgtgaacggattgcaaaggaggctgaagatcgacagcaacgcgccttggaatccaggcgccgagcgagagagctcattgggcaacaagacgtcgatggaacagtggtctttcgcaccccccagcagaacgcggttgcagcaatcactctcctcgacaccctcctcaaggaagacgcactcaaccaagctgatcatgttgtcaacatcttgaaccagacgaagaccatgatcgctgcctcggttccagccaactccgcaagcacccgcactccgactggtagccaagtccctcacctccgatctcatgattatcatcagccaagcctcagcatcatcggcacaggatctagtcgcaggagcaggggtcacgacgaacgatctgttcactcgcctcccgaacgtcacagggagcgccgagtcgaacggcctcactctccacctcaccagcgtcctgtcgatcttcgcgacacgatcaaccagcgccgtgcagcacgaggtcaccgccattcaacaaatcgctacgacgacgacgtggatggagtagctgccttcactaatgacctgcgtcgagtggattggccagccggctttaagccgactggaatcgagaagtatgacggcaccactaatctggagtcttggctcaccgtctacggactcgcaatccgcgcagcaggaggagacagcaaagccatggcaaactatctacctgtggccctagcggactccgcccgatcctggctccacggactaccccgtggcacgatcggatcatgggcggaacttcgtgatcacttcatcgccaacttataaagcacctttgaacgccccggcacacagtttgatctctacaacgtcgttcagaagtctagagaatcccttcgagattacatccgacgcttctccgaacaacgcaacaagatctccgacatcaccgacgacgtcatcattgccgccttcactaaaggcattcgccacgaggacctagtcagcaagttcggacgtaaaccccccaggatggttaagcagatgttcgaaaaagccaacgagtatgccaaagccgaagatgctattaccgcgtccaaacagtcgggcaccacttggaagccaaagaaggatacatcgaccgcaggagggagtggaagtaacaaccacaaggatcgcaagcgtaagcccgaagaacttgtggcgaccacctctccatcttcccgacaacgttcccgcgtcaacaccttcgacaagataatgaactcccaatgtccgcatcatccaaactccaaccacgtggccaaagattgcttcatctacaaacagttcgcggagcaatacgtcaagaacgcacgtaaaccttcagacggagatcaaggcacatcaaagaagaaagatgatgaagacgatgccccgactggtttccaagatcatcgcaaagaacttaatcacatcttcgacggacccctggcgtatgagtctaagagaaaacagaagctaacagaacgggagatcaatgcggttcagcctaacacgccccaatatcttcggtggtcagaaatagcaattaagttcgaccgctcggatcatcccgaccgagtggtccacccggggcggtaccccctggtactagacccagtggttcgcaatgtcaagctccgacggactctcatcgatagtggcagcgcactcaacatccttttcgctaagaccctggacgatatgcagattcctcgcacggaattaaagccgagtaatgcacccttccacggtgttatcccaggattgttagctacaccactcggccagatcactcttccagttaccttcggcactcgggagaattttcgcacagaaaatgtttgtttcgaagtcgctgatttcgagacagcatatcatgctatacttggacgaccggctttagctaaatttatggccgtcccacactacacctacatgatgatgaagatgcctggtcctcgaggagtcatatcactacggagcgacatcaagcaggccgtcacatgcgacaaagaaagttgcgagatggcccaaacccacgagactactctcgcccgcgaagagatccgactggctgcgaccacggcaagcgagggagaagtgcctacaaccaagctgacgaagaccgaagaaagtgatgccaagaccaaaaagattcccttagatcccttcgatcctgataagactgctgtaataggcgctgagttagattgtaaataggaaagcgcgctcatcacctttcttcagaataataaagacatttttgcgtggaaaccatccgatatgcctggtatccctagagaggtgattgagcactctttacatgttaaggaagacgccaaacccatcaagcaatgactccgccgttttgcataggacaggaaggatgcgatcaaggaggaattaaccaagctgttagcagcaggcttcattaaggaagtccttcatcccgactggctggctaacccagtcctggttcggaaaaagatggggcaatggcgcatgtgtgtcgattataccgacctcaacaaatcttgtcccaaagacccttttgggttacctcgcattgaccaggtggttgactcaacggccggctgcgagttactctgcttcttggactgttactcgggatatcatcaaatccgactaaaagaatccgactgcttgaagacctcgtttattacgccctttggggcctactgctacatcaccatgccctttggattgaagaatgcaggagcaacctatcagcgcatgattcaaagatgtttttcaactcagatcggtcgcaatgttgaagcttatgttgatgatgtagtcgtcaagaccaagcagaaggatgacctgatcgcggatttagaagaaacttttacaagcattcgtgctttcaagatgaaactaaacccggaaaagtacatcttcggagtgccgtcagggaagttgctcggatttatggtatctcaaagaggcatacaggccaacccggagaaagtcaacgccatcctcaacatgaaaccgccaagctcccaaaaagacgtccaaaagctgactggttgcatggcggcactcagccggttcgtctcacgactcagctagcgggggatgcccttcttcaagctgctgaagaagactgacaattttcagtggggacccgaagcacaaaaagcctttaaagacttcaagagacttctcactactccaccagttttggcctcgccgcatccacaagagccgctgctgttatatgtgtcggcgacctcccaggttgtgagcacggtcctggttgttgagcgccatattcaaaaagtccaacgaccaatttattttgtcagcgaggttttagccgactccaagacaagatatcctcaggttcaaaagttattatatggtgtcttaattaccgttaggaaattatctcactattttcaaagtcacttggttacggtagtcacatcgtttccactcggagatatacttcacaatcgtgaagcaaatggacggattgcgaagtgggccttagagttgatatctttggacatatcattcaagccacgaacttcgatcaagtcacaagctttagctgatttccttgccgagtggaccgagtgccaagaagacatgccagaggaaaagatggaatattggattatgcattttgatgggtcgaagaggcttacaggcactggagctggggtcgtcttgatttccccgactggagaaagattgagctacgtattgtggatacatttttctgcgtcccataacgtggcggaatacgaggcgctactccatggattaaggattgcaatctctttaggcattcgccgattaatcgtccgtggagactctcagttggttgttaatcaagtcatgaaagagtggtcatgtctagatgataatatgaccgcttatcgacaagaggtacgcaagttggaaaacaaattcgatggactcgagctcacccatgtcctccaacataacaataaggcggccgacagactggccaattttggttcaaaacgggaagcagctccttcagatgtgttcgtcgaacatctttatgaaccgaccgtgcctagaaaagagatagtcgaagccatggatactcaaggcgtaagcatgattgaagcctactggagagaacctcttgtaaaatttttgaccaaacaagaactccctcaagacaaaaatgaagccgagcggattttcagacgcagcagactttacattattcatgagactgagctgtacaagaaaagtccatcaggaatactgcagcgctgtgtatctttggaggaagggagacaattgttgaaggatatacattctggtatttgtggtaatcatgctgctgcacggaccattgtcggcaaagcttaccggcaaggttttttctggcctacagctgtgtccgatgcggataagattgtgcggaccattgtcggcaaagcttaccggcaaggttttttctggcctacagctgtgtccgatgcagacaagattgtgcggacatgcgaaggttgtcaattttttgccagacaaactcatttgccagcccaagagttgcaaaccattccgttgtcctggccgtttgcggtctgggggcttgacatggtcgacccgtttaaaagggtagtcgacggttacacgcatctctttgtggctatcgacaaattctccaagtggattgaggctaaaccggtcatcacgatcacagcagataaagctagagattttttcatcaacattgtgcatcggtttggagtacctaatcggatcatcactgataatggcactcaattcactggcggagcattcaaagatttttgtgaagacttcggcattaaaatttgttacgcctctgtggcacaccctatgagtaacggacaagtcgagcgcgctaacggcatgatacttcaagggatcaaagcacgagtttttgaccgactacgtcccaatgctggtaagtgggtagatcagctgccgtccgtactttggtctttacgcactactcctagtcgggctaccggccagtcgccgttctttttggtttacagcgcagaagcaatgttgccgagtgaagtggaacttgaatcactacgatttcggaacttcaacgaggagggctatgaagagggccgagtagacgacatcaaccgactagaagaagcccgagaagcagctttaattcaatcgactcgatatttgcaagcgttgcgccgttatcattgtcgaaatgttcgattgcgagcctttttagtcggtgacctggttctgaggaaaattcaaacaacacaagatcggcataaattatctcccttatgggaaggaccgttcataattgctgaagtcactcggccgggttcttatcgactcaagcgcgaagacggtactctcatcaacaattcttggaatattgaacaccttcatcgattttacgcttaggcatttcgtttgtatctttcctctttgactgttaacttcaagttttttccttgaagttttcagtcagggggctactataataataatggagtgtgatttttatcaattcaatttgcttacttgatgtatcattgccctgtttgatttcttggcttagtcaatgaggactgaaagttttttaacaacttttgcgggttttaggctcaacaaggtttgacaaaaacttttaagaaatcaggaactagttaagatatcaagcatagcataaattcatcagtattgtataaattgtgcctccatcatcattaatcatcaaaatcattggtacattaatcagtatcagtcttttcatcatcagaattatcaggaccagtcggtcgaagatcggtgtcctaaaatctctcaactacatcagcagcaatcttgtcagcggctttctgcgcatcactgatgaggtcaagagcaacttcttcgctcgtcccgtctgcaaagccatcaatggcatcaacgtcaaccctcggataaagagatttggtcatcgccaacgccagacttgctcccatacttctagcttctttgatgttcttgaaatatgtatccggagcaactcttagcttgtcgaaaatttcagaagcatcaagtgcgcttggccgttgttattgaagaacatcgcttgaacaattggggcagcagcgttagcaacctcatcccgggatccttcaagtttttttatcttgccaaccaggacgtcgaattgagcttgagatttgatcttgcggtctgcatcaacagattcacattaataagtcagcatatggaggataatggtttttgaggtattgattgttgataccttcaacttcttttaaagccaggtttctttgtcttgccagttctgccttgtcattttccaggatttgaatttgcttctccaactgagatatcttggcagcttgcactacattgattacggttaatcaagattgcaaagataacagtatgagtcaattgagcagagtttgtgcataccttttgatgagccactcagttcaaaatttgattcctggagctcagcgatccgatcccgtagatcatgttcattcttcctggcaagttctttcacttcgtgcagttgattcctggtggcttcgagggttccgagatgagggactaacctctctaaggttgccgttttggcttcgttcctaagatgaatcctctgcaagacagtttaattagcgcatgaattaaatggcaaacgagatggttgagatcaagtaccagagggcttacatttacaatgcgtgttgcctgaccgagtgccttcttcagtaggcataactcttcgtcctcttttttcttacttatcacgatcccttgaggctgcatgttgtcatcccaccacttgaccagaatcggagggcatgaatcctcagctgcttgtatacgggggatttcttcttcatcaccaattattggtcctaatgtattcactaacaaaggttagacaattgatcagagttatttgggtcaacatggtttcagacaaagtgtttacctgtaatgatttctggacgaggatgagtggactcagatgcttttaaaggagatccagatctccggtcattgctggcgtcttgtccctgagggttgtctgcttgggtttcgacttctggaatctcttcgtttgcccctgcatccgactggtttccggtcgggggctcctggttagcaccgacttcagcttcggccgactggttcccaatcgggggctcgttgctgggttctacattgtccgttgccggctgattgtcactcggatgatcctcagcagttggtccggtttctttggaagaacttgtgtctacgttagtcgggttagagtctttcccggacggatctatatcagatggtttcctgcaaatttgattatcggtgttattgccgcaatggatgcgcatcaatgcaagagagatcgttatgtgagttgtacctagaagacttcctgatctttggtgcagggcgactgaatgttttcttccttggagtagcctgttttggtagtttcttggttgtctctcggtctccaggcttcctggtggtatcatcggcttcgtcgtcacttagaaccagcttcctctttcgagaatctgactggccgactggatcagaagcacttggttgagtttcggatcgaattcttggtcctccgctcccttgcccagtttggcggcggggagattggcgttgagcaattgggggatccgacttcatcaaagcaaattcctgggtataatatctttcattgttaactgattcaacaagaagacgatcatattttgaaaaaggttgaagtgtatgaatgcgtaccggtggaggaggattgaatgcattgaacggtacgactggcagcaagtgtgagtagctgacaacgatggcgtttgaaaagatcttatacatcctttccttcatgaccttgaagtcaagagaatctgggtcttcacggtttgggtcatgcttgccgtcgaattcgaaggctgtacgagatctttctttgattggagctaaccgacacttgataaagtgcctggtgatctgttctccttgaaggccctgttctttcagctttatcatcctctccatcagttctactgcttgtgcggcttcatctcccattggcagcgagttccaagtatcctgataaactggaggaagacaggagtactcgggaaggacaggctcggggttttgaacataaaactagtttgcgtgccagcctttatttgaggtcttgaagggcatggagaagtatttttggcttagagttcccctgagttggaaaccagcacccccaacgacgcatggtttgctcttatttggctggggcttgaggaagaagatgcggtggaacaaggcgaaatgaggcctaatgcccagaaaagcttcgcaggcatgaataaaattggcaatatgcactatggagtttgaattcagatgatgcaagctaatcccgtagaagtttagaattccccggaaaaatcttgaggttggaagagaaaatctgccatagaagaaatgagcgaataccacgatctcatgtgtatctggggtcgggaatgcctcaccaaatgccggtcgccacccgatgatctcttttgctggaagaacgacgtgcgccaccatctccttcagattgtcttccgttacatcggagggcgcccactgactttcgaagctttctctttcctctgccatgaatgtgaactggacggtctgatttagttcgagatacggctggaaagggatggggaatcggagcggtggatgcgaggagaaatttcgcgaagtttttgagggtggattggagcggatcgatgaaccctagtttgcccggcgcagttttgcactgtagcagggaatgttgaaaatggcgagagtctcggcggggaagacgaagagccgtttttcacttcggcattattagggtatcgggagtactaatgggcctggacctatacagtacttcagcccaatactataattagcgtggcctgttgtgatccctaggaacttaggcgctttttgctttggcaatatgtgctcacgatgatgcggcccgatgctgttaaaatcctttttaacgcgattcaataattctttggaattattatgatgcacattaaaaggtgcccgacagaaaggtgttataccatttttgtaaacctttttaggctacaaaagctattgggttaatttgagatgactggtttattagtagtcattctcctagcatgttatatgcttattttgattgtggtaagggttatagcctaggctaatgaacttattaattaccatgatctttatcatatttggtggatcattttaagagtttcttacttggattcttaccaaatatatctatttttggaccttttgagtgtttatcattcggccctttttatattttttgtccttgatatgttctagttgaggagcagtcggctgggtatcttactaagtaccatgcgtgcttcgctataaaaccactcggttcttgactatatgtttagtttttcacatagtcgggggctacacctaattaggtgcatctactcgatgcaccatgttttattttcgcccttcacagtttctgatttttactactcggcaagctggagcaagttgaattgaagcactcggactactggtttttgtttcgagaaggttatttcgtcaactacgaaggtctcgggggctactgtggagataatggataccccatatctgcatgacagttatattttagtcggatatacagtaccaaatatagatagaatatctttatgaggactcgggttagattctaaacttgtatgtcaagaaaatactcgggatcctagtcggttacgattgtattttatctgtaatcccatattccgttaggatatggactgtactttgtaatacagatcccttcccttatataaggaggggtccgggttcctctcgagacgattcttttttctcccaatcatacaatcaataacacactcggcggaatcatccccggacaggagtagggtattacttcttaaataagaaggcctgaacctgtataaaattccttgtctccaaacccatccacttttctagcttgatagccacccccttttattattgccgaaatcttgtttcgacattgatcatttaaggtaacaaatacaatttcctctacagattactaccatcggagcatccttttccttttggcatatcccttttaacaaaaaaacgttgtgctctaccacactcaaacttatcattttctaaattaatttgcaagaaattgattcttatttcattctaccaatgtctgaagcaaccgtgcaaggtatcaactagtttaagtaatatattgtatttgttgattaacattatgatgagtcgaaaaccgggaaatattcatgctctggacatgggctaaaaggaggtaatggggagaaactagacagagtttgttccaatttaaatttgaaacgaaggctgtgaaataattcaggaagattcctacaaatacatactactataaagtatatcaccttaagcattgtgaaagtaaccttaagtattgtgaaagtggaccataagaatctgacatcaaaaataagcattagccttatggtgtggcaacaagactatagaatgtggaagcgaggaactcctacggtgaggaggttacgtgttgataataatgccacaatcgggcgacaggattacaagagataaatagcttcggtgagagtttgttgtgtacagctaaactacagagattgatcatatcttatctaactaacacaacaaactctatcctcagccatacgggagtattatcaaatgtacatgcaatatatccaaactctaacatagaatataatacttttgtgatgtgttgttcacgctagtacttttggggaattttcattgtgcaaagagtttcacaggaggataagaagtgattttttttatccttcggtgggacccattgggacccagcttattttctcccataggcacagccattgtggatatggacataactaatgcttactatagcgggtcccacatatatggctgatggaaccataagcattggccttgccctaacctattggcacaaaagattttctaaacatattgaaattaccatagtttttcactgagacaataaacaactaaaatgatttctttggtatagcttcagatccaagatcttttaaagtgggtattttacacatgacacatcacatcacatagaacctgaaaatcttaaacatttataatttaacatatgaataaactattttttttattttaaatgaaatctaaaattcttaaacatttataatttaacatacaaccttcaaataatctattatgtaactgtgacgtggaactgtgccaaacaggacctaagcgtgaaaaaagaaaattatgatgggccgaaaagccattgaagaacagcccaataagcccactgatgggaacgtatagctgtccctccgcggtcaatccccatccacagcacgcccctctctccccgacctcgagcatccgccgtcgacgtcatccccacccgccgccgccgccgccttctcaccggagctcggctttcgcccgggagacagacaaaaccgtcctgctgctgctcggctctcgggagcaggcggttcccccaaatctcccacatcctgctcctgctaatggctgcttcttcccccaaatccctaccctaaaaactctgctgctgccgctgcataggccatgggtactgacgccgttcgcaccccctctgcgcgccgcgcagcccgaacccgcagcgcatcgtcgggtggggaaacaccaacggagagctccggccgtaggcgctccaagcaagccgccgtaactggcgagcgcggtggtcggcgccgacccgctgccggcggtgaggtaggtgcctatgctcttctctccggttcgaattctgtgctagtgctaccctttgtgagctttctcaggtattgagctgtgaaatttgagcaaaggccttgtgtgtgcttcgatgtggggggttttggaaccctaatttcaatatatctagtgtttcatctctttctctttttttttctgctacgaggagagtgattaggctacatttgagttagtgatagtgatttgctgttgatttggattctaggaatcatacttgtaggggggcagagatgaagagggtaggaatggatatgtagtggcgcaggttcttcctcctctactacttgtttctgctcgtcctgcaatcttatcgttgtatagaaatggttgcgcatacatgcttgtactgttggctgttgatgtttggacaaggtcaagtgtggctccttcccatggtggtgatgtgtggctgctatatgacataatatggctggtgacttgtaagtgttttgggtattgctagaggaaatattaagctagattaagacacctaacagagcttttatgtaggtaattttgttgtctgtacatgataataactcatggcaaagctagatttatacttcggtgtattctgcttagtttgttgtatgctaaacaaagtgtatgcactgatgtaattttaagtattatacctcaaaatattgttatactcatgtttgtactaattatggatggtgaagatttagtgtattaccacaatttgtataatttagacaatagtatcatgtctaattaattttttgtatataatttgggttaaaaaagttctagcttctaaatttttaaccaagttgccattcttttgtttaaccaatcgcatggatcgaattaagatatacaatttttaattagaatctaattaattgtgggttgtttcagcttctcaaaagccctcgctctggccgccccaagaaccaaccatcaccgccaccgcaggaggaggaagagggaaaccatggaagcgcgcgctatgactgcacttttcaggatgagggaggccatgattttgcaccgccagagcttgtctggggcaaggtgcggagtcacccatggtggccgggccaggtgtttgatgctgcagatgcttccaagcttgcgctgaagcataccagggcaggcgctccccttgtcgcctatttctgggacaagaccttcgcttggagcgatgcctcctcacttctgccattctgcagcaacttcacgcgcctggccagccagagcaccatgtctggttttgtatccgctgtggatgctgcactgcaagaggttggtcgccgtgtagaggtaggcctctcatgcacctgctttggtagtagcattggcaagaggcaagagattgagaattctggcatccgtgaaggggcttatggtgctgttgtagatggtgcgtacatgaggggcgcatatcatggtagaccatttcttgactacatcttagctctgggaatgaatccactggctggtgccgaccgtctcgaacttacaactgccaaagcacagcttagggcattcaattgctcaaggggtagtaggcacctccctgagtttgtgacctttgaggggattgaggatgtttctgtggcgatcccacacaccaagaggaaaaggatggataaaagtggtggggatgatgtgatggacatggagaagaagccaaggcgtggtgagagttcatcacgcaagaaaaaggttttgccggaggctggaaagaaggagattatggatggggaaggttctgtgccaagtataggggcaacagaagatacattaagtaaaacaaagaagtcgaagaaccagaactgtgcagcaaagaagaacagaaacacctcaaaagatgcagatgggcttgatatggatgacaaaggttctgtgccaagtaaaggggcaacagttgatacatcgagacaaataaagaagtcaaagaaccagaacagtgcagtaaataagaataaaaacacctcaaaagatgcagatgggcttgatatggatggcgaaggttctgtgccaagtaaaggggcaacagatgatgcatcgagtaaaacaaagaagtcaaagaaccagaacaattcagcaaagaagaacaaaaacacctcaaaagatgcagatgggcttgatatggatgacaaaggttctgtgccaaggaaaggggcaactgatgatacatcgattaaaacaaagaagtcaaagaacaagaacagatcagcaaagaagaacaaaaacacctcaaaagatgcagatgggcttgaaacagttggtgcaagcaaaaaactgtccaagaaggctgtggatgaaaccttgagtgacagcaaatcagcacgcagaacaagatcaacacgcatgaagggaggcaccccggtagccttgaaaggcaggggaaaggatagtggtgctgaatccttaaaggtggaagagaagaatactgctttgctcaaggagaataaggtggggcgtagagctggctctgcacgcaagaagtataaaaccacaggggatggggacggacttgaagatggcaatgccaatgtttctgtttcttctggcaagaggtcaacgcgtggtgaaacctcggtagcttcagaagcgcgaatctcagagcagggtaggaagaagaagaaactttctgaacttatggcagtgacagatgtgcctaatccttcttctggtggtaaaagcaaggctcgaggcaagcgttctatggatgcatcaactgagaaacttgaggatcctgatcgtgatttggaggatacaatgaagactaggaaaagaaagaaacttgacacattgggggatttgtcttcccagccacagcctgtctcccgcaagagcactacaaaggttggagaattgatgcacaaagctgctggacaaatgtcacagacacgacccgttcgcaaagctaatggcgcagtatctcagaagaattctcgtagcactaaagaaagacaagtaaatgctccagacaagtctgcacattctctgaaggtgaaaaagggcaagactgataccttgacagaaaattccctgtcttgttctgaaatgctgtcacagctctccctagcagtatttaatcttaagaaaaaggagagattttccagtgcaggcatgaacttctttactgatttcaggaagtactcgtatgcttctaggtctgatgttgagaaggagatatatgggaaggcaactaacactggatcctgtgcttcattttctgatgttgatgaggatattcctgagaaagctgccggcactgagcccactcctttggaacagcccttggctgatcatatgcaggatgattattgggctgacattctgattaatgtggaggaaccactgtctagtctcagaaaaaagaaagataagggtgtgaacagaacaagaaagaaggaacatgttaaaaaacctgccatgaaatcatcatcactgggaaatatagagggaccaactgttgaaggttcagagaacaagcaaccgaatgcagaaacacaactgagtgttgcaaatggaactaaagtaagttctgaagaaacggaaagttcctcatttgctggactagtgctgcacttcagcaggccaggtgctgttccgtcacgcagtgaccttatcaaaatctttagccaatatggacccgtcaatgaagccaaggcagagactgcaaacaatgctaactgcgctcaggtgatcttcaagaggcgcatggatgctgaggcagcatttgcaggcgcagggaaaatcggtgctcttggaccagctcttgttagctttcgcctctccgacttcccagccgctgcctcaggaaatgatcctcggcagggtgcatcgaagagtgactagagagtgtttacccacctgttgaacctgttgatactcggtgaggtaaattcgatgtatttcttcctgtatcactgccttccattgacataacaatgcggtcaccttttgctgtattgttcaaatattaagtgagtagcattcttgttttcgcaggtgaaggagctgagttagtcagaaaaatgtctgttaggtggtagattgttacaggattaagcattcataggaacaaaaggttgtgcatttgtcatgtaaacatgtgattgttaagctgtccgcaggtcagatcagtgaccaataaaataggctggctctgtaagaacatgttgtaagctgatctatacctaaaaagttgagcttaatttgtcaatgtgagtagcgatactgatatgcgtctggaagctatttgttgtgccctcgcggaacaggaataggtgggctactgatgaaggtactagatgaataagcgcggcttcaagccacgcccgtcaatgtgtacatagagttagttgaaagtaactaaatgagaaataccagtatataatcaagtatgtgattcagttagcatcacaaagggagagagtatacatttttagtaacaatagtaaggataattggttgtttgttacaaagacaatagtcagttaaacaagctttgccacataactacacatataaggatgccatcaacatgtaactgcaatcatcagccaactggaatgccataagaagcaaggtccaatattgctcaaattgccacatcacaccaacatttttatacatctgtatgaacaatgcaccgagtaacatgaacttgatttctttgtactgtaataaaaccaatatatatataatggattggtaaatgccacgctcaagaacaaaatcaataatttgccaaaaatgccttgatgctcttttcattcccttctggatggatgcaatctcgtggacaggacaggtgtaacaatctgatgcagaacctacttttgagatttcgaataaacatgatcacagaaattgatgtaactgcaaagggaagcaaagcatgatgatatatatagtgtgtcatggtttacctgatatatgaacgtaagaaagaagatacacacaggtaaaacatatgacaatagcaatggcaacagagactactacattgccaagccaatttggtaggccaccagggttcctgcaaatttaaggtacacatcagtttggttgatttaaattaattgatatggtgccttataaaatctattagcagttaagttacaaagtatttttagtcctatcacaaaaacagcatatcttaaaacagagaaccctcttggaggtcgcaagctcaatatatgtatctatcaatgcgtacaatactcccaattacaacatcaaccatgcaaataaccaaaccagcatatgacacaactggtgcagccaatgccaaaatcaatgtaataaccttaagctgtttaggtgaacgagcatgagatagtgttgcttccataagaccatctgaaaagaaataacagatgtgaataatgaaggtaaatattaatccatcacctttatcgtaattagtgatctactgggcttactttatcaacagtggctcatatacagtaataactacatcagttgctgcattcttgaggcgtatattggccaagtaaagttgcaagaggtaatccaagaactcagtttgaagaaccaagatttcataattttcctgctgtacatactaacgaaggaatagatatgcactcactcgaacaatgttctgtgcttctatgctttgccttccttttgagatagcctacaaaaatgaagaaaattaagcacaagattttgcactttcctggtcaattcaccatccagtgttcattatacagcatatccaagctatcaagtatcaatgtgcatcaatgaactgaactaccagagttaatgaaatcatgatacacagtagtttgataattttgcacaaatcataatgtttcatggatctatatctatatatgttatggaggactcttgatcattattttttcccaaactttattttccacctagacacctgcaataatacttatctagaaagagaaggatgtagaacctaacatatacctccaacattatgatctaaggggtcatcaattatatgtggtgaacatgatcgcagttgaccccaactaaactacagtaggatcagcaacattagcaccacttacatgtaacaagtcacaaatgaaacatgaaacagaatagcactaaagacgtagcccactcgataaccatgaaaaaagaactcctgacgaacaccatccaaaatttatagaactacagttgagattttggcaccaaaaaatcagagtacatgcacctaacaattcagtccatcctaaaaaaaattcaacaccctatttgaaatttaaagccaactcatccgccaaatctagaacctctcccttggaaacccctagttctcacagaatcaaacatctcaacctctcccaagagaggaacccccaattatcacacaatctaatatctcagcttcaccccggtctagatttgattaaaagcaccagctcactcagatacaataaataaaaacacaagggcagaaaactcgccttgatgacctcaatggcatactcgacctggaacagacgcccgtccagtgagaaaatggttaacccgcggtcttactccatcctgcacccatccaccaggaaaatcccaataaaatcagccccgccatcgccccaacgcggccatagatcgaattcgagttcctgcaacagaattgaagcatacctcatgagaaacatcaagtgggagctaaggattcccccggtggcatcagttccacgcgccacccgcccgacaccgccgcgagcggagggagaagggggggggacaccggcgccggctccgacgccgccacctgacccaacgtcgccaccagagaagggaaaggtaaagtttttggtacagtatctgtggtcagtatcctcatgctgtcagatattcagacattttgagtccaaacggaactaaatggagtactggtacctacctccttgagaacattctcatggctcgctctgctgatcagtgagaatgctagcacaaatatatccgctcctctgtagctcagaatcctcagcctgctgtaatcctcttgtcctggatgaatcaaacaaaagaacacacgatgttcagagattggacagttgcatgagtaaaaaggaaaaataaaatctcagtagaagagagtagaacaatggaagaatcagttttaccagcagtgccccataatcccaagttgatgatgttcccatccactgaaacattagcactgaaattgtcgaacacggtggggatgtaatccagcatagccaagaaacagcatcacaaacgctaccaagaaatgcgcgcgggcacacacacacatggtctaaggcaaagggtgaggggatcgagatgattgggaagatacacaaaacgaggtaagccattagcgcatgattaattgagtattaactattttaaatttcaaaaatggactaatatgaatttttaaagcaactttcatatagaaattttttacaaaaaatacaccgtttaatagtttgggaagcgtgcgtgcggaaaacgagtgacaatctccccaatctcctttgaaagaaggcagcctaaatctgatgcgctgcacactcgtggagggctcgatgctgagccagtccctcgtcctctcgcaagtgggggaggatacttttgggggcggcggaatggtcgagacaggtgaaatcgtcgccgacggctggcccggtgccggggttggaggagacaatcgtcattttcgtcgcagctgccgtcagcatcattgccgtcgtcgcagccaccgtcgccgtcgtcgttgtcgtagctgccgcagccgtggccgctcgctcccgcccgcctaagcccgccgccgccgctcccgagggcggaggcggccagatccgcgcgctgccggcgctcccgctcccgccaggccgttcccgaggacagagaacactggatccgcgaggagaaggagaagggggaggggcgcaccgacgccgacgcacacgtgacgtcccgtgcaagggcggcaggcgatgaaggcgaagatggtgccgcacctgtcggcctccgccgctccgtcgccagcgcctatcgcggtcatcttcctccgccgcgccgtcttctccggtcgccagatccgacagcggcggcggcggatacagccgagggcgtagccgcctcgccagatccagaggggagggccgccaccgccaccgccctcccccctcccggcggagccgccgccgcgtccaccctacacggcacgcgccgcctccaccatccacctccgcctacaccggatctgggaggagggagggaagccgccgctggctccaccctccgcgcagccaccgccttgagccgcctctgccaccgtcagtagccgccgctgccgccgccaccgccctccggcggcagctctggccggaacccgcgccgagagaggagaggtgggaggggaggagagggagagaatgggggaagggtttcgggattggggggttagtgtaggacgttttgtagaaaaccccctatggtttttatgtttacagcgctacccctagaagcggaattttctcttcttcgcattgtattttcctagaagacgaggggttatacgcaagaaatacaacgggatgtcaggcggtccgaggacgtatacgatattccgtgcaaacacaaggagttttttacaaaaatgcccagccctctcacctggagcagccctccaccccaacccgtatgcacaccaccacagcgcccaaattttaattaaccggcgcacctcttatgggcggttgcccctgcgcgcgcaaggagcaggagaagtagcagccacgtgtaaaacaatgagatagcccaaaaataattaaaaaaatgagaaaaacggtggggttaggagagttattgattgatgatatgcgtcttgaatagagggttcactcacttctggaactcttggatcattatggatttttggccttatggggaatggatgtgcatgacactgcggctttattccagaaatatgcaaatatgcaatgcagggtggcgcagctctagcttgctttgctaattgctcttaatatttgtgttgtagcgtgtattacttactagtatttttttttctttttttactctagtaaaggccgttgggtctgcaggattaaaaccaggattaagggcccctttgatttgtaggaaaaatgtagaaattttagaggatttcaatctataggaaaaaaatcctatgaaggctccaatcctttaaaattcctatggaatgggtaatcctatgcacattttggaggaaaattagcaagaggtctaacctcttggaacatttcttctgtgtctatctctctcatctaattcctgcgtttttcctgtggtccaatcaaacggccatttctgtgttttgcaatcctctgttttacaattatattcttgtcagtatcctgtgtttttcatatttctctgtttttttattcctacgattcaaagggccctaaagcagggtccagctatgagctgcaaacaagccacggtacgatagtacagtactgctaacaaacaagccttatacgtctctgtatccaaaatttacaaagatattggccctaccaaccattatagatcgacaggagcacctaaacagaactaagtcgtgcaactttataatcaacatattggcagtgagtaaaatactaaatctatcgtttgaatgttatcaatttcaagtatggcaacaaataacaatcctacaatgacaaagcccaggctgcattggccacgtagtgaggccttgcatctggggccctgctgtcagagacagcaacacagcgagtagcagaatcagacatgatgtgacctctgtgtatcataacggtactatcattataagtatactaacatgtgagataatataagggtggaacccatacactagttgctataatcatagggacattatgatagagaattcttacctgtgatatttatctgcaaaatggatgacatcggtaaaaatatcatgagatcctaccacccactgtgacgtactatgttgtcatttatgtatttcagtttaagatttgcaatttcacgtatgatagatttttgcacttctatctttcgatttttcatccatatgaagctgcattaagattcatgtttccatatccaacttttagttacacccaattatagaacacttatatttggttatggagcacttagttacaatgaatttccactcagttgcagagcacgaaattaaattttataactgtttttgtctctagatttacaatttttgacctgttcctttttttcttatttcattcaaaactagttgtatccattagttgaaaattctgtagatttgaagctttaaatttatcgaacaattaataggtaatcccgtataaataagattatcgcacgcaatgatgtagtagtattgtgcttgcacgaagaagttttgatcctcccgcagtactagaggatccatacaatgagaaattggtacaccgccaacagggtgaagtttcatcagtaataatcaaaacacttttatgtctacccactcccctagcttgcatcccaaccctcattggagagtctacatatagtaatgcaagtagaaaattaattaagtagagtcaattctcaattctttacagcagtgatggtgtcatggccaattattttatttccaggcaagagacgttagttccatgaccagaaacaatactttccctcatagaacatatcctatgcatacaagttttttatatgcactccgtacaaaccaattaacaaatatcacgaaaaattctcgaaagagaatctgacatgtatttttaatagtattacaaagtcttatatgcaaattcattatattttagccttaaaaaagtgagagatctgacagttttcagagtaaaaatctgtcagaattttgtcttttctacaagtaaaatataataaatttgaagatgagatttcatagataatgaatttgcctattgaaaagtccaatcttttttagaatttttcgtgatatttgctgattggtatgcatagagtatgtatggaaaccttgtgtgtataggatatgttccctacttctaattgttaagtagatggtcgttgtcattgattcttatgcttgtatttgactattcatcttattttcaaagaaaattataattataattatttttatttggttttgtcattaataaagataatttagaaccacttttatttttatatttgcataaaaattataatatgataaatgataagtatatcctaaagccaatagcgtcccctattaaaaaccgaaaggattactatttataaccctcgtaatcgcgccagagtcagacagacgatcgataggaagtaatgcaatcatttccatcgttcaagctcagagaagaagtcgagcagacagaaatggcagcatccgatcaggctccaagcatgttggtcccgaccgacgacgagatgctgcaaacgcaggccgagctgtggcgccacaccctctcctacctcacctccatgactctccggtgcgccgtccacctcggcatccccaccgccatccaccgccacggcggcgccgcctcgctgcccgacctcgtcaccgcgctgtccctccccacggccaagctccccttcctccgccgcctcatgcggctgctggtccactccggcatcttcgcctccgacgatgcagggacgacgtaccgtctcaccccggtctccttcttcctcgtggacggcgccgccgccgccgtgcccgtcgtcgacggccacctcagccaggtgccccacgtgctcgcctcgacgtcgaggcactgcctcgacaccgtggcggggctcgccggctggttcagggaggacttcccggctccgtcgccgccgtcgccgttcgagcacgtccacggcgtgacacctctcgagagcacagcgaggcttggcccggaggatgcggcgctgttccaggaaggcctgagggtgtacgacgcctccgggttcgccgtggttctccgggagtgccgcgacgtgttcgacggcgtcgagtcgctgaccgactgcggcggcggcgacggcacggcggcgagggccatcgccgaggccttcccgcacgtcaagtgctggacctcgcccgtgtggtcggcgacgtcccggccgacggtgttgttgagtacgtggcaggtgacatgttcgacttcatcccaccgagtcaagcaaggtaattaattaattaattaacaacatgagtgagtaattcgtaatccattttgtatatatatcttacacgaaaagaaacctgcactagttctgaatcggtgaaacctttaatttaatctgaacacatgaaagtttttaatataacttgaggcgaacgcgtgcttcgcacgctgcaccagtggtgccatttaggagaatcagtgattacataagttgaggtaggcagttgaaacaatgttctttgtaagttcaatgaaggacatgtataagtataactaaatgatgtatacagattgaggacagtaaatacataacaaaacttgccatgtgtacgatgacaggatatacagtacatagtagctttatagcagtagcattgcaacagttctgctagatgagcacatacgactatattacagatggctaaattctaatgtggtttggatgcctttgcagtaattgacctttttccccatgaattcagaggattgcattgctggtttactgcaagggccttcttgttgatgtgtaaatagaaggcacattttttggtacgatgaattgcttccacttatgcatagttgctcgagaagtgctgcaaaaatacaattttagtgtcaatattgagagccaataatgttgtggcgttgaactactcaacaatattagtcgtcccctcctaattttctttttctgaatgtgaataaaataagttaatggagttatttttgtggcgtatgtttaaattgtaaggatgaatgcagtagtggtgtaatctgtgaatgaattaaccgaaggagcaccagcaggtactgtaccaatcttagaccaatgtgaggaaatcaatcaaacatctcaatgacagggaaacacaaaaaggattgccaaaaccgaagtaatgatttatccatactaaaaacacaacaaacatgtaaacaatctaaattgttctcttagtatttttctcataatcatgaaagtgaaccaaataatttatccaacaacatatttatgcagcaaataaagttgaaatggacaggattgtaaatgtcaatctatcgttaaactattggtgttgtgcatcttttacatagattataggtatgtgattttaacacttaattcattgcaagcacaatatttttgtgagcagatactatcagtatgtttaaaggaatatgatgaaactacaaggtacaagctagtcataatttggttacaacctgcaggacaacactcaacatcaactgaagcttcatggtaacaccgcaagttggttgcctattgttgagcacctaaaatgatgatgagcagaaacaaaccaactgtgcttccaccaattcctacagctataaaaaaagtaaattactcatcaaaagatcacaacatttagtatgtgtcgaaatcgaccagcacagtattgcacagccaatagtttaacaactgcagtgttaatatgtcacttacttaaaagcaaagctgccctgctgaaagcttagaatgagaaaagaggctcagcaacagcagcaagagaatattgtaaaaaagtttatatataagcaaaggcctaatcaaagtgcaaaattagcccatttggaaatgggctgaacaaataacttgtactatataaaataaagagtaaagtccatcaccggtccctaaacttgtaccgctatgtcatcctggtccctaaactcgcaaatcgatcgttcaggtcctcaaacttgttcgactgtgtcatcccagtccctaaacttgcagatcacttgtttaggtcctccaacttgctcagttgtgtcaccccggtccctaaacttggatttgaatatcatctgggtcaaataggacggtctaaagactttatatttaaaaataattcataaccttttcacgtgaactctaatgaagataaactttatatcaaacttgtagtcctcgacacgatctacaactttgtagttgaattttttttattttaagtcattttttgtcccaaaatgtaattttaaaattaaaatttcaaaatctataaacatgcaacaatattttgggaccataaacagttttaattcaaaaacttttcaactacaaagttgtaggtcgcatcgagggctacaattttgatataaagtttgtcttcattagagttcacatgaaaaagttatgaattattttttgatataaagtttttagaccgcctatttagggaccggggtgacacaactgaacaagttggaggacctaaacgagtgatctgcaagtttaggtaccgggatgacagtcaaactagtttgaggacctgagcggttgatttgcgagtttagggaccgggatgacacagcggtacaagtttagggaccggtgatggactttactctaaaataaatgtgtagtttgtttcaaaagaggaaaaaatgtctcgcaaggaaccgtgccactgtcctagtcatcatataaactacatcatgctattatttcaacttaacttgtagaaaagcaaggataggtaagcaaagcttttgctttaaggtcacaacgggcagattgattaactgcatacttgttttaccagagagaaccaacagctaataatagaggttatatcttaaaaacttcatatagctagcttgtcttaaaaataattactaacttttcctcaaaattaagagatagtgtacagaaattgtgcaaccatgtaggattcaaacgccaaatacaaagtactttacaaaccttcgaatgatattttcaattttaccttgaattaagggaggccgaggtaaaaaatagtactcaatagtttgggggggggggggggaacataggttccagatgaagggctataaatcttttgcagattgccattgttcccttttcttcaggctgctctttgtcctaagatgcaatacaacaaacatgtggagtgcagggtaagtgatagggaaatgatttactgccaagagaagggagaagagtgcataactgtcaggctagcaacagattttattacaaatagactctacaaccccatcaataaacactccatatattaacgggcatatttaagaaaaaagaacattggaaaatccatttgttgttttaaatttcctgatgtctacaaatatgggttctcatcctttgctgaccaaaagcacattagtccatgacagatttagagccaaaccacttccaagaacattttaggtgggcgtatttgcaattgaatgaacacaaccctatagtgttttgttcttatgcattcacaaataaaattttggtcaaatttatacaatgaagcaagcatgaagaaagcaacaagaggaaagcacatgcaccttgtcaattgtggaggccttcttggatttgaaggtggacgtgcaagtgtggaggcacaacgtgaaaccaaccgctggtccatgatttgctggaagtaccgctgcggtggatagaggcagctctgccctgaactccctctcctttcttactcttccacagctgctgccaaggaagcaattccacaaacacatagctggtaccaatgaaaatattgttcagcaaaggatgaaaatagatagactacctaggaaattattgaacagtttcaaatatcacactacatgatgagctaacaaaatagtaataatcagtcatcaccaggtttagccaaaagaaatttagctgtgaacttctgttccaattacttttctatatttccatgcaaatttagaaggaattgtattaattgcaccaaaaacagtcaatgatctgaaatcatgaaggatctaaacatatacaaagcaaacctgaagagatttttttatcaagagtgcagcatcattttttttttctagatggaagggtccgattaaatttttaaatggaagtgcagtatcacatttggaagagtggcaaacatgattagtgcctctgccaacttcaagaatcagatttaacaccgctaaatactttgcatcaaacatacgcagctggaccactcgtcggctggccctgcatgcacctctgcaattgtactgttagatgaactcaccatccattcccaggaccagagtgggcagctataccaccatgttgatgtggagtgaaaacatttagatcaaactgacagacaacagttaggtgctaatgcatctaagaactattttagccccaacttaattgcttcaaaaaattagtcactcactgtattattcgaacataaaagatttacacaaaacactaaaaccagaacttcagtcctatctttcaactgtattaccagcatagaacaaataaaatgtagtatgtacactgctagtaaatggataagaggagcactttagatcaaactgacaggcaacagttaggtgctaatgcatctaagaactattttagccccaacttaattgcttcaaaaaatgagttactcaccgtattagtcaaacataaaagattgacacaaaacgctaaaaccatatcttcagtcctatatttcaactgtattaccagcatagaatgaataaaatgtagcatgtacactgctagtaaatggataagaggagcactaaaaccagaacttcagtcctatatttgaactgtattacaagcacagaatgaataaaatgtagtatgtacactgctagtaaatgaattagatcttaaacggtgtaatctaagatctaaccaaaaaggacaagatatttattaaacaaaagtgaacaattaaactaagtattcaagtttggaatagagaaattcaagtgaaggagaagttctccatttttgcggcctacaacaaaatgataggacagatggccacaaagtaaaaaaaacactcaatatgttcagattatgaaaaagtacatacagtctgagtatttggaaccaaaaatctattggatgttccgttttgatagcacggacttacccctctaaatttacagcacatcatgcccaagcatctgtaatatatgtcataaatattaaacatcactttgatggagaccgaactttgaattctgcacaagaaaggatgaaatgcatctaagcttgctgttatgggaaaaaagcatataaattttgaagccagctatcctaagggaaaaactaatgcgagttctcataagcatatactgtcaattaaggtatgttcttctatttaactaaagcgtggagatgtatagttctcgtaagtactcagtagaaaaagattgttttactaaaatgaccaaggttatattttctttgttagatcaaagaagataaaaagcaagagattgcgaacatatgacaaattagctaccacatcgatggagttgttaagcaaagcaatcagcataccatgtaatggatgagcagagcatcacactgaggaaaagagcatttgcatggcaaaccaccacaaatcagagcacacatgggaaatataaagcaaaaacattatgatgtacctgattaacattttgatagcaaaataaggagtgttatgcataatactttcaccaccacaacagcattgattgtccagcaggcctccctggatatccatattatgatgatgcacttgtttgatgcagcaagagtcgctactatatgtcaaagccagcacagctttacctacttctcccaatcaggtcatcgctaattgcaacaaagagagaaaagcacactggctagaattccatacactgaaagatccagcataataggtggtctcagatactcagacactgaaagatatgatataatatgtggtttcagatattgggatcctgtaatctgacaacatagtgtaaaaatgaaaaatttttaatgctggataggttcaatcgatgcaacttaaagtcagtacatggtatacataagttacaaacaacaacagagtaagcagtaggcggtagagggatggaggaaaaagtacctgcagagatcaatagtaggtggtgcatagggacgagcgggcctgtattttagagatgtccaagaagtagttgtactcaaccttgtccataatccctagatccatcatgtcccatccacaaagagacaaccaccatatcctggcaagcagacaacaaccggatgaaccaaaataatcaatcaagatagatcaagctgcaaacggaccgtggccaatgccgcgatctcggcatcttcgcttatcttcgcctcgcgcagccgcacatgggatgggatggaccggcagtgaagggggttgcacgagttccccaccagctctagatcatattcaacttccccacccagctatggatctggatcacggtgagagggagagtgagaataaagaagagggtgggagagcagagcctttccctgtggagtgcgctgccatggagagacgaccgtcgtcgatgttgccgatgtgcctcccgtgatagccctcgcctccgagcgaccgaatacgccggcagggaggtcatggctgacggatccggcgggcatgaccttcccaccggcggatctggccccgcggtagcaacatggaggtaaggcgatgcgattgggtgcgagaagaggcatcggcggtgctgtgactgtgaggagaatagggggcagcggcgcgaggagagtaggtgacgcgccggagtggggtaggagggaagaagaaaatgaaggagcaaagtctttccccatggagctcgctgctatggagaaaggaccaccatcgacactaccgatgagcctcttatactagaccagcccacgccttcgggtggctagatccgccggcggggaggtcgtggatgccggatccggtggccacggcctcccctacaccggaaccggccccgcggtggcgagagggaggtgcgagagagtatgcggcggcgtggcgtaagggggtgaggagggcgtgaggaggaggaggcagcggcgtcggtgttggctagggaggagcgaatggtggcggctagggtttcggaggaggggttggtagggataaaagtttttgctaaatagcccattagtttccatgtttccgagcgcagtcctattttccaaattttctcttctttgtattgaatattcaatattttggaggtcttaaatgcaataattttaaacaaaaaaacttttgattagcatctatcacgaaatatcaccaaacgcgagggcttttctgcaaatttttcaaagacgacgcggaggcacgagggctcgcgaaattccaccgttttcccgcgcgcgctgacgtgtcgcgacgcggcagcgtccacgccagcgcaaaacgctgagggaagagcagatcggggctggtttggtttgaagactttagattaaggtttgacttttctcacatatttatgtaatatgtaatatatatgttttctgattgattttatattaagattaagacttacataaatttatctgtgctagcttattcaaattattttaataagacaaataaccgaatgttaaataaaaatcaacatcatcatatatttataaaagggagcactatttttttttgtgttgttgacttgcacaattttatccatggttaggttaggttgcaccattggagcgacgaggactgcataaagatcctagcccaatgcaagaaagcggttccgctccaagaagagagagggaaagtgataatcatcgacatagtagtcggttctgattcagggccaatgctggaatcccaactccttatggatgtggccgtgatgttggtgaccaaaagccgacagcgggacgagaatgattggcgagatctcttcatgaaagtaggcttcagggactacaagattgtgaagaaattgggacctcggtgtgtcattgaggtctatccgtagaagtggcccttggatacatatatgatatatatgcgtctgtggtttcccttctttgttcatggtgtgatcaaagcgatgaataaacaaatttggtccttcattattttctgtgatgaagtttcatgtaagatctgaaatagcgagatgagatgtgtcaagcttggcgtcctagatctgtaaaactttcttttggagatcagatcaatggaaataggtgtatcagtttcaaaaaatggaaataggtggtgtatcatggaacaagtttaaaaaaataaaacatttcgtcataggttaatatcaatttcccctaggcgttcatatatttcacactagtgaaaagtttccaaaatattttcctcatacacaaaagtgtgaactatgcgagcttggggtagaatatatatacacaaaaagaacgattctgaaatgcgtcagtattactctacgcatttagtgactacccctcgctatcaccaaaagtcagagggctgtcataaacaattttggtgacagcataccatcacaaaatactgtcacccatgattttacaaaagtggactttgaacaatgatttttttttattttttttttaaataagacatgtcaaagtaaagtacagttaatgttcgtttctcaactaactccaataaaattgcgtgaagtttttttaagtgtctacggtacacccctaattgcaacacaattagcacaaagtcaataacagaataaacagacatatgcatacccactatacatgcaattatgtgtacttctaggattgacggataccagctcaagtctaaagatttgaggtccggtgggttgggcgaaaaggacactgtcaaatctatgattttaagatttaaacgctaacagattggatacacaaccaaaatagctatctggctacatagtaccttccatcaattattgcatttcaacatgatgcatccatatccatacttgaatagtttgcaatcacttgttccgatcctttaataggtggactttgaaacaggtaaatattcaatggatccaatggttgatagattgttactattattagtcgtccctctttttcaaactgcaattgcctagtgagtttttaaatccatgtatagaactagtcaaaggaaaggcatgccttccaaataataaagggagaataggagctgattttcttaggattactcccttggtcctaaaatataggatttcagagtactatttctcacatctaaacatctcttatttaattttcactcaatattacccaaccatcctcctactccccacatacccacatcatagtcttttccctgtgaacttaatctctaaaaaattcctaggatcacttcatattttgtatggagggagtacgtggccctatttagttcgggaaaagaaaatttttttgttgtcacattaaatgtttgaccggatgtcggaagggcttttcggacacgaatgaaaaaactaatttcataacttacatggaaaccgcgagacgaatcttttgagcctaattaatctgtcattagcatatgtttgttactgtagcacttatggataatcatggactaattagactcaaaagattcgtttcgtgattcccccctaactgtgcaattagtttttttatttatctatatttaatgcttcatacatgtgtccaaagatttgatgtgatgtttttgggaaaaatatcaggggaacaaaacggagaaggaactaggagcatatgtcaaatcctactaacataggagtactacaatagcagaggtaccatgcataaaagcaccgtcactactacgtaacttattttcccgggcgggcatatctatttttccgtgcggtcatttggcccgcctgcacaccgctgtctgtgaaaatcattattttcgcgtgcgggcatactataccacccgcacggaataaaaaaaccaaaaggaaaaaagaaaaagaaaaatcgccgcccgcccgcctgccggcaagcgaaccagccgccgcccctcaccgccgcgggggacggccgccgccgccggatctgggcgggggacggccgccgctgctggatccgagcgcgtgggggccggttgccgttggccatcgccgccgcgcccgctcgctgccgccgcctcgccacgcccgcctggtcgtcgcctcgcgaaagtaggaagaggagagccctccctcctcgtcattgtcgtcgtcctcgagcggggaagcccttcaaataatttgtcgggtaataaatgatttgaaatgagaaaaattgtcaagaacaaagttgtaaaacgcatcaagatctacaactttttttgttttggtcattttttctatatgactttgtctcgacagtttgaatttgaatttcaaattatgacaacttcaaacaacattttcaaatactaaatgatttcagctgaaaaagtcatcaataacaaagttgtataactcattaagatctataacttttattttggtcatttcttcatccgataaagtgatttataagattgttcacaaaatatacatatctcttatattgttttataaactataagagagatatgtaaattttgtacaaatgttaccatcacttcgtcggatgaagaaatgaccaaaatagaagttatagatcttcatgagttatacaactttgttattgatgactttttcagctgaaatcatttagtatttgaaaatgttttttaaagttttgaaattcaaatttttaattgataaaataaagtcacaaaaaaatggccaaaataatagcagtaagaacataataacatgataaagcatgattttagaaacatttaggaaaaagaataatccaatttggagttcatatgagtgagatacactagttttaaatttttcaaatttatttttgcatacggctccttaagactcccgtatggaaaaatcgatttttccatacgggcgcttaagtgagccgcatgcaacctcttaagaggcttgtatgggaaaatcgattttttcatacaggcgtattaagcagccgtctgcgaaaatgccgctcgatttttgcatacgccactagttatggtccgtttgcaaaaatgaagaggtcttgtacagaaaaatcacttttgtagtagtgattgattttgtctaaatcttatagacccttgtccagcactgcccgcactcgtgtggggagaccatacaacctgatgaatccctcagcgtttttgcctggttatatatctttccattctcgaacgaggaaatgtcctccccgtacaggatgtaggggctcttccgggatgcaatgtttactgaacccttgtacaacttgagggtaaccgaaccagttgttgtctcggtaaccttctccatgaaggcatccatggattgctggagcgggtcgaaccagcggccaacataaaccaacttggtgtacttgagggcaagaatgtctttccactgcatgatctccctatcaagggtcagggactcgagctcacgaacggcagctgccattatggtgtcaccgggggtcttgtagacaccgtgcgatttcatgccaacaagacggttttccaccatatcaatgcgtccgatcccatgctgtaggaaatgtcctccccgtacaggctgtaggggctcttccgggatgcaattttagtgaacccttgtacaacttgagggtatccgaaccagttgttgtctcggtaaccttctccatgaaggcatccatggattgctggagtgggtcgaaccagcggccaacataaaccaacttggcgtattttgagggcaagaatgtctttccactgcatgatctccctatcaagggtcagggactcgagctcacgaatggcagctgccattatggtgtcaccaagggtctcatagacactgtgcgatttcatgccaacaagacggttttccaccatatcgatgcgtccaatcccatgcttcccaccaattttgttgagctacacaagaaggaatgctgctgagatatttcttccatttatggagactggaaccccagcaacaataccaatttccacatatcgatctgcatgcacaaagtgcaaaacaaaaaactaatttattacgtcatcacatccaaatgttatattactctatctaaacgtcgtgggagcggtgaaaaattagcttgccacgtcatcgattttttcagaaaacatcctgtgcttctgtttaattgtgcaggggtttcagctactgtgatccgttcgatcttggctaggagcaaatccatccatccacgttcctcagcgtgccatttctttgggctggtcgttcgtttggcccagcccaactgtgccggctcttccatagccctcggatcagtggaaggacgaacgaacggccttgatctctccagtggtgaagcgccaccaaaaccctagtgcgccgtcgatctcgccgctctcgcggccctttctctccccgccagctcatgcctcgcctccgtgcgccgcgctcctcgccctcgctctcgctcgtgcagtgacatgtcacgcgccgccgccttcacctcctccaacggtccattgacgatgaagacggaaagagagagggcgagagctagaggggatggggagaggaaggcacgcagcgagttcccctccttccttcgtagcaattggtgcttccaccagcaagctttctataacgtggagtgtcgccgaccacggccgcagcctccttcctctggattggactccactgggaactcctccgacatatcaagtgtgcctgtccaccttctacctctgaggcaaagattggatcaagcaagctgggttgggcttcctgtttccacggtgctaaatcctcatttcttctccattctctacactcacatcgtttcctgttttttttacagatctgactcagcaccttgatctgctcaacaaccggagcccccacctccttatacatcccaaaggtgatccttcgatcgatccatgatagacaatcttggttgatttctgtgtgttctcttatgtcctgttcatgcctcatacaattgacagttttttaacttgccacagatggatatgcatcttctgtattcagttaggataaggcttccaaggtctgcataaagcaaccgtgagactcacatgctacaaaattttggtattttcttcattcttccaaaatccttggttgattgctgttgggaccgacctaatctcatgatagttatgttaactattatagttccttaggtgccagcaaataactaacctggccaagtaaaagaccataagaatgattgctgcatgaattaccacttgctgtataactgtattactgctctttatctgtgtgtgtgtcagtgtttttgctgcccatagtttgttctctaaatgtgtgttgtgcactgtaaattgtctacagaacaaagagtggatgatgcattgtatggtgatagaaagaaggatgtgacacatatttaagcctaaaaacaattcaatttagaaaggagctatggtggatgctttgcttctcccgcagcatctttctatttcatttttcataaattgtattttgaggcaccattcttgctctaattattgggtggtaaatggtcgtcgctttcctatttcaggtttcacatgatgtttatgactgaaagtaatgcagtatcaggcatgcaaaaatagaagtttagttgatctactggtgcttcatctgcaaacaccatggatcagttcatgacagcatgaccataaggttgggagggacaagaacaaggtgtccattaaagttatggagataatgctgttcaggtaatgttaattgctaacatggacatcataaataatttattttgttcctgttttcatcatgctgccatttacgcagtgttgagttttaatggtggcatgcacattagaattttcttactgatgctgtgatcaggtaggttggataaaagttctgctttgcttctagctatgtccgctagcatattcactgttgcaaaataaacgtaatggagccagttttcaggttacaacttccaatctacataatttaatattaagtgttttataacatttgctctattttctacattatcaacaagaaccagaatgagaagactttaccaagctagaaataatttcaaacttgcagttgcaggctatggctcaaagtcccgcatattcatctttaagatgttaatttggaagtttcctccacagcgaatttttattcttgaatagctttttccatgaatcaataacgctatactagacatgtaggatgaacagccaaatttgggcattttcttcctaaatttttttttctaacatgacaaagggattcggaattgtcgttttcttctgcctgtatttgttaatgtacccttagcataaggatgtattagtgcatgtcatcggtctatattaatttggctctgacatctaatggttgtgtatggattgtgtatatcattttttttccacagcaacatgtacacacaataaaatcaattacttacatatcctgtataagcacactcatttcagtgcagttaaccgcatgaaatattttcacatttaaaggcctcccacatcttccatggttatccgtgttcgtacgtttgaagccaatatattgccatgcttttttttctttttctgctactagtatcatatttatgtgtaatatagttaacaaaatgttaaccttatgtgtaatatagttaactacagaaaaataatatatggtgtggattaattgttatttttgtgtttgcaggccggtccagtgaaaagagattaaagaggattaaattgtttgcaggtcaacgttttattagttcagtgcaatcattccctgattgtcatatttagtcataaattgattgtacatttgtacaaatcgttgaagtagttctatttagatttataggttgcattactatttgaaaatgtgtggcactttatctaagggcctgttcagattgatgtcattttcaaccataccatttttgggcatagttgccaaaaatgtggctatgtttagtttgttgccaaattttagtaaatacataagaaatcctgtcaaaattttggcaatattgccaacttaccaaaattttggtattgcttaccaaaatttgcaaggtttattttggctacaatctgaacaggtcctaaaagttgatatattcagtactaagtttactattatgttgtttttttgttaggactacaagagaatacatttgtgtatttgacgaaaacccgagttttgtggtccatcaagatctcactattttctttccgaattgtcaatgcatgtgtcactgcaagctgtttggtcgtctatatatgatcaaaagatttatgttgtgtttaatattggattgtaagattttcttatgccatgtatatgtacactttacaactataaatgccttcaacatgcatctcagctcatttggattatactatgcatgtccacacgcagcggagcgcgtgtctcttgctagtatagtatgaagacagactgaggacaacacagccatttgtcatgtatttgtaataaaacaaaaaaaagttctaaatataattgaatctgtgatactttttaaagttaaaattaaggcctaaaagagctttcaagtagagttaaaacatgtggtgtccatcctatgatgtgtgaaacagctattatattagttgcatagttaacacagttatagtaagttgttcaaacacatctcctttttgtcttgacatggtgtgataatatgagtacttaattaaagtaactatagagtcctgtgatggaacttcaatggaaatccctcaagaagacttagtttagatgaccttttttcactagtacagaactccttaactctaacggcttttgccgtgtcgggatcttgcgtgccgtcacagcatcgtcatctcaaacgggccaaaataaacaccgtcaaagatatagtcgtacagacgtaatacatacgcatgcatctaaagcccgtcaccgatgattcctatcggtgacgggcttatgtttaggcccgattgagattatctttgtaatctttgtcagcccctaaacgtatgcctgtcaccaataaatctcaccagtgacgggcactaaactaggcctgattgagataaaattaaggtatcgatgacgggcttagtataaatctcactgatgtttgtcatcggtgacgggctcagtattacacccgattgagataaatgagtgctcgtcatcaatgtccgttcagtgaccgttactaatatttattgcacactataaatacttcacccctcctccccaagggaatggttattccactgttcactattttggtgggagattgagggggcgatttttgtctcttttttccaagaaaaaagaaaattcataaaagtaagtgaaaaatactaatcaattccaattaatttagtaatacttatcttacaaaatgtttatctaatattttgttcacttttgcagcgatggatcgaagttggatgtatagaagaactgtgcgacgtcatagcaaatagtatagaaattgagtattaaattttataaacaccgcggaggaggataggaaaagaagaaacaagattacatatgttgtcaatgtgcatattgcaaaaatgagatatgtttgatagcagagtggacgtacatgctcatctgatacaacgaggattcatggagggctacacatgttgggtgaagcatggagagcaagaatcacttgacgatgttgcagctgcagacagaagtggagcacaaaattaggaaaatgaagatgagcataatatgtttgtaccttctccattaggcggtgaaatggttgatgtggatcacgatctgatgcaagacatattacatgacgttgaggacacagcttacaacgagagagattccataaaattcagcaggttggtcggtgactcggagacgcctctatacgccggatgcaaggcaaaacacaccaaattgtcagataccttgaacctaacgaagctgaaggcaagtagtggatggacataaaagagtttcatagatctttggggaatactgaaagcaatgctatttgatatattgtttacatatcttgctagttacatgatcaaactgattggcacacatgcatctcatcaatttttggacctgcactggagctaagcagatctcctaggtcattgctgttgtcgacttagttcgcaccaacaaagttctggcaccataggccaagcgcatatttttcatcaacaccgtgcacttgcggacttatttgtagccatcacaaataacaacagggagagggggcggtgatgataagttacccgagggtgacccggcagggccctggggtgtgagttgtctttctaaaataagagtgtctaattctatatatatctatatatcctatcaatagcattggatcctctcatgctcaataaattcatgtcttatgtacaattgcaattccaaatcaaatactatgaagcttaaaatgttgttttttaagtcatttctatatcctatatagttggagcaatgcttattatttgatcaccatgtcacatgcaattgagattatccattgatacttgaaatttattccaaaatttggttagtcatgcttcatttgatacttaaaattgaatcaattggcatagaaaatttcatttgatactttttgaatcggtgccaagaatttgagttgtctgttgttttacttttggtatctcttatcacacacaatacaccccatggatacaaagagttaggggggctctcacattctcaaaaatatgtgcatataagttcacttcatatatttatatgcacagatttagggggagatcaaattaacatttggattcaaaatcatttattatcaatcttttgtaagttttaattgtgttgtcatcaatcaacaaaaagtagaaattgaaaaggcatctatgcccctagtgggttttggttaattgatgacaaacaattaagagactaatgtgcttattgagtgtacaaccaagggattagtccgatgaagagacgatgaagatcgggatggagaagatgtaatagcttgtggtttcatggaaggttttttctgtgggtgctaatggttcttcccctaagtaagttaatgcagaggttgcggacatgaagctagcaccgatagtgggattataaagatcatgcaccatgacctctctcataagacattgaataattaaggatgggaagctaatctgaattacttcaaaagaaagctcgacctcccttaagcactcatcgctcatgatggtagtcaatcctctcaccgtctttttgagaaaatgttattcgagcggcgcagagggactacacgggacaggtggtctcttctgatgggaataggtcgaggtacttccataatcttaaaaaagatcatcctcgaactagaaaaggatttccagaggcagaatttcttctttcttcggtacccgaggctcgagtgagggcttaacagttgaattttgggatgtggaagtataggcttggattcaacgggtatactcgacttcctagcgggtttcacatcggacgatgggaggtgttctctacgatacaatccctaccttctgcagtgcgactagcctccggtgaaaaaatcaacatacgaggcagacttcttctcactctgctaaaagccgagaatttccatccataggaagacatcacgggttaacaggaagaaagcaagacaaaacatgcttttgagttctccccattcaccatgtgtcttcctaactgtgcgagaaggagtgctcccgaaccatggctacaaagctaggacggagttcaaagccagatgggttttgaaaggtagtggcttagagaactcgccttttgaagcggaaaggttttgaatagataggctgctccgtggtagaagagaagagaaaggaggaaagaaagaaaaagaaatatagaggatgaaccaagttcgtagatgatacagcaaccgttccccggcaacggcgccagaagatgatttgtgcgccctccattccgtgtactcacgtctgattggcaatatgtgtattttgtcgtatggcgggtgtgttttctccataattcacctgcatacaaatattcacccagacttgtagaaatggttagtaataaccactacctctaagtttggtattttattttatattctttcatttgcgtttatataggatttgacggttggatttggtacttaaggaccgtcaataggcagcttgacagcggccagtcccctttgaggccaatggggaacaagctgtggccgacggctagctcagcggcttggccattggcttgtagactgggctagtctagcaaaatgggacatgttggtaggctggactagtgtttggtggtttgtgggctgatctgtttggctaggccagcataggagaagaaaataaaggaaaaagttcacttgaggtcccttaatttgttgtagagtttaaaattcatccacgagctataatattaggtatatatagcccgtccccaaacttataaaaacgggttatattagctcccaaggcagtattgctccggttttggctgacatgacgacagagtcagcatgggactcactttttaggacatttcattctaaaaaaaaattggtggaccccacatgtcatcaacaccacacacacaaacagtcctcctccctctatttctctccatcctctctctgcaacgggaacgctagctcgcgtcattcaggggaagtttctcctcctcctcttcctcctcccgtgggttcgtgtagcacccggtccaaatcggcagccagcaaaggtgcccgcgactcgagttatggtgacgtgaccgcaacgtcatggatgacgtgtacatccccttcattcttgaggaggcggcgacatcgtgggccaagatgtgggagagtaagctccacaccaacagttccagtttctacgaaagcggcggtggcatggacaatcactaaatactcgccatcgatccgacactgcgcgacaccatttgagcggacctgcaccagttcgtgagcaatcacgagcactacgcatgagtcggatgcgtgtggacacggggctacctgctccatgacctgcccagcaccggctagggtttgaaatttcgaaagtaggatttctgccgcaggtgggcgatagaaccaaaatttcagatttttttcgtacgaatttttttaaaattttgactgattttgaatggatttgaataaaatttgaccaaattcacaaaaatttgcaaaaaaaccaaaagtttcgggcgagatatgagcatttcggtgggggacaaatttcgaaccaaaatttcaaaccttggcaccggcaagaccagcctcgtggtggccatccaacctcctcgagttgaacatatacgacctggtgctaactcaccacagtgatgtccaactttgatctccgaaggctgctggcctcgacgcggtccaagtcggtcatggtcatcgaggacgtcgacttctccctcagattgttagaccggacgcgcgcgccggcatcctaggacgacgacgactagggccatgggatactgcgacactcgctcaattttatgccaccagtgcgtttcgtggaggctactgtggacgtgccgctcgccgtggtggtgccattcagaccatccccggaggtgaagcggctatacccgagcatcgacggcgcccctgtgaaggaggagctgcaggtgcaggtgtatggtgcttggcttcgtgtctcaccatcacatcgccaacgagcagggccactgcgagcttcctggtggcatgggggctcaccacatggcagctgcccgtgggtgtggtagcgctgcccccatccgcgaccatgccgcatctcaagtcccggaccttgtcggggctcccgccgtcgcagcactggcggggatacaccaccttccagggtttgcaatttcgaaatcatgttttttgctgcaggggagcgatagaaccgaaatttccgaaaattatttcgtacgaaattttttgaattcaaatttgaaaatttcacccgaaatttatgggaaaaaaatttgggatgcactgagaacaattttgcagtcatacaattcatgatttcaaaagaaataaatcatcttggaagcaattagtctattatagttgcatacaccaataaatccatcgcaagttcatcacatagctttaacagtccattacataagttttaacagatggtaacatagctttagcagtccattacataagttttaacaattcatcacataacagtccattacatagggttaacagtccatatgacaaatagtccataacatagatttcaaacattccaaataggcttaataatacatcacaagcataaattgtctcaacgtagcaaaatagcataatccaacagagtttcaacatcttccaaaagtagtcattcatggacatccatgtcctcattctcagtgaattcttgttggagttactttttctttgtctgatctgaaaaaagtaaagtatatatgtactagtcagtgcacattccatatgatatattacaggcttcactagcagctccttttatatatatattttttcagcataatagctcacatggagttttatggagtaatggcaaatatatgcagctatactttttttttttttgcggggaatatgcagctatactttaaacagatgataatcataggctgagcatgaatatgagacagtgcagcaattcagtttaacatgtatacaggattacaaggcagcaagcatcaattttaacatgtacacatccaattgttcacttcctagttcctacaagtagcgagcagcccagcatcataaattcagcagcaagcagcaaaattcacagcaagcagcaagcagcaagcatgctttagaaattcagagtgggcattcacaaaattcacaagtgatctgaatacttactgttataaaccaatgcattgacattcttcagcctccttgttgtacgccgagcatgctgcatctcaacacctacaaatagagaaatacattagtcaaatagagaaatacacacacctttcagccaatatgacaaacatcaaatatttaaaatgcacctgtagatttcattgcttgtaaatctctttggtcaggattcacatctccatcatggtcatggtcattatcactagaactactgtcccctgactctgcatatacagggctaccatcaatttcgctgtccgtgtcatcaccacttgcaaactcgtcctcttccacagccattgctttccccttcctcttcctgctgttaggcccatctccaggattctttctctttgttgcccatgtattaatgggctcatcaagtaacctctcgccagacatgtcgatgcggacagcgtctgttgggatacgcgtaggctacgatagcataaatcaaaaatttctatcgcgtaaaccaagaaccatgcaagtattagatcatagatcgttaccgctcgacgcgctgcgcagcggaagaagacgctgagaagtcgaaagaactctcgcgaagtagcgcgcgtcgatgtagaggaagtagtcgatcgcaccggctcgaccttctcctcctcctgcgttctcctcgccgtactcctacgacgatcagcaccgcaaaccagtggcgcctctaccggtatccacacgtacagggacggaacgccacgcacagatgtgctagcacccgcgcgcggctagggttttgctcggggagggaagtgacggctagggtttctcacgtgatgcaatacctccgccggtcacacccctcacgaatatataggatccatcactcgggcctccaaagcccgtaggactcctattcggatccttatctgcattaagctcatattggatctctatccaatccccttattccagcccattaagcgtgcgaccctgtaggttcatatatactcggctgtaacccgaaaactcattttcggtccacgcgtcaacagcggcccctagcagaacgtattgacccaccaggcatatataaagatcatatcggctgaacctctagtgtatacttgtataaacccctttgcctcacgatatcgattaagctcaaggctagatatgtgccatcctctaatagctcaatcattcactcgaacctgttgatagattatataacttgtgattgactcctcaatcacctttggcatggccatgcacttccataatctacaacatcgaggggcccagagatatctctccataggaggggcaaatcccatcttgattattcatatcccactacatgtttcatagcatacccgaaaactacttttataactatccaattacggagtagcgtttagcagtccctaagtaagctactacgcatgttgggaaccatgataatctcaggtctaaggattcaacaccaacactaaatgagatcactgatgacacaacacatatggctcttgcattgtctcatgttgggtctatccaacaacatgttcaccaacatgtgtccacattattaatttggtatctctataccatgatccatgagacatgatcatcaattaatacatgtgctgatcatataaacatatttgttccacatatgatatttgatcagggatcctttagaaatagtaacaaacaacataaagagtctcatgaaagaatcacatattcattaaccaataaggagttatctatttcaaggaacaatgtcggataaatatgtaaacatagtatgtgatacaatcatctctatgattgcctctagggcatatcactaacagcgtcaatttcggaaatttcgaaccgaaatttcaaaccctgccaccttctcttttcttgttctcttttgttcttttctcgtcctccaagcttgcgcaccatagctaggttgggaggcagtggatggcgcggaatctcgggcggtgtccgaaaggcgctcattcggcggtggagtggccaagcgtagcgaccgccttgacagtatggggaggcggtagagctgcggtggcatcataaagttggcaaaggcgttgggtcttgggaaggtagaggcgatggggtgctcggaggatgatgcacgtgtcaaggacagccggcggagggtggccatggtggcggagtacgtgtggaggccgttctggccgagcgcaacggcgccactagagagaagggagagggcggaggcaaatggagcggctctagtgctattggtgagctcaagaaaggtagaaatggagaggattgtgtggaggatggccaaaggcatgaaatcgaggccgtaggccacggcggttcgatttgggcgtccctctagccacgggaggggaagagagggaaggggaaagagatggctactgacatatggggcccacgtgggttccacactgactcagcatagctgagcatagtcaaagcgtcacatcaaacaaaacagggagccatcctgtcttagggtgaaagttggtgtggttttaaaagttcgagaacggattatacctagtattacggttcagggacagattttgaactcgacgacacccaaagtgatccaaaaaaaaaagaggggttgcgcttaggctttagtataggtaaggtgggctaggcccaccagaaaattagagttcggaaagaatatttcctcaaaagagtattttgtttcatattcgaatttagttgacactgtcataaaaaaataaaattcgagaagacccagcatgatgcaaacttttgaaaaaaaaaataagattgagatttttagtcgttgaatttaatttccaaaatttaggatccccattaaagtggataaaattaatgagtgcctcacacataatttacaatgtataataactctatactgttccttttttcaatcaatcttgagcatatatctcattcttgtgaaacatatatttttttattgtttgttttgaattattaaatattaccgtagcggtagcacgtgcatttagtataatgtgtcaattaatttctaactgtacaaagtttgttagaattattcacatgttctaaggagattcttgaaaggtctccaattagtataataaaagaatgtcatatatatatatatatatactcttaaataaatatattcctagataattgtcaatatgtaatgtattaatttactgccgatataacgcggagacgttaggaattttttttatttatacatttttttataaaaatatttacaaaaataattttttgtttcgaaaatttacaaatctaattgcctgccgccctctagaagggcgatttttaaaaatcgccctctccaagggcggcaagggacctaaatacaaaatttttatttgtgttcaaacccttcccaccggttttaattgcttaaaaactaataatgcttattcgatactccaaatgattttaaatggaaaagtgatatcatcaagatctacaacttttatataaagtttatctccatccaatgtcgtttgaaatgtagatctgagattttttaaaatgtgttttatattttataacgaatatttggacatcttaaatgaaaaagttattaactacaaaattgtagatctccttgagctctacacttttgatataaagttttatttcatctgactttatataatataattttaaattgtaaaatcatagagctaacaagttatgctggaaaatttacatttaggtcccttgccgccctgtggaagggcgatttttaaaaatcgccctcccaaagagcggcaggcgattagatttgtaaattttcaaaacaacaaattatttttgtaaatattttaataaaaaaaagtataaataaaaaaaattcgttagagaacgaccaaataccggaagcattagcccaccatcacatctagcaaccattttcctttttttggtgcagatagagatagtagattatcattaacatggtaattagaatgtaaatgagctatgcttaattacgtctagtgttagtaacaagcagaaatatttaccaataacttgtaatgtatatagtcttttttttatttttcccttgatcgtggacaggtagtcaaaactcagcagacaacagatacgcaataccattatctaaaaaaacagatacgcaatagcttgaagaaagatctgaaatatcgggcaatcttgtatctacagtttgagtcctgtagtattgggaatggaggttaaactctccatcttgtttgcatatcataaaaaagtttaagaaatgagaagatactatgtgatatatcactccataaacatacaaattaaaattcaatttctgcaagttagaaaaaacaaattaaactatagctaattatcgtatatgcagtcatattttttgttacacatgtagaagttaacttatgcaagaaccttgcatgtttgtggagtgaagtattacatattaatctatcttgttgatttttttcaatattttttataatcgtttaaatgacatgcaaacaacgagaggagatgtcccctcgagagtttgatgacatgagtaacaaccgaatatagtttccctgtagtattagaaaacaaaaactggaaggtgaatatgacatgaataaagacatgagtaacaacagaatatagtttccctgtagtattagaaaacaaaaactggaaggtgaatatgacatgaataaaaacagaaagtgtgtgttgtgagtagtgacacagcctgactgacaggtaatatgaaccggtgtgtcatggagttgtgaacagctcatttgatttggcatctgctgatggttgaagggccatgacgatgatatcttctttcaacatagaaatcaggggcaaatatttttgtttagatggctaaacctaaaagaaaagaaaggaggacaagaactgaatgacagggcagatggcttgcatgggtacacaagcccagctgccaccctgcccattctatggtgtaagctgaagctgaacagagtgccaaacacaacaaaaacacaaatttcatctgggcattctatatgtacatcagtagtcattgtatataagcaaaagatgtcttgcataaagggcaacaacgacccattacatacgttgggtgctctcctcataccaaaagaaaccatcacacaaactaaagagattcagcagcactagcattagtaactcacaacatctagcaatattcacataccatcagtaactaaataatacgcaagcataccaattagtttgcacaaaccttaccatggcgcagcgacgacactactgaagcgctgctcggtagacatagatgattgcttaagttggcttgcttctactttgagtcttgaattctccatggcatggctcatctgctgtgaaatagcacggttctttatgcaacggaagagatgggcgtgttgttcaagctggcggacaaccatacttagcacactaatttctgcacagcgttgttgatcatcgatttcttcttgagcaatcttcttctccgaacgtttcatcatatcctgtattttggaccagctgttttttaaactgagcagagtttccaaacgagatcgtaggtgcctgacatcgaagccgtctgcttccaacacagaaatgcacctcatcttatgttcaaatactgcattatcgtcatggacattcagcatgtttatgctttctgctaaattggtgaaagagtacatcaaacccaatgctatcccttcacgaaactccggaggatgctgctgtaactgatgaaaatttggtcgttgtggcactttactaaatacttccattgcctcaatttgtgcccacatcggggaggtcttcacaaacggaagttcaataatagccaaggattctgatggctgatcaaccataatattctcatgcacatgaagaaatttctgcatcaaggggcaggaagagttatgtgttcttgctacatacttggatattggtgtatcctgagtgttgtttgaaacgatcaagctgttaccaagttcagcatcaatacattggctcatatcaaaagaacataactgagttattgtcgaatcatcgatggactggctactttcagcaacacattctggtgactctaccatggctgagctgtgatactgttgtgaaactccagattgttcattaagtgcagactcccacgttaaactatgtgaaaggactgttttaccctcgagtgcagctaaagatatggttgacagtggaccaccaacactggcatgctgagtttcaggaataatactggctaactccaccacatttgctccatgatccacattgtccatgccatcttgtttgttatcctgacaattctcactgactggtgactggttcggcaccccatcatcaaacatagctggagacaaaaaagacaaattctctgttggagtgttcgtcacacactcaactattgctcccaagttttccttgcaaatgaggtcatcatgcctggtagcttgaccactctttgctgaaggaaattgatccattctagtatcatcaggcataaccaaaatgctccgacaaaattcttcaccagagtcttcatccatacttatttcacacccttcagatttggatattttcttctggttttcagttgaagaaacagaagataacaaattcacatcaccagaattatctaatgttgaagttgcatgcagtacaaggttctcatcttggcgaacatcgtttataccactttggctgattttatcaacaatgctactgtctcgtggacctgaatcagtataaggcatcaaaatataggcattagatgactcgtttttcagtaatgactaatgagcacaagtacctttattgtcttcaagtggagttggctgatttttttctgaaggaattgctggaccagcaataacattggtaggcagttcattatgttcatctctaaaaatcagcttggtctctgcaacattttgttagttagcaacttgctttgagttttctgtatcgtggtttagtataaacttacgttcttcagagattgctgcaatgtcgtgggttccctcaattgtttcgtcaactctgtttttcttcatctgcatttgaagtgtaaaaggtaatcaagaaaaaaagagaattcagtgctcagcagtagaaggtttagaagagttaaacagaacctcctgaatgtgaaaagaactgagagtttcaggattcacccctagttcctcaggtgcttgaaaagaaacacattcttttctttttctggacacatcaattccagcaaatgacacaaagttgaagctatttgcagcacttgaaatcagacaacagccttcatcagttgattgcttttcttgatcagtcgatgcctttgatccttcatttctgctgagatctggatgaggtgattgcattactaaaagtggatcctgtgggataggtcttagtttcccaaacaccccaaacagtgaagcttgcagccctgcagtttgcggcacagagggcatgacatccatctgagaagatggtagttcaataggactacctagaataagtgaagaagtatatttcaaatgaccagatcctgtcattgataactgtaaaggaagttttatctgagatgctaatgccagcactgcattttgttgcttcatagtttctttaggtcgtggtactacatctgcagtctccaacaatttatcagagcttggtttatctctgatttcatcactgtcattacatgatgccaagtcagcaggaattggcttttttcgagaggttaattgagaccctctaatgacaagcttctgaaatggaaaaggtatcacattatatagagatgattttaatccaaaaggagatcaaatatggagaaaaataaacagagcaaataccataaaaactgacagtcttttcttaatatgttatttggtctacaatcttgagttaatattatgtaaaaccattatgtaaatcagagaaagagggtagactaactataattaaagtaaatatacatatttcaaatgcatgtctaggtattttgtgtttcatgtgcatcaatatttgcacaggcatacaaataacaatgcatacagaggataacaggattatactgcaaccagtcctgcaaacagtgcacaaacaactacatcttgatgacataactacctacaattgttatacgatgcacataaaagctagaactttaagcattccatcatcatcgaagtaaaacacacagcagaagtatcttttttttttaaaaaaaaagccagagaatatgtacctttgcctttgtatcctttttctttgtcatgcagcgcatccattttcgaccatcccattcaaactgtggtctcagttttgtattttcaactgtcaacttatccacgccatccacattatccatgcccgttgtgtaactcttcagtttaacaacatacatcttgccaaatacaccacttgaagtctccaaaataattccaggccaccagctaccttcatgaaagacctctacatgagaagatggagaaaatctgtattttgagtccatacgaatgattgagcgtgctggccgaatatattcagtatcaacaatctccgtgaccagctccccatcatctccgacgtgtctatactgtactaagaaatttgtagaaccaatcactttcaaaatagtagctggattccaagactggccaaagctttccgcagatctactcacttcaactaggcttccctctctgaatgctggacctccattgtcctgcacataacaaaagcataggaacataggattaagtattgcagcacactgtaacacaaaaggttacctgacctttttctatgataaaaaagtattttttttgtttgtgataattcaactcattcacacaaccatcaccagagttacattaaaataatgaaaatgaattatccacaggaggcatagacaacctattccgcatattgatggtgccaaagctatgcctttacaatgttgtctgtttacctcaaaaaaaaagcttgtttgtttagaaaggctttatgtaacatgtagatgcgctaaattctgtgaaattatccacaaaagttattttaagatcatggaaaaatggtgctcaaacttatacactgatacatgagcaattgcagatctaaaacatcgttgacttgcatatgaaactctcaatcttatagtcctctccaaacccatctcacttgggtctattgagcctaatggctaacaattgtacccattatgattcaaattcctaataatagctgaattagcaaccattttacaaagcaaccatagcgaccttgttgacattagatgttatgcaagattcctcctatgcttccatgtttgattgtcaagacagactcattgacatgtcaatttggcacacagaaacgcatcgaaatattttattttttttaaaaaaagaaaaacaattataaaatactacaaacaaaagaagacgtacatatttatttattatttttttttaccaagaacaaaaaaattgtttactagaactggtttcttttactatatctcatctgattttatttcctaaattataaaatgttacttgattagttgggtaagctaaccatattgtacaattgtaaaattggaacattgtaagtgcaaaaaatagcgtggtatctccttcttgctcccaagtaccaaccacttctacttgaacagcatgacatgtagattgttaagcttttggcgtaataacacaaaacggacataaacattcaaactcttattaaattctgccaccctatctactatcatcgtaaattttgcaagttaccccgtgaacttcttaacatttaaaaaaatatcaaatccaagataaccacacaaaaattagattaagatgaatattccctacagcaaaaagatggggacacattaatacattttatagatggggacacattaatacattttattttatccgtaacaaagcacgggcatttaggaaaagcgcatggcctctccattttagactaaaaattacactataccaccatcatgttaaaaaaaatgagtactgcccaaatctgtaaaagaaaaaaaaatgactagccctgaaacacaagttcgcacagctcagcttattaccacatcagcggccgggacccagctgccgcggcggaacacgcggtgcggccgcagcgccgcctcctcgaactccatcacctcccgcgacgtcgggaacgccaccgtgtacaccctccggcgtgggtcgacggggagcacgtccagcggcagcggcaggccggtgaccacgcccgaccaccacccctcgttgtggaacgcctccaccatgtcgtgcatcgcgaacccaccggcgcccggcgcgcccggcgcccccgccaccggcggcggctgcgggcgcacgtcgcgggcgcgggcctcctcccgcagcgccgcgccgccctcctccagcgtggtgtaggcgacgacgtatccgtcgccacccgggaggtgggcctcgacggtgccctcgtagaaggagccgacgaagcccgggtcgtcgctgccaacctccacctccgcgccgaccgggaacagcagcgcctcatcctcctcctcctccttcacctccttcccgtcaccctcctcctgatccccacgcgccgcagcccgcggccgctttgccagcttcttcgacgggccgcgccccatggcggggggccgacccaccggcgttcgcgtgcggtgtcctcggcttctccggcgagagaaagagcgagagtgtgtgtgtgaagtggggtggggtggcggaggcaacgatggatgaggggattagcggtgggtggagcggcacgaattccgaggtgggtgggtggatcggacggtggaggatggagagagaggaaacgtggagggacgggatgaggtcgcgggggttgtgggtggaggcgggctcgtggcgcgaggcggcggaggccgcgagggccgtggtcgtggactcgcggtcgtggagtgtgaatgtgtgtgatgggacgtgaggtggcagttggtggtaagagcaagtttaatagtatagctaactactagctccaatttaatctatagtcaatgtaatagctcattatacatactatactattaatatctgaatatccggtttcaactatcatacacacaatgcgtcttagagtctgtgctatagctgactacaaatctgtagcccgttgctcttctctcttcttatttatctctttaaaatatatttgtattgctctgagggtggaggaagcgtccaggcgtgcagctgtaaaaaaatattgatagaacggaggaaccgttcgatatttttctttaacgactcatacaatgtgaagttaatattgatagaatattgatatagtaaaaaaattactataaaattaaaactaatgaagataaaatagccatcaaccacgccccgacaacactaatactagaggatgcccgggagaaggctagcaccggaccagccaccgctagaccagtaaaggaactactgatgaggatgcccgaaacccaaccctaacaaccgacacataactacactctatccacatctttggaattgagggagagagggtgagagagaagaatggaaccactctccccctaggccctccgacgtggccaacttgcgtaaactagggcaccgacacaatagaaccggaatctatagcgagcttgcataagaagattaggaggtttcggtaagggggtttcctggatgacgtctccaaggagagaagcgataaaagcaccgccaccgccgtctgtcgaggtctcaaaggagaaccgagataggttttcacccgacaacccactagaggagatgggacggcatgacaacaccctcaagagggaaagtgacactcgaaaacaccgttgttgcgggccaggtcaagaccgggctaggttttcacccgccacttgcctatgcgcatgtgatgcaccatttctccaccaccatcaaacctccgtcatcacatgggcaccactgaaccaacgcccgctgcccgtccagcctttgcgtgctgtcctgcgggcactcccatcacaccatgctgcccttccctgccagcaactccacctatgcgttgagctggcctcagtaaccatcggtcgtgcaccatgccggccttcgtcgtcagccgcacctttatgctgaccgtcgcccttagcctccttgtcgcgactgccgcttagccatcggcgccggcctcccacaccattggtgctattgcggccgccccccgttcagccgccggcctcccttccgacgtcgttcttcccgcaccacaaccggacagatccattgtgtaggtgccggatccgtggcctccaccatcaccctgccgcctccacgtcctcattgctgtctccactctactgtacccagccgccaccgactcggggtaggagggtggtctcctgcgccgtggaggctagatccggcaccgccgtctcgccgtctctatgtacaagtctctatgtacttgaagaggagagaatattaaagatatgtgcaagtctttgtgtactctagaggctagagttttagaattttctaagcatgttactatattttttctttaggacgaaagatcttattaaaatgactaaaatccattttttctacaatgatttaatttttctattttataatcggtgtgtttgactggtattttttagctatagctgcaactacaataattaagaattgttgcaactaatttttaacccctccgtcccaaaaagagtctaatctatgcagcagccgcatcagctatagcttgtatggctacctaacaaaagccaatattagagaatgggggataatttactactccctctgtcccaaaatataagaacctaagattggatgggacagtccagattcgtagtactagaaaatgtcacattcgatagggctcaaatgtcactgtctcaaattttgtgaggctgatatgtgggcccatataacatttgagagtaacaatttggaagagtggcaaatacttctagattctccctcaatccgacagaccggacccagcggccagccacatcgcataatctcgtcgcgcacacgacacacccccgctgcgcacccacccaaggcgaaatttcgccggcgcgcgggccccacgatcatcggcccaactcaggaagcgcaagaagaagcaaccggagagcctcctccggcggccatggccagggccctcctcctccggcgcggccaccccttcctccgccgcctcctgcggcctcccccgcctcccacctcctctgtactggttcgtcgtctccaaccctctcgagtcgccccctccccctcttccccttcctttttttgcagcccccgatcaaaggcgtcgagccgcggggatagcgctctcacaactgcaggacggacagctgggcgcccccatgtcgggcgtgcatgcgcggccattataggctcgtcgttgggggccatggccgcgtggtccggaagttatctcgcgtgcctcgagccatccgaagccaatcgattccttttctttttctttcttttttttttgttgatttcgttgtatccttcttagattttgtggattttcattgttgctgggttagtgggtttacaaaagggggaaatccctttgagttgaaagctgatgatgcattggtaaatatatgggtataacaagtttctgaacctgatgtgatggatactggtgacgatgagcatgcagtgcccactacttgaggtcttttaaggttttgattgtcgttatcccctagaactgcaagcccttggagttgtgtaccatttaccatgttgattaaggcagcacgattaattacctgtttttttatctgcatggattggctataacagcggacaacttaatctagccctgcttgttttctcctagtagaacggtgaaagaattttttatgactcaacacaaaaatcaacattcaggccataattattgccttctgttttgtttttgaaggaatcctgcaatagaaatgtgtcaccaagagttcagttgtggagattctctgcagaaggtgcgtaaatgcctagttctttcactctaatgcagtgacattgtgctaggttgatgatacctccttgctggaaatttttcctcttgtaatacttatgttttccatggtacttctttcttacgacagatttacttttttgtttctggatttgtcgtatggttatatcctgttaatttcgttggaaaatcttcatgggaatctagctggcatgtgtacagcatgcatgggaaagaaatatttgttttatacttatcagttatcataatggaagtgttatacagttttagctaattatcattataggaaaatatttttccaattcaataagaattcatgtgctaacctttgttttttatgtacaacacgaatcgttgttagtggttcccctattctggaaaattttacatgattgcatcttgagtttgtttccagattccagataacttgaaaattctattccaaaataacaataccgatctcatttgtcaagtttattggtgaatttgttcattgtatatatatccagatttaccactgactctatatatggtttattttttagggaaagaccagacaaattcaagtgaagatggttacagtgaggcaaacattaagaagaaggactttgcgctacaacaagctttggaccaaattaagtctgcatttggtgaggagtcaattatgtggctaaatcactcttacggtcctaaagaagttcctgtcatatctactggatcctttgcattggacatggctttaggaattggtgggctcccgaaggtgagttaagggtattaattcttttgtttaataattgttatattctagtatccaggatcactgatgcatgctctatttaggacgagtaaatgactttctactattgaaagtttaatgaaacttattttctattaaaaagagtaaattgaatcagagctccctgaatttgtagacttgtctcacctagctccctgagctgacttttgttttctaggctctttgaacttaaacccatttgcatcactggtcatctattccccgtttgctaacagaataatccgagcctaacagcaaatggatgcaagtttagggaggctagcaagcaaaataaaactgctaggtcaattaacatttaggaagttccaatgcaatttaatcttttaaacattactgacctgtttatcgccatagccagcatgtcagatagagttgccctttttttttctgatagctctattgctccattataactgcttctgtagggtataggcgaacgtgtgtgtactcagggttttctaccctttctttttcttaatcaatgatacgcagctctcctgcatgtttgagaaataaaactgctgtagggtttgttggtatgatttagtaatttcctggaaatctgaaactcacttatgttaagagatgtttgttaaataatgcataaacagaagattagttaaaagcatatgtacattttggttatatcattctacatcgttggttaactgataaaattctaagtgaatttccatttagcaaattatatgatattattcttcataattatcttctgctatttgttcttttgcacttcattgacttttgcatttatcagtagggaagggttgttgaaatttatggtccagaggcatcaggaaaaaccactttagcacttcatatcatagctgaagcacagaagaatggaggtaaataattgtttggggtatacatctgatctcctctgtgaactagtttccatgactaacaatgcaaaaagtgaattaagatgccaatatagtagttttgagttcttaaagcatgattttgttctttatttagatgaagctagtaaaataagtactttatgccaatgatcaagttttcagtgctaacctctatgcctaacaccatgtacttgaaaactataagcaaaacgatggacagcattaataatctaattttgatgggttcaggttgagctgtgaagggaaaaaaagtctaagactgcattagtaatgcaatatcttaataaattaacttacctgtaaatttgtacagtggctgagaaattctttgatttgatttatctgagtcagtcaaccatttcaagtctgtcctggccagtggccttgacaatgagctgtgaaaagtgaaagaaagtgtggactggctatttcagcatgcaaatataggtactttactttgaacaattaacatacaattggtatttccactttgttgtccacaaataggctttagtttcagaagtaaatggtaagaaagttaggagtacaatctctcgctgctagaacaaaatatcatactactcagtggtgtagaccagttttcccgtgaaagcatgctccttcagatttcaatatctatgcaacctgttagtaaaataaatccttttttaaaaaaattgattttgttgtttcaggatattgtgcttttattgatgccgagcatgccctggatccaacattagcagaatctataggtgttaaggcagaacacctgttattatctcaaccagactgtggtgaacaggcccttggtcttgctgatatcttaatccgaagtggctctattgatgttgtggttgtggacagtgtacgtagaaagttagtaccttatgctatattcacgctttgcttttgcctttctgcctcctggctctgaacttctgaaaagatatcgataatattttatcatatatgtgagaattctattttaaaatgaatgctttatatgaattgctccctgagcctgattttaaagatttagtgctccctttttagcatagtcattgttaatctacactctagaatgtactctttttggtcctgcacactgcataatgtaactaacttacatagcagctactccctccgtttcatattatatgtcgttttgacttttttcctaatcaaacttttttaactttgatcaagtttatagaaaaacatagaagca

SEQ ID NO: 78154 - DNA, 22328 bp, Oryza sativa
  unsure (1)..(22328): unsure at all n locations
ttatgtacatgtatgcttggtgacatttctagtctaatgttgggaatgaaaagattttattctgttctcaaattataatcatgcaatggtttaagttggtcatcacctaaattaaaacggaaattttttgctctcaaaattggagaagttaacctctaactattttgacaagaaattttaagtcctaaaatttcaggtacgttataggcaattacctttgggaaggtaattgagatgcggcatgtggagacataagcgccatattgccatgataatgatgacatgatttgtgaaattaggaaaggaactaaacacttgttttagaccggggcggacggtagatttgggtggtatccgggaaaggctagtatcgtccccggtcaattaaggaccgagccatgaagttaagcatgaaacgaccccgtacaatcacacttctcgaatggggatagacctagcggagtaaatagccgagcggaggcagtatccatgcatagtggtttctcgatgtgtaaggcaggggctctacaatggtgtcgccattgttaggactgccatgtgatgagttgaacataattataacttaatacatgtgtgtgaattttccctccccgggtgcgctagaactcctctcactgctagaaactgtgtacgcctagagcgcatgaggatgaaaagttcatggagcgggtactgccaatgcgaggttatcgaaaagctttgccgtgacgcgtctcatgtgttgagacaaggctcatgtgttgggcagtcgcagagtgtgggtaaagtgtacatccactgcagtgtgagtaaaccaaatctattcgaatagccgtgcttgcggttattgagcatcgggacatgtattacacttggctagactttaaattcttaacttgtgtgggatgggttattgcatgatgaatttttatggtggacgtcctcagaaaaccatgacgactcaatggcgggaagctatccttgggatcacaatggatggtggacagaaccgtcgttgtttaaatacaaacactggtactaaaatttgatcagtcaatgctaggtcttaggcttgtgaaaagaattacaaaatttgctttgcgcaaaagaaccatagccatcctttgaaatacccctatcatatgcattgttgatgtggtggcttgctgagtacggttggtactcacccttgcaaatataaacttaatcagaggcgggacttgaagcttcggaggatccctatgcctattaccaggagggtgatgaagacgatggcgctcagtaggacttagtacggtcgttgcctgtggcattggcgtgccgctgtcttatttccgctgctttatctatttctgcttttgggatgtattccggaccgcccggtccgatgatttaagataatgcctgcgggcttatgttgtaataattcgcactagactctcgtgtatgtgcatttggtatttcagctatgaactcgtgtgtaccagactacttgatccagggaaatggtactgtttacacgattgattcctgttataaaaatgggggtccacatcactggagttggagctgttgcaacgcgggctataggaatgcttcgggatgcatggatgacaattcgctgaggagcaagcttctgattgtggggagttgcgtggactgacgtgctggtagctatgtttctcggttttgggcacttgtcagtgaaatgacacatttcttgacaattgaagcaacagatatctttccggactcagtattttcttttctcattttgattcctctgtcctggcactggagttaggctgaaactgtaatcttggcgaggattggtgttgccttgatgcttctctccattagaacgggcatgttggttggccatcttcttcgtcagcagaaaactgagttgacaatcttttggtacatgatcagttccttcacacaagaaacaagtgatcctgctcatggggcactcgccgggtggatggtcttccttacaatgaaagcaggtagtggcacatgagctggcaacatgaccgatttctccacaatgagagcatgccttatgttccattttattctggttgaacccttggggagacttctcatcttcatcatctgaggagacttgatctgaatcttcactatcagacactctacctccattagctaaaagatgctctgtcaactatggtgcacctcggaaggaatttcttctctgacgttttgtcattcctggtggaggccattctgtactggtaatgatcatcttacggacttcatcttcggttcgcattggtgcttttcttttctgctgaggacagttccttgcatagtgcccttgttcatcacacataaaaccaatgatacttgcttcttttgagtcaacatgtgacatggcatgaggggccttctgggatgttggcggtgcgctgacttgtggtgtgagtgcttggattgcctccaactgcgcctgaggttgcatctgactcgggttcagaattggcatccgatgctgctgtagtatctctataagcaatttgttctggttaatcaagtgttggaccactgccacacaattggtgtctggtgcttcattcactcgggagcttgaggtacccatttcctgacttctgaccttattgcctttctcattatccgccatctgttgcaggttttggagagggagagaggaaaaacaaaggggagagacagatcagaaactaaggataggaccttaacagagctacactttttctgttgtgatgtatgttaggcttattctgcaagttgattacgcaaacaacctagcatggttacatcacaccccactgatgcaaaccacgcgctacacacaagagcaaggaaacacacgactaacgaaaccctagaggtggcttaggttctgcgacgggttctccaagatcttcactcctgcttcacatctggcttcactgcttccctcgcttcgctagcagatccaacagtcttgcggagcttcggcagacaattgacgacatcttcttcttcgcaaagctgaccacctagtactagttgaaattcgaaggaggaagaagggagtaaaccttttgcaaatagcattaggcaaaggagaaaaaaaaggaactttcgcaaatagttttatttataaaatatgtccttaggttttatccacttggcttaacctacagtcaaccaggctctgataccagcttgtcgcgcccggaaaaatacctttttccagaacgctagtgtattaatccccgtcccaggaaaagccggggtacaccacacaaacatgatataaaagacacatctttattatatcgctaatatttacattattacaaaggcacttcaggcctgacaatcaaaaataaatagcagcggactagcgggcctacggctccatcttcacaggcgctcaactgaggtataagctaggactccacaaaagacttctcccaagcttctcttactgaagggggaaagatagagcaagaatgagtacaaccacagtactcagcaagtcacaccggtagatgcatgattaatgcaagagggtacaaggggtaataataatagggttgggtcttgcagtaaagagcgtttaaaagacacttagttgctcaaagctattttgtaaacatgatcctagagctacacaatattattaatcaaggccgtgaaccctcacgaacctgccttaacccaaggcctacgatgattcggaccgaactggcaacccgacctgggtcccagctcgtcccaagccaacccaggccaaccattccatattttagttgttaagcaaattttaagaattaaaccactaacttgggtacattgctaggcttgcccatatccgagggcacggctatgtgaatagattacactctgatcagaggtgcacatctttacccacaagacacgcctttactctgcattccattgcaattggaacccatcataaaaaacgtgacataaccctttacccatcctagccgtgaacaaaagtaccgatccaaccctgcctacggccggtatcccgggacaggcaggccaggattgagcccctagcaataggatctagaccgggtgcgccacacgcataggggtgagaccacccgtgtactagtccagtgccatggcatctcgactagcgggcaccgacccgtgtagccttcatttgcctagacatctcgattaccgagccacagctcgcgtagccttcatttgcctcagagatatccatcgtcgcaacgacttcatccatctctatccgtgtccttttgttcaggactagactgagcaccgagttaagccttacccattagacatacggttagtacggtagtgctttgcaacagaggcccgagcttaatccttatattggccggggtgctacttcccacaactggcatgcacccaaaccccaccggaaaacaggttttaggggttttgaaagaggaagagacgggtatgtccaattccaccataagccaaccatttcatagtatccaagtgatatgagaattcccaaagtctaaagttataaaaccacctaatattgcctaattaatcagcgaagcatctacctaaattcatactagtggaactataaatagagtacccactagttgggttttatttgcctagggtacgcaaggtgataataacaattgcaataataaggctataacaaggattaataggtaatgctaaataaaacagtggtaacacggaaatttgaataaagtagtaatgcaataattcaaatcaaaataattttataaactaggattcaatgtgctcaaggatgatgcgacttgccttgctcagagagaacggccttccgaaccttcggcgacgaccgtgaaccacgcttcgggaacctccggaacgacaggagctacgcgaagcacacaagcagagctaaaccctataaagaagcaataacaatacataaaaagaaagcacagggttctttaggttataacaaacattaggagacttgaacgggtcaattcagagttcgtatgaccaatgtatggtcatccgaagtttaatgctgttatatggagatttgcggattattataattaggttttgcaactacaaaacatgtgtaagcgctagcctagaaaagacaggaaggctgcgccgttgacatgcagactccacatgtcaacctaaaggaccacggtagaccgagtacacagagacggtccacgggtcgacggaagcggaccccgtgtgccaaccgaggcgagtggccgacaagcagactccactagacaccacgcgggctgcacacatggaaacaacgcggctaccgagcggctcactaacacgatcaccacacgcacacacgaacgactacctacaccggtacaagggtaccggggtcgacaaacgcacgacgggtacggggcgacaccgaaaggacgaggacgggagcagcgagaagggggaccttaccaccacgcgacgaggcgtgggaacgacaacgacgaacgagcgcggcggagacggctcggggacgacggaggcaaacggcgagggaatgacttcggcggtgatccttgcacgaaggcgagacgtggccggcgcaacgcttgacgacgcggaggcgaggacgaagacgacgacggggctgcggcacttgacggagcgaggacgacaaacgagaacggcttgacggagggacgaacgccacgacgaccgggaacgacgagaggacgacaacgacgatgaccagggccggcgaggagacggcgatggcagccggcagcagctgcacagatgcgaggacggcgtggaacatgccgctgtgatgatgacgatggtggtggcgcagcgagacgatgtgccgggcgaccgacaggacgtcgacgtcgaggacgaacggtgacgacgacgacggacagcggaggggttcggatggagggaaggcgatgccgaggacgtcgtcgccggctcgccgctgcgatgccggaggagacggcgacgtcggccggcgcacgggaacggtggaaggggttgccgaaagaactccggcgaggcggagggcgagaccggagcgggcgacggcgttccggcgaaaccgagggtaggccggggtggagggcgacgcggcgatgtcgagggaggatggcgacgacgacagtcgctacaccggcgaggcggcacaggcggctggaggcggtggagtggtggcgacaccactggtcgtcgacgaggacgtggctccgataatttccccgcgaaacggaggcgacgccggggaagaggaggcggctacgaggccgctgggggtgacggcacgaccggacggcactccggcgaggagggagaggcggctggaggcgaccggcggcacgggagaaagaggaggacggcggggagaggtggtgaggccacgggatcgaacgcgggagggggctaaaactggagaacggatcgagggggttccattttatagggaaggagagggagctggccaagggagaggcggggaacggtggcgaaattcgtggccggcggccgtggaatgtggccggggttggcgcgggcgttcccgacgattggggtcacgaatcaagggggaaatatgggggaaagacagaggaatcaatagggattaaaaccccctaatcaattttggaaaccctggtttgaatcgcgtggattttggggaggtttggcgctagggtttgcacaggagagagagaggaaggaggccgggcgggaggaggacgacgactcggcgcgtgggacccacgcggtcgcgcgatcagcgcgcgtgagggggggtgggcggcttgggaggctggggcggctgggtggggtggcttgggccgggaggcggcccaggcgggaagggaggaaaagagagctgggccgaggggaaaggggaggcccaagagaaggagggggagaaggagagggagagaaagagagggaggaagagaggactttggccgcgggccgagagagagagagaggaaggactttgggccagacttggcccaaaggaggaaggaggattatttttaggtttttctttttaataaactttgataattgtttttgttgcttaataaatatttcctgtgctctgaaaattcaagtaaaatttgagggctcattttagaccaaggagaatttaacaaaaattctccgggccacattcgaatttttcttatacgtattttagtgtttgccaatttcttttcgaattttaattaattctattatttcttttagaaaatgatttttatttcgagatgaatttatcaggacgtgacaaatccaccccccttacaggaatctcgtccccgagattcgaggaggctagcaagaagataggttgggtggtcttctcttcttgtctgacttcttccgctccgtgttctataataaacttgcctaacaaaacttctccactctagactgcttggctcgatctcctgttccagatggaatcttctcttcacctgacttttccatggttgcacctctagctgacttcgactgggttgtggcacttgaagatgggacttcagttccagaacttctcataattcatatctttggcgtcaacctcatacaagttacccacttcatgttatgcgccgatatcagcttgtcattactaggataccatgcttaccatcgtgagaataccacgcttggcgtttccttccagcttaccaccctatgctttagactatgatatcccgcttactaagaataccatgattgacaacttgccacaaactgtctcatattagctttcctggtctccggtgctagatatttcctctattcaatgcgagggtcgataattttgcctttgaattatgtttcccaagggaaccaacttatcccacttgacatgctttgacgtcttcccaaatgactttactgctgaacttattattgtctgatcgttatcctgccaaatctgaagcttcgttgttggatgtgattttaatctgacctctgtagattttccttgaacatatcacttgtttcataactgggaatggctctcatgaacaagcaactcagattcactttctttacattcggtttactttccagtattctcttcgtgttgtcatcatttagcattcaacgtattcctttacaccttcagccttgatgtgttctttcccgatggatcgattgctaggaaagtgcgttgaacgatactagtgcaggtgcttttattctagcagcatctgatgcagagcccaaggttgaaccgagctttagattccaactgtgcgggttttcttgttgacttcttggtcatgtcacgaaagtttccatccttgtcctcatagaatcacttctacctgtggtcatctcgcttactcgcgaattcatctgctttgatgacagggtggctattgtagggtcaattgctatcgggagtcttcctcgagtgacacaaatcatggttctcgttatcctttatcaatcacctttcgacctacttcttttccctgtaaccaaacatcttttccgatctcttccattaatcacctttcgacctttctcaaccaggtactcttcactccgggtgttgaggatgcttctggggcaatgaggtccttgggcatgctgtctttcagagaaactttgaagtagtttgtcaaaagctagactgacgattgttgcctttgatccgaagaagacacgtctgaaactcttagtccaaacaaatgtctctttggttgatcagttgattttcttttctatctacaactaggttatttgattcataatagagtaggagctcacggaaatgagactctaggtctccttaatcaacaacaaaacgtacacaactcacagcacttgcaatcttaacatggatccttcataaacttgtcaaactcatgttttacctcttgttgaagatcgaaaccgatgcaactcaacccgaaagcgtcgtcaagcgttgcgccggcagcatgtcacgactcaagttctccctgagcatttggttcataatgtgcagccagatcaatcggtgataccccaagttattccttagcatttggtgcgcaacatacagccaaactttcagaattatcaggggggcaatttgaattaccaatatcagccttcgtcgcaacaggttcagtatcagcaaggaggatcagctcagcctcagtttgctcctcagtacaatcaatttgagcctatacctcaacaagcacaaggggtgcctcagcagagaccttgggccgatatgtttgcagatgtgatgagagagcagtttgggcttaagccaaaggatactcgaaacttgtatcggcatccgtaccctgagtggttcgagacggttcaattgcctaaccgatacaaagttccagatttttcaaaattctcaaggcaagacagtgtttcaacctatgaacgtgtcagccgattcttagctcagtgtggtgaggcatcggctgttgacgctttgagggtcaggttgtttcctttgtctttatccggattggcttttactaggttttcttctttgccatacaattcaattaacagttgggccgatttggagaacaatttcatagttacttctgtagtggggttcatgagatgaaattgtccgatctaagagcaattagacaaaggcatgatgaacctgtgcaagattatattcagagaatcagagagatgaggaatatgtgctacagtttgagtctgactgatgcccagttagctgatttggcttttcagggtttgatagctccaatcaaggagaaattctagtctcaggagtttgatagtctatcacatcttgcatagaaggtaaccctacatgaataaaggtttgcagaagccaagaagaacttcaaaaagatcaatcatgtctatccttacatgtatggatccgatgatgatgatgatgattccgaggtagcaacagccgagtgggtcagaagcaagaaggttataccatgccaatgggtaaatagttctggaaaagaggagaggtatgacttttgacatcaccaaggctgataagattttcgatctgttacttcgggagaagcagattcaacttcttgctggtcacacaatcccatcggctgaggaattgggcaagagaaggtattgcaagtggcataactctgggtctcattctactaatgattgcaaaatattcagatagcagattcaggcagctattgagggaggaaaaatcaagtttgatgattccaagaagccgatgaaggtcaatggcaatccttttcctgtcaatatggtacatacagctggccgaacagccgatggaggaaaaactcgaggttttcagatgaattcggctagaattattaataagtatcagaggaagtatgataagcagcaacaggagaggtattatgtaacataccgaaaattaaccgttttctaattgtgcatcatgccgagtcttatatttttaatagcatcctaaacctaggaaaatataattagagggaccttctaaaactaacttgcataaaatccttctctggtattttatttcttttgtatttttcatttaaaaatatatttggttaaattgaggtatttcttgatttggttttaatttaaaaccttctttcgactaaaactcttttattcaaatttagtttgaaaaacccctttctatttttatggattatggtccaagaaaccttcccaattttgccattgaacctaaaccaaagtaattccaattttagtgggattatttgttagcccatcctttgatcttaaacatatcctttgattcttgatccaaattcttccttttgatctagctgctgatctaattcctgtggcttgatttccttctcggcacaagaataatattactacaaacattgtgaataattgttcttgtgctaagataatagattatatccttgtcatccaaatctcctattagcctcaaacaattctttgaaacccatgccatatattttgaggctaaaaatcctatctatcttcctccatttattttctctccctctcatttgagtgcatcaaataaattccgttatattctatctctcaaaatattgcactcaaactagaaaatatctcttttggaaattatatccaaatataatttcctttcaaaattccctattcaaattccttccaaattctaatctcatccaatttctatcatacaaacaacctacaaaatttagaattgatttttaaatttaattgggctaaaatccctttgtctcttccttttggcccatcttcctcttcggcccagcccagccgagccgccccttcctcctcccgtgggcgcttccaggcgccgccatgcgccgctactgccgccgtgcacaactcagctaccgccgctgccatattgccttcgatgccaagcaatcgccgccaacgtcctgccgtcgccgctaaggcatcgccgccgacgtcatctgccacctcacgccgccgacgtcagcctctggagcaaaccgacatctccaaccaatcacaagccacagccggcgccgtcgccttccttctccacgtcgccgccaccaagaccaactctatcttctcctctacaaccgaccttcacaaccgacgtccgacgcctataaatagaaggccagccctccccttttctccacatatgagccgagctcctcgagctctctctctctctcctgttatgtctagccaccaccggccactgtcgatctccctcaccggagtgtttctggccaatcccttgcgccatcaggtttgcctcgacgaggcaaactcattttcctagtttccccttcctttcctcttccgaaaccaaccatcacagccacctcctcttgttgccggagcaagctcttgcctgcgccgttccagcctcctctctcacttcctctgccgactgtcaccctccccgggtgcgcgtcgctcgggaacatgtttttccgccaacgtcgcagcctctcaaccaccggagtatcgatgcccctcctctcccttctctctgtttgttcgtggagaaagagagaagaagcaggaagaaggaagaagaaggaagaagaaagagagaagaaaaagaaaaaggacagctactgacaggtgggcccctacagtactatttcacattttctagatttgattcaaaatccaaactttagaagcccatatctcctaaaccgtagatccgattccagtcaaacttggacctaaattcatctaaattcaaaccctaccttttgataccaaatttgctatttaaatattttatttgaatttccttgatttatttaaatgccatttgcctttcaaatatctcctgttactccaaaatacccgttagccagtaaaaagccgccgattggaactttacgccttctatggagacgttcgtggtctattggccccgacatggaaccattggttgtaaagcccggcataaaccaaacccaaggtcgaagtgctgctcctggcaccccacgccttgatgcatatagcggtcggagcttcactattctatcgacctccacagcacgccacacagttagctctcgggctctgtgtgatcctagccgctccgccgccacccacggttgtcggagtaacacttccgccccactaaattaacctgcacctacctcatatccctctagccgttatactgtccgtcaacaccgactagagaagacaccaaatctagtcgttatactattcaacactagcatcgactagtacacaaccaaaccctagctgacaccttactagttaaatcccagccgtcatccaaattccacacccaccagtatcacctatccaccatactctcagccacctactctccaactacctagaacctatacataaaatatagagcctagccgatatgttgtcctatccccaattggcttaaatataagcgacatttgttgcttgatcccctttctatcttagcctccaaccctttagaacccatacatgaaatattagccaataatccctatatcttacaaaggagatatttataccccaaacccagcctttcttgcccttcatcgctttcttgttattttgtgacttttattgaatttggttctttctcttctttagtagagtctattttggatggcagcctgtgatatttcgaggatcgaataatcaggttgcctatcttggatttatttgcgttggagcaaggcaagttattattcctcccctttgagcataataatcctatattctatatctccagtatcttgtgcattagccttacatgattttgaatgcataacttgaacatatagcaaaccagatatatgctagattttgcttagccatgcctagttagattgcataaaatataataaacttagattggaacaatacggaagaaatggttgatttccgggtggctagtactgttccaaccgacataaaattgccaagtacatgtgaagaacatacgagtacgaccgcaattctcgtatgggcatagacctagctgattaagttatctagcaaaggtggtacctctgtattgtggttcttcttaagtcctcgtgcaggaggcaaacttacgccgagcagggcgattgtaatatttaccgaggcgcaggtaaatatttgagataaattgtgatatcacaaactgtgtgtattgtgaaaaccttgttgagatgacgggggtctctcaactagttctctccaaaaacctcgggaacgccagaactcctttcgctgctgataacgttacgtttagagcgtatgaggactacagttcatggaacaggtaccactaatgttagtaactgaaaagctttgccatgactaagctgatgaatattagcatgtcatggattgcgggtaaagcgtacatttactacagtaaagtataaatgaatctattcgaatagccgtgctcacagatttgagcattgggactcatatggtatttggttagaaacttaattccaaactttattaaatactgttgcatttaaaacattctaggctttcttcctctatattctttgctttctgccagtaaacctagatctactcagatattaccatttcatgcattcattattgaatataatagtttgctgagtacgttgtactcacccttgcttcaacccctttttcagagtccaattgatgttcttaccgaagctgggagttcaatcatataagttagtctcattctaacttagttctcaagtatagattagataaatggtttaagtctataataaaacattagtgtttaaatccttctatagcctctgctggactagttagccacaatcttgtaaattcccctattattttatgtaataacatctcctttgaaaccttgaccaaatgtatgcaatgaagaaccagattgtttaacctgtatcaatttactgatccagggcttgatacagtctaaacatgtcggtttccgaatcattagttttgggacccgacatattatgaagaagatgatagcggttttgaccctcattgggactgagtttttcagattttgctggaatgaagttatgaggctgccatctattgaagattgccctgggtgtagtgatattacagaaagttcaagccgatcttacaattgaagcaatcggctgtggcaaacgcgggttcctattcattaaaggttgggcccagtaaaccaagatcgtgaccaagaggacgatgaggataggaaaactcaatggtatccttctggtatttttacaaaaaatcagaagagaagggttcaaaggttgaggaacatggggcgctttcggaggttgagcaagaaatcaaccatcggctgaagaaagcaaagccgaagcaggagtggcgtgttaagaatcaagctcccacagccgatgaggtgaaaagattggctaaggggaagagtgttgtgactgcatcggttaacatggttttcacgttacctgcggaattcggagctaaacaagccgatgttgatgaagttgaggaagcttcagctaggttggttttgtcaccagagcaaacagtttttgagaagccggaagggacagagaatcggcatcttaagccattgtacattaacggttatgtcaatgggaagccgatgtccaagatgatggttgatggtggggctgctgtgaatttgatgccatatgctacattttggaagctaggcagaaatgctgaagatctcatcaagatgaacatggttctcaaggattttggtagcaatccattagaaataaaaggagttttgaatgtggaactgacagtcagcagcaaaaccgtccctacaacattttttgtcatcgatgggaagggttcctacagcttgctgcttggaagggattggattcatgctaattgttgtattccttcgaccatgcatcaatgcttgattcaatggcaaggcaaaaagattgagattgtgccatccgacaggtcagttaacgttgccagtgccgatttagctctttgggagatggacgatattgattgcttatctggaaaagtttgggatggagatattctaagagtgtccgattgtgatatacagccaattgaagatggagagcccaagttattattttgagggcgtcgtggagggttcaaacgtttacaccaaggacacagtagatgatctcgataacaagcaaggacaggatttcatgtcggccgatgatttggaagaaattgatattggaccaggtgatagaccaaggccgacattcatcagtaagaacttatctccagaatttagaaccaagttgatagagctcttaaaagaatacaaagattgctttgcttgggagtattacgagatgctaggactcagccgatcaattgttgaacatcggctacttatcaaaccgggtgttagactgtaccagcagccaccgagaagatgcaaagccgatatgctcgaacctgttaaggctgagattaaacgattgtatgatgctggttttattcgtccttgtcgatatgtcgagtgggtttccagcatagttccagttatcaagaacggcaaagtcagggtgttcattgatttctgagacttgaacaaagctaccccaaaggatgagtatccaatgccagtagccgaccagctggtttatgctacttcagggcacaagatattgagttttatggatggtaatgcagggtacaatcagaactttatgtccgaagaagatatccataagactgctttcaggtgtcctggtgcaatcggcttgtttgagtgggttgtgatgacttttggcttgaaaagtgccggagctacatatcaaagggccatgaactacatttaccatgatttaatcggctggttggttgaagtctatattgatgatgtggttgttaagtccaaggaaattgcggatcatatagccgatttaaggaaggtttttgagagaactaagaagtacggcctgaagatgaatccgacaaagtgtgcttttggtctatcggcctggccaatatttaggatttcttgttcatgaaagtgggattgagataactcagaggagtgttaatgcgatcaagaagattcaacctccggaagacaagacagaattacaggagatgatcggcaagataaattttgttagaaggtttatctctaacttatctgggagattggagccttacactgttgttgaggttgaaagccgatcaaaaatttacttggggggcagagcagcagaaagctttggatagtattaaagaatatcttagctctcctccagttttgattcctccacaaaagggaataccttttagattatatctatcggccggagagaagtcaatcggctcggtcttgattcaggagcttgaaggaaaagaaagagttgtattctatttaagtcgccggctcttggatgcagaaacaagatattctcctgtggagaagatgtgcttgtgcttatatttttcttatatgaggctaaggcattatctattgtccaatgaatgcaccgtaatatgcaaagccgatgtggttaagtacatgttatcggctccgattttgaaaggaaggattggaaagtggatattttccttgacggaatttgatcttcggtatgatctaccgaagccgatcaaggggcagactatagtcgatttattgttgatcatcgtgatgattcaaaaccgctcggtgagattgtgccttggactttgttttcgatggatctgtgtgcactcatgggtgtggtatcggcttggtacattttccccctcgggggcagttttgagttttctnacactattaaccctnatgcgaccacaatcaggcntgagtatgaaggcggttctcaaaggggttgcaattactcaaggaagttgaagccgatgctgttgagattatgggtgattccttgctggtgattagccaattggcgggagaatacgagtgcaaaaatgatacattaatggtttacaatgagaagtgccgagagttgatgaacgaatttcggctggtgactttgaagcatgtatctcgagaacagaatgttgaagctaatgatttggcccaaggggcatcgggatataagccgatgatgaaggatgtcaaagtagaagttgccacattaacagccgatgattggaggtatgatgtgcatcattatttgcataatccatctcgatcagcttctcggaaattgcgttataaggctttgaagtgtaccttgttggatgattagctttattatcgaacgattgatggggtgcttaaatgtttgagtaacgaacaagccaaggttgcaatcggcgagctgcatgaaggaatttgtggaactcatcaaaaggctcataagatgaagtggttgcttcggcgtgcaggatatttttggccgacagtgttggaggattgtttcaaatattacaaaggatgtcaagattgtcaaaagtttggagcaatttagagagcgccagcatcggctatgaatcctatcatcaaaccatggccattcagaggttggggaattgatatgatcggtatgattaatccaccatcgagcaaaggacacatgtttatattggtggcgaccgattacttcaccaaatgggtagaggcgatttctttgaagaaagttgattctgaggatgctatacaatttgttcaagaacatattatttatcgattttgtattcctcaaaccattacaaccgatcagggttcgatctttgtgtccgatgagtttgttcagtttgccgatagcattggtatcaagttgttgaattcttcactatattatgcacaagctaattggcaggccgaggcatctaacaagagtttgatcaaattgattaagagaaagatttccgattatcctcggcaatggcatactcgattggccgaagcattgtggtcctatcggatggcttgtcacggttcgatccaagttcctccttataaacttgttgatggacatgaggctattttaccatgggaagttagaatcggctcacgaagaatggagttgcaaaatgagttaacagccgatgagtattataatctcatggccgatgaaaggcaagatttagttcaatctagactaagagcccttgcgaaggttaccaaggataaggaacgtatcgctcgccattacaacaagaaagtggtgcccaagtctttttcggaaggtgaacttgtgtggaaattgattttgccgataggaactcgagataacaaattcggcaagtggtcaccaaattgggaagggccgttccaaatcgataaggttgtgtctaagggagcttatatgttgcaagggcttgatggagaggtttatggacgagcgctaaatggcaaatacttgaagaaatattacccaagcgtttgggttaatgcatgatcggctggtgttgccgatacatgatagacgatgtgtttacatcaccttgagatggccgatatgattatatcgcccttagttgttttcatattgtaatcggttgtgtcttgccgatatacaatggccgatatagtaatatcgcccttagcagttttattatcataatcggctatgttttgccgatgtatgacggccgatatgattgtatcgcccttattggatttctgtgtgattaacataatcggttgtgtccttagtccaagttataattttatcaatgccttcgtcattgcaaaattaggggggcacatatatacaaaattgaggaaaacagagaaaatttttgagcaaattcagaagttatattaatcggcacaaaggattatcaagacaagttaaataaaagtaccagagtatcttagctgtttacaaaaatttcctaaggtctattacacagaaaatcactgggacagatagcgctggatagccgatatagctctttgcctaatttgttgtacttcttcaatagcttgggcatcttgagtatcggttctagggatgacttttaaggacttggtcatatcagcgacattcttaatagccgatttcatccttgtcttctgttcttcaacagcttgcgggagatcggctagctttttgtgttctagatccagttcggcgttgcattcttgaagttgtgccaagagctcaatcttacgagcttcaagctgtaaaatcaaaggtgtttttggttattattctatgatgaacaattgggcattggagattattggttttgttatttggaatttattcacgaagtggttttggagatgattggatttcacaggtgaatctataggttatcattttatgtgtccggtcagaccaggcaggtgttgccggtcagaccggcggtgatcgagcggtcgaaccggccagcccgcggtatgaccggccgacgctgtgtcggtgtcggtttcgggttgtttatttggatatccgtgattatttcatgattatggcttctagatggatactatacgtatgtaatactattgtttgctgctaatgagtcaagttggagatagcttggtctcggaatatggtttctttgtttgctccacgtgtaggtgacttgatgtctcgggagagtatttgcggtgatggaccgggagtcggcttggggataagacgacgtccgtggtggtcagagatcatgcgggatactaaggctagagttgatgcacatggttgatggagattccatatggcatacgatggagttattgtgtgcgtatgggatgtggagtcgaatttggaaggagtccaaatttggtacgattggtcctgtaaagtttctttcttgaactagagggtttcctaaggtgttacgnactcntagtatgagtttggttcgtggctttgggctgcctacctcatgtataaatagagggggagcgtgaggcttcccggtatcgctttagagagcaattgagttgagttttgaattagggtttcgagtttagtcgaaatttttgtaaggagtgttgttggtgcnctttataaccacagagagaagaaataaagttgtcatccactttaagagttcttcgatttgtgtttcaccgagtttcggtggtccaaccggcgacataccgacggttagaccagtggcatcgcggcggtccgattggcggaaggacggcggtcagatcggcggcggcgacaggcgcggcaggcgacatcgatggtcagaccgggtgatctataccggtcagaccgacggcatccacttggtcagaccggtagatcaatctcggtcagaccgatctccatcgaattcgagggtaacttttattttcgctaaaagttttcggtttttgggtataccaaccattcactcccctcttgttggcttagttcttgctatttgatcctacaagtggtatcagagccaggctaggttaacatctctggcccgatggacacgtgtgaaggcctgatggaccttgggtgcctgcggggcccgcatacctgatggaccgtgggccggtggggcccggatacggtgaaggggcggtgaagggctaagggacactaatgtgtgaagcggagattgttgaatagtcccacattggttgtggaagggcaaagaacctaagatataagtgggggagcccctcacctcaatggctagcttttggggtgggaaaggccctttacgatcctacaattggtatcagagccatgttttcttctttggatttttatcgatctagagtttttgccatggctactcccgctcgtttttcaactaagcctcatgttttcgatggaacggatttttctcattggtgtagtaggatgcaatcttacatcatggctgaagattatgatatttggagaaaagtttctcatgcttatgtgattcctgaagctattaatactgctgctgaaaaaactgcttttgaacaaaattgcaaagctcacaacattcttttgagtggtatttctcgttcggattatgatcgtgttgctcatcttcaaactgctaatgagatttgggttgctttaagtaattttcatcaaggaacaaataacattaaagagcttcgtcgagatgtttttaaaaaggagtacattaaatttgagatgaaacctggagaagctttggatgactatctttctaggtttaacaaaattttgagtgatcttagatctgttgattcttcttatgatgctaattatccacaatctgagatttctcgtcactttttgaatggtctcgatatgtctatttgggagatgaaagttacatctattcaggagtctgttaatatgtctactttgactttggattcactttacaccaaattgaaaacaaatgagatgaatgttctttctcgaaaagctgattctaagtctagtgctttggtttcttctacttcttcttctgttgttgatgcttcttcatctatgccttcttttcttgctgcttttaatgccacatccgatgatcaactcaaacaaatcgaggaggaggatttggctttggtcgctaaccgtattgctcgagctatgataatgctaggaactgaaaagaggtggccaatcggtgcgtgaatgtggttcaattgatcatcttcgttcgcattgtcctaagcttgggagaggcaaaagagaagacaaagatggtgagaagacaagcaacaacaagccctacaacaacaggtcgaagagttcatcccaagggaagaagatggagaatctcaggaaggcttttcaacaagtttgtgctgctttcgagccactaagtgatgtagatggtgaaagtggagatgatgataagaggaagaacatctccgatgtttgcttcatggcgcgtggtgaatctgncatagggttttatcaagatgggatcaaccggccgtg

SEQ ID NO: 78155 - DNA, 555 bp, Oryza sativa
gtaagacagctgatgtgtaagtttatcacattcttcctcctgtgatagtcaaccatctaccttataattcgccaactcattttactgatcatcatcattggacaaatccaacgcccctcatcgctccgtcctcatcaaacggtccaaactcatccacgcgctcaccctctctccccgtaatttccgctgcccccttccccaatccccacagcgcgtaactcccgtcgtccccctatctcgcaattctaaaaaaaaaaaaaaatcgcccctcaacctcccgtcgtcagctcgtccacccgcccgcgccgatctctcccgtcagcgtctctgtcgacgccgtcgccctccaagacgatctcctctgcaccgccagaactccgtcgcctccctcgccgaactgctccgcccataagctgctgcctcctccatcaacgtgatgccgcctcaagcgccaccggtgccaacccatatcccctcctccacgaagaaaccctcctcccccacccctcccccttttctgtctccccatccctaatatgtttcctaatatttcag

SEQ ID NO: 78156 - DNA, 1890 bp, Oryza sativa
  unsure (1)..(1890): unsure at all n locations
tttttaacacgaagggtgtaaatgtttttttatctatggaaggaagccccgccccccaaagccaaccaaacacggcgaagttgaggggggaccacgggcatttgcggaaggcccaatttagacacaaaggcttccatcctttaggaactcttttctgagtttgggaaaaattgagcagcttgagtacaccccggtcttcaacaagacacaccnccaattgcagaattaatgcaaggaagtacaaggagtttatatataagggttagggttgcagtaacagcatttaaaaatattttagtggcccaaagctattttgtaaacacgattctagaactattcaatattatttatcaaggcggtgaacccacacgaacctgctttaacccagggcntacgatgattcagaccgaactggcaaccggacctgggtcccagctcgtcccaagccaacccaggccaaccattccacattttacttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaactcccgggacaggtaggcaggactgagcccctagcagcaggacaccggccctgtgccatgacatctcgactaccgaaccgcagcccgtgtagccttcatttgtcctagagatgtccatcgacccccgacttcgtccatctctaatccgtgtacttttgtttataaccagactgagccacaaactaagccttacccactagacatgtggaagtacggtagtgctttgcaacagaggcccgaagaccggtccttatatggccgaggtgctactatcaaaaccatgcacgccgagcccagcctaaaaccattttggggattttgaaaagaaggagcggtgtgaagccaattccacaataaccaaaccattccaaagtgtccaggtgatatgaatattcccaaagtctagagttataaaaccacctaatgttacctaattaaagcgaagcatctaccttaaatcatactagtggtaccattagtagagtgtccactagttggggttttgttggttctagggtgaacaaggtaataataacaataacaataataataaggtcataacaaaggtaaataggcatggctaaataaaacagtgataacgcggaatttaaataaagcgataatgcaataagttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctactaaactccatataacaaaccgaaataaagcacaaaaatgggttcttggcttcttaaggaaaaattagagacttgaacggtccaattctgagttcaaatggccaagttatggtcatttgaagtttatatgctctttaaatggatatttgtgaatttcttcatttaaattttaatttaaaatcggatttattgcgtcagccgggagagaggagcgcgcggaccgggtccatgggagtggggcccatgcggcagcctcacggtcgacggtggaccgggtgcacgcggcttacgccggtcggcgccgtgggtcccacgcatcagccgcacccgagggcgcatggatcactcaaagacgtcaatnggcaat

SEQ ID NO: 78157 - DNA, 5251 bp, Oryza sativa
aactgctggaaagtgaaaaccaaccaaacagccattggttaaaattgtggtcatagaacaggtaaaagatagtgacgattcaagtaatcgggagtcagaacagtatatatttgtctaaagtttaggaaaagtgagctcttgcagctatggactgtctggttcatctacttcaagtcctgaacggccttggtatgctggatctctgcagatgaaatccaagttcaaatttcaacagtataaaagattctgttggtctttctgaataatgatttgagatgacagaattaacaaatctgcaaacaggtttctgctccacagaatgtcttgcaaggttaacaaagaaaggaagagggaccaaactatgtgtttattttggcagaaagatacacttaatatcacaaacatgcattgaaagatgtcacaatgagagaggaataagcctgggttaaagaattcagcaactgagcacgcgtccaaacaaatattgattacactttgtatcttcaaatgccatgtctgcattgaatcaacaagggacatatataaaaccaatgtctgaaaagcattaactaacaaagactaacaaaagaagtcagggaaggaactccaagcatggttccgaaattagctactccacaagccatatatatacttctaattgttggagaagaagcagataagtattgttggacagatgaagtgtgcacatgaagaaatccaaacaaaaggttaattttttccaatgcatgatctttggtccagtcgagcttcaactccaaaccttaacttgtagatattgaatgacagcaaatccaatgagggaaccactattgataaataacacggacttcccatgaactaaccaaacatagatcccttttcaactccaacatccaccctttggcgtgtcatctaaagcacagaaacacatacgctaaacaagattagcttttaaaataatttataccaagggtacggaacacaccttatataaaaggataatgtctgatagctggccattaggtaaaattcctcaaagtgccgagacaaagaacagcatagagacagacaatccaaatcaagataaatctatgaaacgaccagaccttatctaataacttactgcccttcctcaatttccaggtactagctttctcacagggagctcatttccaaccaaccctgtaatcaatatgcgaacaagaaaacacatgcaccgaatctagaaacaatcgatcaaaccacaaaatggtaatcaatatgcgaacaagaaaacacatgcaccgaatctagaaacaatcaatcaaaccacaaaatggtaaaccacaaaccaggcaatttaatttcctcgagaaaatttcctcgtcacatggacaaaaggagaatctgcatgcagaggaaggcacaaatgacgccaaatcaaatatgggcataagaagctacattatcaaccaaaacagaaatagaaacataagaatgcaaggagagcactaaatcgtatatagttgtaggttgtacgatctcccatggtctcatctagcttgaagctccaaaacacaccctcgaaccctccccatccctgatgatcgaaattaagagtattcaaattctgtccttgtggggcatttaactttttaataaggagttgaagggaaaatcctggttgttcagaagatttcaatcggaattggatttgccttgcaaaatgaccaaaaatagacctgaaacaggcaaaagactatcttctatgaatctgtataggcggaagcagcttagacatcaaaaacaaattgtcatggtggaaaggagggataagcctgtttagagaggtcagaacatccaaatctgtattgattttgcagctccaaatctgtactgaatctgtatgtctgcatttgaattgatggcaggcacataaaaaccatgtctgaagagtaataactaaagaagtagaaagattgttaatcacagaagaaaccagtgccctgattagctccaaaatagcaactccaacaaagctagtacttccaattgctggagaaaaaacgaaaatccacataagcatcgctgagaagatgctaaaccggatggtaagtactaaaataatgagtgggtgaatttggcttaatgatctttttccagttatatgatagttgctccagtccaccgtaatatcaaaagatccatcctctactcttggatttaatctcccgatagccacccttctgcatcatctaaaacaaggacaaacacacaaaccacaaaaaaaaaactaactcaggtctcaagtctagaatccactaaaattacgagatactgcaactgatggctggccatcagggaagaccccacacagaaacgccaagccaaacgatccatatgctgaaataatccaggtaacaataatctgcgaaatcaatcagaccttgtgtgcattcagagctccaacccccagaccaacccagagactatcggataaacataggtaacaattgaaggtgataaaacacaaaccgaacaagccaacagcctccaatcaataaccttgtcaacttgggagaaaattaaggaatctgcgaccaacaaagaaagacaaaggcacaccaaaatctaagctacatgtatgaagcaattctgatgaccgaaatagaaactaaacaggaagttaagtattaggcaaactaggaaaagtatgttttggttgtagaattctccagtagtcacatctatcttgaagctccaaaattcctacgcaattccatttctgcagataaatccaagcacttaaattctacccttggtgagtacttctaatgatgaattgaataaggggatttaaagatttcactcagtgaaggctggccatgcaaaattatgaactaggacctgcagtgagcaagagaccacttattcgagaagaaattcaactttgcaagcaattaacttctgatggtaaattgaagagaaaggggtgatgatttaaaggattcactcagattggccatagaaattatgtagaaacctgcagattggccatagaaattatgcagaaacctgcagtgagcaatagattggacttaaatatatctttgtgaggtatataacttctaatgatgaattgaagagaagggtggtgatttaaagatttcactcggtgaaggttggccttgcaaaattatgagataggcctgcagcaagcaagagaacatttatttgggaagaaattcaactttgtaaatttttaacttctaacgatgaattgaagagaaaaagggtagtgagcttcactgagacgagccataacaattactcttatttagagacctacagtgagcaagagtattattttggaggaaagcagcttaagcatagaaaacatgcactaaagactgagtggcataggtataaagcctgtcttgagctcgcagaccgaggcaggtttggattgcaaattccatcttagttgtgtgctatctgcaagaactaagaattactgatgaagaacatggaaaatttgattaaggggaagattgtcgatcacagaaaaagaactgccagcggcctgtatgtatggtgattccaattcatgcagcaaataggactcgccgtgagatgcaactcccaataattctgaagaacaaccaacggcccaaatcagacttttcaaggcattaatcaaattatgctgacaacaactaaatcaaatcaaggggggttcagaatccaaacgaagcattgctattccatctgacaatctcccgtaaatctatctccaaatcacttagaaatctgcacatcttgaggatctgaccaaaggaaatccagtgaacgttgtcacgacaccacaaactttcgtgtcagaataatttcagaaccaccatgaactaatcaaaaagccatgaaccataacaatcaaacctccacctccccgattcatcataataatcaaagcaaccatgaacctggaccataataatcaaacctccaccaattcggttcatctcaacagcctccctccctcctgcatcatctagagcagcacaaacacataccacaagccagatcagcggttacaaataactatcaacccagggtctcgaatcacctcgcgtaaggacagataagaacccgatgatcatccatccatcgattgaaggtaatcaaccactcaaatctgaaatcaatcaccgaacccaagtgactaaatcaaacgaccgtagacgggaaactgacctcttcctcgaaacctcgacttcccccttcgccacacgacgccacgggaacctccaaaatcccggatcaaatccgctcctgcaacaaccgaacacgccgagaggacgaacacggggaacaacacaaaacagaaatcgagaccagagaaggggtcggataggatcggatcgaatcgaatcaccggggaggaaaaaaatcaaacacgtcgcaagcaaaccgaacaatcaatcaatcaagtcgaacgaatccagatagaggaggctcccgggcagcgtcgcacggagatctgcggacagaaaaggcgaagaacacgacgacaatccaaatcaacacgaagattattaagaggggaaaaaaacgaagaaactcgaatcgaatcgagaggcagagggaggaagggatcgggaacgggaagacgcaaacgcgacgacgcgaccacgccgaagagaagaagaaaaaataaaaccgagggggccgcgaggtggggagaaaccgtggcggggcgtcgcctaatataggagaggggtggacgagaggcggtgccaagccaactcggcttcggctttccttaacggacacggcgccgcctcggcctcgcgtttggtttggccccatgtggggcccaggcgccagcgagacaggtggggtggacaggctggtggaagtggtattccgtgttcgggttggctacgggggtgcgtggacggttggcgcgtcggcaacggcaacgcggaagatattcggtcgcgtggaccgagaaacttctcgggttcacgggagcttcgcgaggagagggggggggggggggggggtgtgggtgtggggcccggtcgtctgtggctgcggttgattgctgaccgttggccacccgtgtatcatatggtccgcacgtatttttggggttaaaaaaaggcttttgcaggatttgcggggggcatcgtggaccgggtccacccggaccggttcctaggcggtggaagaatttttttcgtttttagattttttgggctgcaggaat

SEQ ID NO: 78158 - DNA, 3567 bp, Oryza sativa
ctccaatctcagaattgccattgaagcacatacctggatcagtgcatgccacagagccaacactgcacggcttctggtaagggaatgtgccgatctccatatcaatcttgccccggacatcgagtaggatgctccttaacctgatcacctcagcctcgagcgcagcatggccctgcaatcgcttcagcagctgctgattggcggcgcggagcttcttgacctcctcctccaagaaagccgcatgcgccttcttcttctcccgatacttgcgcacggcttccctgttccccagcggcctccgggtcttcgtcaggtcctccttgatgtcatcttcgccactgccggaggcgaagacctgggtgtgcgtgtgcaagcatgtgtgggtgtgcatggttgccgacggaccaggaggattgcaggtgtgggtgtgggtgcaggttgtgatgttgttcaagaaatcatcgaagctatcaggcacctccggatgggagaagagcaattgacttgggacatcgtccattgccgcagaatgcgccaagaacaatctcctttgtatgggtcaatggacaatttgcacaacaaagttgcaattgcaattgcaacaaaaggaatcaagaacctctgaacttgtttattcaatgaggtttctagattaactgaccagggattgagcaggcagactacatgatctgccaaaacccctgcaaaaactggtgagctaccaactaataatcaagaaaggagtgagcaacaaacatggcacaagtgaggaagccctgattggggagctctacgacagagggcatcacaagagccaaaaaaaatcgatgaggtgctgaaatagacagagaaaaggccggattcgggcatcaaaacctcatcctgaggacggcgagcgacatggatggaattcgcagcaacgccgagctgcctcttgcagggagaaaagaaaaacaaaagaaaattgaaaagactctctctctctctccttttgctcccctcgctttccttcgctttccgccttctctcgccaccgatctttttcctggcgatgttcccccttctttgctctggcgattgggggtttggggatcggagaatcttggaaaggagccgcgccgcgagaggaggaggggagcgacgttgatttgatggatgagtagtagtggtgggagagatcaaagttgggggaggatcctagttcttgccactgtgggtggggatggttttgttttgtttgggtttctttcttttagagcttcctttttgcatatttaagtactgcactagttgtttgtccgaactgccacttggacatttttgccccttttaatattgttgcctagttgaccatgacacatacggatgtgcactgttttagtaaaattgctgcttatttttatgctgatatatcccactacatccattctaaatccctatatttttttgtagatggggatagtattaacgcgaagggccttgaacgcaggatgtaaaaatatacacagaaatcgaaagattataggaacacaagacgaagtatggtgtttccgtgtttggaacactaagaatagagtaaatcaatggattcttgatatataaaatatagtttctatttgcttgttgattgtctcaattgtgatcactcgaagtcacatgaattgatttgttttggtcgtctcaaaggcaaataaaattgatttgctttggtcgtctcaaaggcaaataaaagtcaaattcctatggacatgggcaaagggaaaattctcttgtactccaatgcccttcttcaaatctccaatccaaaggtgtgaatagtactacccaaatccctcaaatccttaagaattacccaattttcctcaaatcccaaaaaaccaaaggcagccgaaacgttcagtatactaatagccaatgaagatatgcttgactgaactaagccgaaactgatttcaaattgtagagttgactaatttctcaatttgacaacgcaataggccaaacctttgtattttggatgcttacgagtgtacagagaggaaagaaatggagggatatgtagccgctttttacaatttagatgacagaatcaaagaatcagagggtgcacggcaacacccacgatgcagatatctggattttaagatgcagatatctggattttaatctatctcgtggcgtactggcgtcgtatcacaatatcaatactatcatatcagtgcagtcccttcaaaaatactatcagtgcacaaggccactattgtttcatcctgctgcccacaaactttgctcgtcccttgccgcacaggatcaccgttgcctgctagccgcgccaacactgcatctgaattctgaacgagtaggaaaattagagtgcagtctagctgctcaacagacacgagagttttccattgccagtgtcttcagatttgtcagctgacgctttgtccctgaaatgtagtcaatcgtggaacaactgaagggatgcgaattttttacccccaaaaaaagggttaaaaaaaaacatagtcccgcggcaataatattggaggccacacttttaactgaaaatactggctttcttgtcaaaccatacctgtcttactctgcactgccgctgccaacactttggcctggctccggaaacaacagtgtaacctgcaaaaaaatgctctgataatgcaacaccattgcaagatcgaaatcccatcaccaacaaagggtgattacttctactttgatgacaaaagtcagtttgtggttttgcagtcattgattccactgcggttccgtcagaaactcaaatccagaatttacaacacaaatcatattaacaagctacttgcagttccctccacattttttcatccgggcttgggaccggcaaaggcagtgttaaacggcaaaaaaaaaaagagagagagaaaagaagaagaaagaaaaaaaagagagagaaaagacaacacaaaacagaagatcaaattgaaaaacaacgaaaatatccatcatgaaacgcaggttactcaacaacctaaaattattgtggtcagtctggaaatgcaggttaataatcactaatttcatcaaaataaagtttagacccaatatgtaactgattagtgccttaaaaaaaatccaggatgttgagatatgatgtgaaaaccagtgattcaagacagcagaaacaagaaaatgccatatcttaatttggcacaggtaagttaaaaatgtgtgagaacataaagttttgtgctcattttagtatcttctgctccaactccaaatcatagtcaagtaaatcaactttgaaccgttgtaagcaacataaacaccaactgactggatataatattgggaagaattggtcattaaattagtcatctgaacaaagaatccttataatcatcaaggttattgaaacaatccaacataaacaccaacttactggataatattggtctattgggaagaattggcaagaataaagtgttgtgcagttagcaacagattgttacacattctttttctatagaactcatataatgaaacctgcaccaactgtgatac

SEQ ID NO: 78159 - DNA, 13430 bp, Oryza sativa
tgcaacactctgcggacctggaaaagagatactttcatggaaactgcacccccttgagcagttccttactcctgatgagaaatatgaagttgttgagcaaattatggttgatgcaacaaatcaaataggtttcgacgttaatcttgctgctagccatgagtggcatttttcaactctacaattcgttgctggtttggggccacgtaaagcttcagctctacagaaagaattgttacgagagggatccatttttagtcgcaaagatcttgtaaaacctctaggcaggaaagtattcatgaatgcatctggctttttacgtgttcgccgtagtggtggagctgccgcgagtgctcaaatcattgatttacttgaggatacaaggatacatcctgagtcatatgcattagcaaaaactttggcaaaggatgtatttgctgaggaagcaccacatgaagcaaatgaaatggacgatgatgagcaagagatggcaattgagcatgtcagagaaaagccacgttatctgaaatcgctcgacattcgtgagtacatgaagagtatgccagaagagttccataataaagagcaaacactgaaagatataaaatgggaactgttgtgcggtttccctgattggaggaccccctatgctgagccaactccagatgaggaattctggatgctttctggggaaactgaggacaccatatcagatggaaggattgttcaagttactgttcgtagtatacaagataaccgaatcatttgcaccttcgattctggtctgaaagccatagttatggctgataactattctgatgagggctttgatctagaaactctgcagttacatgaaggtgatgtattaacgggcaaaattaagaatgtgaataaaaacaggttcatggtttacttaacatgcaaggcaagtgaattgaggagaagaccattgtccagaggtaatcatgatccgtacaatcatgaacaagacatgacttctcagaatgaacaagataagcttcggaaacagaaagaactggcaaagaaacatttcaaaccccggatgattgtccatcctcactttcagaacttgacagctgaagaagctatgcaggttagtcaagctcttatcgatcagatattccccactctgtttatttagtttctcctgtcgtaaaatctaatatgaaccctcctgaaacagttcttatctgacaaagaacctggtgagaaggtcattcggcctagttctaggggaccatcatttctgacacttactctgaaaatttttgatggtgtccttgcacacaaggagataactgaaggtggaaaggatcataaagatattacaagcttgcttcgccttggaaaaacattgacaattgataatgaaacttttgaagatcttgatgaggttggtacacatgatctctttttgttaccattgttactctagttcagtatcagtaagtggtgactcttttctgtgtttgttttgcacgccagcatggttctgtgtttctttttgcttgctgttatcacttagcagtagattgtcattctgttatttttggctaactactggtgctttattttggcaaataggttatagacaggtacgtggatccattggtaggccacctgaagagcatgcttttgtaccgcaaattcaagaaaggatcaaaaagtgaggttgatgagatgttaagggctgagaaatcagagaatcctatgagaatagtgtattgtttcggcatatctcatgagcatccaggcacatttattttatcttacattaggagtacaaatccacatcacgagtatattgggttatacccaaagggctttagatttcgtaagagggactttgacaatattgatcgcctagtgtcctatttccagaagcatattgacaaaccaccacctgatgctggtccatcaatgcgaaatgttgctgcaatggtgcctatgaaaagttcaggttggggtaatggtggtggcactggtggtggaaatgatggatggagaggagatggtaacaacgacagggatagacctttctctggaagatcaggttagtttttaacgcacttgcacaatgttatcatccagtttatttgcatggtattggcaggccagctttattatgactcaaagatgtttgcatacttaatatttgcatggaggactttaaattctatgggcctttagttcttcagttagcagaactatagatatgcttgtgtcagtttcagttggctgtagcattctttagggtgattcacgctctgtttgcaggcgccagtatcatgagaaccatttacttcaaaaaaaaattaaaaaatattgccctctgtatttgggattcctgattgtttatgtggttcaggtcaatttatttcatatttcaattttctacttcccattgcactttctttatcttgtgcttctccaatcattgatatcaccgatgaggttcccactaaacatgtgaaaagctaatcttgaggcaactataaaaccggccaagctactatttttggatagtaatatgatttgttacatttattgaattgttgatggatccttaagtagtcacgaactcccttttggtatcttttgtctaaagcaggaggcaggtttgattcaaggaacagctctggtggtcgtggacgtgggcgcgggcgtggtagaggtaactttggcagtgatgatggtggcggcggaggttggagtggtggcggtggcggtggcggcaacagtgggggatggactgacaatattggaagtggcggaggtggatggggcacaggtggtggttcctcgtgggctggtggtggcgacggaggttctggaggtggtgatagtaaccgtggtggtggtggaggctggggaacacccgctggtggttctgatggcggcggcggtggctggggagcagcacccggtggatccaacgatgccccaggatggggcagcggcaaaaaggcggtcccagcacaggatggtggtagcgggtggggagcttccgccggcggcggcagcggtggctggaactagtcaaagaactgctagatgaaatatttttttttttgttttctggaccctcttctatatctggtaattgcgctccacgggagaaaaattgtcactgttcggggaccctagtaatctgctactgaatgccgctggttttatacattttggacggccttattttgaatgcatgtacagcttaagcaccacattttgttttttagttttcattacaaatgcacgaacccatagcccactcagattggaattgtctcaatggttgtaatgccatcgaatatatctaactttaccaggatcttcgtaaaccgtcgtgtcgctcgagccatcctcacactcgtgagagtgagatgtggagctagtcggcccaaacggccagaggaacgagcgcgagcctcgcctgacttgcctctcgccgccgctagctcctccaccggaagcggtggtcgccggcggcggcagcgagtggcggcagacgggacaggagttgtgatggaccagccacggcacgatgcagtcggcgtggtacaggtgggcgcacggcatctcccgcgcctcggcgccgagctggaactcgtcctggcaaaccgggcaccgcggctcggcgcggaggtgccggcggctgatcgtcaccacgggcatcgcgtcgatcgccgacggcggcgccggtggagggccctgcctgctgctccccagctggttctgcagctgctcgaagagcgcctccagaccggcacggtagtatccgccgcggcgctcgacgccgacacggggccctcccctgaagaggacgccgagtctcgcgtgcgcaggcacgccatcgccgccgccatgctcgtcgtggacgtcgacctcgcgctcgtcgccgcccaccgttgccgcgtgccgcatgagggtggacatcgcctccatcaccggggatcgccggagcaagaactcgtcgccggcgtctggcccgacgaaaccgagcgtgctgctcgccgtcctccgtcccatctcgctcatctcctggacgaagccgtcgtcgcagcttgggcaggtgacgtcttggctgccgccgcggatgcgaaccggccgccggcacacgtagcaccagtgcgtggctctgtttgacatcttttgcttgattcctgtgacaatctgagaattcagtagtagcaggcagcagcacaaatttcacgattcaccatcgaactgtcacgacaaatattacatgagcaaacttgaattggacatccaagacatgataacagccccaaaaaaatattgaaagaaagtaaaaagaagagaaattgatccgaaccagagataattcccacccaagaattcagttgacaggaagcagtcaagcagttgtgtgcatatgccacaacaaatcaagctaaacaaacactaaaagaaacagaattaatccaagcataccttgggataagctgatggtttgggaggaggagaatgaattggcggaatgaattgaatgatggggagcggactgatgatagataggcggtcgcgagctggaagagtactgaaagcggctgctgtcggagtatctgctacgatttgtccgttcttttttcttttggaggtctttgtccgatgagagcattctaggcctcgcgttgctgcttgtgcagttaacttgtcaccggcgggcagcgctcgctgtcgctggccatgcttgttaaagcgacgtgttggctcccggtccaaaatacacgagaaatggaagtttgttagtttaacgtctcaacctttgatcgtgaaactttacttgataatcaaagttgatcgagtatgtattatcataatagcgtttgttacgatttacgacagtcttgattgtaacagtagaacagaatgcgacaagctaagccacaagcccacaactgtagcagtaagcggaacatccgtctaaagccgtgttcgactgttcgtcacagcttacttaactagcactatttataaactactaaacgacaagcaatgtattttgtgcaaaagttttatacgtataaatttattaagaatcaaataaatatatatttttatttataatatttaatatttagttaatcctacctgcaccttttttaaattttttttgcaccaataatctcagccaaacagttgaatcgaacgcaacgaggaaccatggtatgcccagtgtttggtaaccaacaaaacacgtctagcttaagaaaacttaaacaataggataatataatttttgaaataacctttatatagaaaattttggcgaaaaatataacgtttagcaactcgtgaagcatgcgcatgagtaatgagaaagaaaattgaaaaggtgcagaaaaaaacatgccttcttttacacaagaatatacccttagagcattatttggagtgaagattttggagaaacatctatactacggtaaatattggcaatgatgatagtagtcaatctgccaccataaccccttatcacttacgtgtgggcctctcaacgttggtaaaaaaattatacttcctatttcaaatgctccttatccctaatccctgaattgtgctttcattcgatagtaacatgtgaaaatatgttgcgtaaactaaatacagtgaaaacctaaaaactataatgtaaaaatggatgtacgagattagttcacgtcatctaaaatactaaaagctttactcatagattcaatcatgactaaaatttttactcttggcggcgtgaaaaatctcagacatcctttttttaaatcaacgggactccagtttttatattttcagtatacgtaacttccagcgacatatttttaattgcaacgcacgactagggtgcaagcgggccaacccgcaaacccgcttataggcaaaatgagtggataacccgcggtttgactcgcgggttaccaactaatttgatatataaatgagttttggggttgatccacttgcttctctatgacacggcaagccgagccatgacgcgaaaacccgtggattaccttctatttacatccctagtcctataaaaaaaaaaatctccgcagccgactttccattcagcccaccctgaggtctcggcgacattgcctgggccgtggcgctctcgggctgggctttttctccccacggagaacacgctcgcggccatcacgttagcagcccactcgctcgctcgctcgcggccgcgtctcccgtcgtagctcggaggaaggttctagacgaggaggagaagacgccgccgccatcttcgcggccgccggagagcagccagcagcggggtgcgggcgggcgcgggcgcgacgcgcgtggcgcgggtggagctcggaagcaggcgcagcctccacgggcgcaggcggggttgccgggacgcgcctgggcgggcgggcgggctcgaggttgtggtggggcgtgtggcaggatcctcctcgcgccgccatggatcagaggaaggcgttgttccgggcgaagctccgggagcgcgaggccaaggagaagcaggagaggcgcatcgacccctccctcgtcaggtatatatctcctctactctccctcttcccccatgtatctgtgtgcctctgctcttcttctctcgcggattcgtatgctactagtagttttgtctccggatcctaccgataagctcgtgctgtggctgctcgcgcgtttgcttgatgtaaccctaggcaattttgaatgttttgttacaaccaggctgggattttaagggcttgaaccggtttgcgtaccctccagtagattggaagaatattacaagtataacatagctaatgggttccagtttcctgtcaatttggtgtaatttgcagcgagccatgaaaaacctacaacattgatcacaatttatataatacctttgcatcttgttcagccggaatggttgctgacagaattgttgctatgttttatccagttttgaatatcatgagcgttgatgaccaagggtagtattagatggcaacatactggacgtggattgtttttaagcaatacaccattctaacagataggtgcatcattccttcaggtacaatgaatttgatcagcccatctgcagaatctgcaatgttactctgaaatctgaagcactttggcctgcacatcaagtttcacgaaaacatcatgaggtacacagagaaaatgaatcatagtcattctggatgatctatgcttggattgacattcgaaggatgtacacataacacatcattttactatctcatgtggtatgaatatgttgatggaaacacaaatacatatagaaattcaacagtgtaactgcaaatacatttctgctgagcatgctagcttatcaatttggataaaattttgtattagcatcgaagatggttgaaatttcatacatgctgtggtctgtgggttgttttggcagtatggtaccattctggttatgttcacttccactaattatctttttttttgttagtatctaaaaggaaaaaatattatgcggttcatattgctgataaccatggtgtttctattcttttccctttagaagttagttgctgccttaaatagcatgcattacatcccatagaatttgtttgttcaaattgcagagatgtgagtctagtttaactgctccaaggataattgattgttctataacttcacatacatatattcagatctatggctgttactaggatttgaagtatatttgttatttaaagtgctcatgtacattactgacccatcttgtcatttttatgatacaggcaaaagccgctgcagctgcatctgctaaagctccatcaggtgcagggtctcgtggcaataaggccaatcatgaacaacctgcagagtctcagaaaccaaaatcttccacattgcctgccaacttttttgaaaaccagggaatgaagaggcatagtgatggtgagagtaacaaacacgccctcccatctgtctgcgctaaatttaaagatagagtgagaaagcaactggaacagccttggttatactttgtagtcatttgcttatatccttttatttgtgagatctctgtaaatattgatttttcgttgagttctcagttgataggctctagaattgtattaatcatgcatctaatttcacattttggtccacacatggtacaatgctcatatgccatgtgtctgtatagatcttcaatgaaattgattatcttattcttaaaataagcaggatagcattatcatgtagtgctttgatttttataggctaattgtaaacagatttaactttaccataaaatcgccataaactactgaaatttcagtcagctaagattgcatcttagactttacattccttagtacatctgataatagctaaacctgcgaaatgttactatttgtgtgagaaatggtgttaggatttgaaattttctttgaacatttttgtttgagacaacattttgtattttctgaagaagaaagaaacaaatatccatgttatgctatcctctgtagagtgatcacctgcatgtacagaacatatattaattcctattttatcaagcttcctgctagtagtattatttatatatgctatagaaagaactgaagtgtccatttagcagtccaaaaaatatgtttcatgctcatgaaccctaatataacaacttatatgactaggcgctggttctgaaggaaggtctgtgcgtcgggaggtagctgatgttcagcaaaaaaccaaagaagcaagcaaaactaagccatctgtcaattttgagaaaataccaaagaaagaaagtcaagccaataccaatgtcaaaggtgttcttccagggaacttttttgactataatgatgaagatgaagatccagctcctactgaggcgaatagtgcacctggaaatcctccaatttcaaatcgcatgcaggtgaaaggtgtacctgatggcttctttgatggcaacaaaaacagcaatggcatgcaacccagtgaaccaagtcaatcgtctaaagccgtaaagagttcagaaacttctgaagtaaaaggatcgctaccagaaggtttctttgataacaaagatgcagatctccgtgctcgtggtatccaacctccgaaaatcgatatcaagtaaggttttcatcgacttgcatatgcattgcatttattaagtatatgcttggacctcttgcagctacacttgttattctcacataatatacccttgtggaagaatgaatataccttttgaaatggcaagtttgaacatcattcatgataaaaatttcaggcttttccttttcatggaagatgtcagcagaatttaacaatataattaaggctgattattaaccttactactgttacttccacaccctttttgcacttgtgcacttgtcaagttcatacctgcatgagggtcagagggttaataatcgtgtttatgttttttctgtgaactatgacatttgttctcttctttttagatcatattcttcctgcaaaaaaagaactgtattcagtttgtattgattgatagttgaagttttaacatgaaatatattattaaaaaatatttttcagtgatgcttacaaagaatttgagaaggaaattcaggaggacttgcaggaagttgatgatcgccttgaagaagaggaggttaggcttctctattacctagttacacaatataaagaataccttcgcttgtctggtgcaaatgctagtttgaactgctatattagcttttttttatgtgaactgtagattgatgctgctgctgagagagaagagtacttgacattagagcaagagtatgttccttagccacaacttgctatttttgagccttcatgcttagcgaagcgaaggttttttattttcatcgtccatttattttgtacacagggagtataggcagcgggtggatatgctgaagaaacagcttaccgagtcaaaagccgcccgtaccactaaagcaaacagcaaacctgttggtatggacatgttgtcaagcagcgactcatctagtgacgaggaagatgacagcacggattttgctgttgattggagagcacaacatttgaaatgatgtggagatttttgtgattggctacccaccgacgatgacaacatagatctgttagcatccaccattgtgcatccgtgacaatcagatcccagcacctctaggtttctgcttgaggagaagatgatctcttttttttttctgttgcatcttgtcttttatcggaaaaatgttcgagctaatcatgaattaacacgatgagaatagttttggagaactggtgaatgtgtataatccttgctcctaaacctatgccacaatcttatctgaaggtgtatgcctatgatgggcaacatctttgtcggattgcaacttcaagatgaaagttggaagggacgcctttacctgtgcagattgactgcctttcatcctgcttcaactccaacgcttatctacagggtttcttaccttttttttctcctctgcttatccggcaccggcaactccgacggtgtatctttctgtgatggtgaaggacgaggccgacgttgctacgcgctggcctgccgggtacctaactttccaaaagtttgaaacctctcatcttttgcttgttggctgacaatgcttgtttgtttatcggatatagccaaaaattgtattttgaagcttgattttagagttgatttagagcttcttcatcgcggtttatttttttctaaggtttttaaaacattaagaacagaaatatagaagttctatccatatattttttcctcgttcattttttcatgtgttattgaggcctggtcactgatctggactagtgtgccgacgttcaatggatcgtctggtgctttgccttacagaaactcaaaactagaattgttcgtagacatcttctgtcttgtgtgctgcagtatccaactttcgcagctctactgtctaaaaatgaaataaacttgtacctctgccatattggatagtgtggtactattgtagtgtaagcaatgttttgcattcgctagaaatactgtgtttcgatggtgccgcttccaaccttgtagatcaacactgaaaacaactagatgaacaagaacaatattaacatagctttctgtctctgctttattgataatgagatatgagaatgatgcgcacagtttcactgccataggtcaaccagactcgtagatcatcacagttttggttcaggcatctgcctctatacccaactgttcgcatttcacaagaagaacactgtgtaacccactcagcggaactcccaagctgaactcactcagcaaagcgtatgacatggtgagctctgcaaccactcattgtgaggttgatcattatgatttcatcttccattataatgctgctcacagccacacgccagccaaaataaacagttggggatgtctggacatgatcttttagaattttactccctcggcccataaatttaagcatttcaagcatttagaatttatctgcaaatataaggattccatcaactaccactcatttgattttttttcatgttatttatggccaccctcccaccccaactatccctcattttgttgagggttatttatttttttcttttgtccaattaaaaaaaatcagttgttcttatagaaggatttataggttatttagcaaataataagattaagtcgaaagattactttttactcatttcagttgtcaatttttaaattttgaattgattatattctatttcaagcatatggttggctttggaataaatgatggaaatcacatgaatctatgcagggatgttatattatggtaaaaaaattaaatattagaaattcttatattttataattgatagattaacaaacagtttaattactgtaggaacagagatcccaatagggaccaggatgacgctcctgacgcctcatgctcacctctaggcgatagaaacgtggccaaatggtaagatgccaagctcatttccgaaacataatcattggaattttcaagtcaatgacgtaggcgatgttcacgtttcttgttagatttggtacatgattatttcatttgaactcctgttaattggtcagtaacttagtacatatgcaatcttgtacggacacatagagatgttgatttacctttctttttttcaccttgagataaaatgcatcattgattcattgcatcataacttgctcaattgctgttggttccccctgatcttgcttggagtaaagggacacatttcaacttggattttatttggactgtttattggagacaccttgcttggatatggtgtaaagaaacacatctcaatttggaatttatttggaccgtttattggagacgtgcattcatgcataattacgtcaggagatgcccaattgcccgaataacccatagatttcttttctcaggtataaaaaaataaatcatgattggagctgaaaatggtatatgcaattttttcaatcagcaaaataatagtcgcaagtgaaaatgaaaggacttctgcaatgataaaataaaaaatcaagggtaaaaccggagcacgtttcttcttctcctttttttttttggtgtctctgtgtacgtggtcaaggagagtgggtaaccaacaaatcaacctacaatttctggaaccgtcaatgacggagatgacaattaacataatatttgaggcaatcacgatacaatgctaaaacaactaaacaagtgtccaattcagactttgctttcacggaaacgattcctttattaaattgtgttttgatggtgatctgaaataaaaattcatacaacagaaatacgctactgctgaaaaaagaatatttctgatgtaatgacaactgacaacagcaaaacatatagatgtttttttctgttttttgaaacgaacatatagatgtttttgcgacgtaagagtacttcatatgaaatagtagcatttactgaaagcatattatgcatataagggaataattagtgtcaataattttagatgatgagatcattatcttatactactagcaattgttggtataatcattattatcttgcactagcaactattgatataacatcattcaataaagtactacagtgccaattctcaggtcaaatcattcactcttgcttttgatattggcttctgctagggaaagaatgaaagatgaccaatcaaaatgcattccctgtcctaacttagaatagtgcccctcccagatgatccattgcaccacaattcacaatcagaatagcatgtaaagctataaagcttcagatgctagcttcccagtctctttcctgtttctagaaaaaaagaagttttattcttccaaattttaatatcag

SEQ ID NO: 78160 - DNA, 25061 bp, Oryza sativa
  unsure (1)..(25061): unsure at all n locations
agagagtggcccacggccccccccacgaggtagagaaaagggacaagcacgcccgccatccgaactaatattgtcaccacccccaccgcaagaaatatagaggaataaagccagcggagcagacaaagaccaatttccccaccaccctcccaggggacgggtcaaaataaccacaaagacgcccaaccttatccatggcgcctacaaaaaagaaagaatccctataaactgacccgaggagtcagccgcgcccgtgacttaataaggaataccgtagagagtaagagtaaaatgaagagacggcccctggtggagaaaatgacccggcaagccgcggccgacatcgtcgaaatgtgccacctcgccggcggaaatgttgtagacaggccaaagccagaaaaagggacgcacgcaagccaactgcgctgggccgcggaagatgtaaaaaactgacagccctcgcctgtgtaccagtaaggggggcattaaatgagaacaacagtagggttcagctgcctatcgagacgacggtagatgataaggcggcagacgcgtacgtgcnccatgggtgggggactaggaagaggtgaaaaaacgtcggaatcgatagggaacggtttgtttgaatttgtgcgaaaaatgtccgaaatcataggaaatcgcgtttgactctgcacgaaggatgtgggaatttaaattagatggacgaattttcttcttaaaagtttgacgtatgtgattataatataatcgtgatataattacactataactaaaactaacatgtaattataatataacatgtataaactttcaaaattgctctgtatcatactattttcgtgaaatataggtcgtgggatcgaatcctctcgattacatatgcgtgcactgtgatttttttccttcccacttatacgaatcttgaaacaaatataacatttcaaaattatataaaatttacatataagttacattatagttatatgcaggttacaatataattacactataattatatttgtcaatttttagaagaaagattgtctataaatatatagcaaaattgcagattaaattgtctcacttgctttgtaaactattactttttttccttgaaacagggcagacagaaacggtatacctcaaaacaattatgatatcggaatgttgcaaaaagacatattattaagaggggaaacacggcaatttcgaatgttgaaaaaataaataagaaacatagcaatattgactagaagtagtaaatcatgtcatgtgtgaaaacttgaaacacggcaaagtgttagaagttgataaaatataattatgatatgaaaatgatgatagaaacgatattttatcctgagccccgaaacacaaatatcccggctagattaagaactggtactaaaaatactttaatacatgttctaaaagtccaagtctttagaaatatcttcaatcctggttgatattagtaaccggtacttaaaaattggtaacatcaatcaaaactcatgatctttactcctagttggagatgcatttttagtaccggttggtaacaccgacgacccatactaaagatatttttaagtactggttgatgttatcaaccattattaaagatgcctttaggattagttaaaaagaaagcatttctattcaagtcagatatgtttagtatgtgagatggacagatggtaaagcgcgtgagagctgagatgagagatcttaagtatgaatctcatatcccacatattttttagacttagtatacatcttttgactttagtaccagttaagatcgagatctttagtcttgatttactaaagagaggttttgaccggtattcgtttcttccctagtggacttatgtcgagccttcagatacttcgctgcttatagcccctaccatcaaaccgctcgtcacatagcgactctattttttgtttcatactagtaatcgtgcacgtgcaatgcacgttatgttaaaattattggtccaattctattaataattgaaaaacaataaatttattctaaaccactgatgttaacacgaaacttaagtgacaaataagtaagagccatatgtggtcccttttgttatccactgccatttcaaacaaaataaataaaaatactaaagtttcacttctcactacatttataacaaagttttacatgtgccatcacaagttaaacttttgcaactaatttggtctaaaataagcaactataggaccatactctcaccgtaacaatatgcaacctggagattaaaaacaataatccaattaagttgatcaacatgtcagactgtcacttatgtccagggatgaatacctcaatactatacaatcaatcaccccccgttttgcatctgatataaggataagcaaaacattatggccttgatcggcagcgatggctgctgccgcagctgccctataaggtgtaaataccatgtgaaagaagacatgcgtagcactctcatgtcacttggccatataaagttttcaactccacaattatataccctcctctcctcaacatacctgagcactgcagaggtgcacatgaatccatttagattatatatagagaaacaaaccctcttctaatcaagcgattttgaagagaaaatgtataatatatgcatacattccttcaatgtccaaactgaaaattaagaatcaacggtatcagccatagtgtcagccatggaaaagaactgagttagatcacaatatcttactgacgaaactaaatatattgaagccaattttctatcaaccactgagtgcatgcacaattgaattgtttatatattcatataatacaaaattgtaaagtgccagcccgaagaagtacatctcgacgtgtcagacacctatgtttaactgcatgtccatgcatgaaagtcaagaaactgcagtagaaagtgatgtttctaccctcacggagtgacagtaaaatcaaatgcaaatgttacaagtataataccaaaataaatactgatctgttcattttgaaagcaacaaactattagactgaagcacatgtattcacggtaagaaaaaaactaatgactaagaggtcaacttggttcacaggagaaaaaaatatgcttagagctctgactgagacacgaaggagtacctaaaaaatatgcatcatgagcttaggacttagagcctcctttgcttctttggttcgtcctaactactgaagccaacacatggatgtcagtcatgtcactgcattcacattgccatctaccaactcccaagaaactttcttcattctcatccaccaaggaatcaacctataggagcagaacctcttatgtcacctgaaaagaaaaatggaacgttcaagagtcaattattcaagctactactgatcaagggatcgcaaccggcgagcatgtatatccatctgaaccatgttgcagtgtttttgttatacataatgtaactgcagaacacatgcaagaatatgaccccaatgatccataattgtatcttcttggctgttccactgaacaatactgaattcatccataattatatcttcttggctgttccactgaacaatactgaattcattatatggaagtcctgaaaaaaagaaggaaacatgatgattggatctcttgagaaaatgacagtatgatttatgctcataacaggcatcatctatgaaaaatatataatttagcatagtcgtgacacaacgcagcatgaattctaattgcgccggacctcattcttagtaacatataaattaagcagaaaatcactggacaatgggccataccttatcaccagaagtcatacctcggtaaaacaaatatcattatgttgagacttgagacgatcatcacccaaggaattaacatttatcattttgcacagctgtaaactaaatcctagcaatatcttagcaggcattctgatataggaggctcaacaggacttgggccaaacctctgtcgccaatgttgttgtccatgcagccatccccaccctctcccctcctcaactgctcccctctccggtgtcatcatcgaggccaagactggcggtggtgctggtggctagatctggaccctccgcctttgcatggcttggtccgatgcctcagattcagtgctgccgtggccggttagggaggaagaagagagctcacatcaaaggcacataagggaggaggaggagaggatatatcagcaccagcagcagcaggaggatgtgatggatctgcgatgcgggtgaggaggcctcgatgtgagatgcgggtgaggagacctcgatgtgcgatgcgggcgaggaagcgattgaggggagcgatctcgcccccgcccctcgatgtgcgatgcgggtgaggaggcaattgagggatggctcccgttgatgtgagctgcacatcaattgcagggagagaaacaggcgtggatagcgcagcggatatcgtaggacatggatggcgcacgacggcggagtcgatgaaggcgcgtgttaggttggtggggatgggggatgggagggacacagctgtccacttttatctttagccgttggatgaatcttagatttaacctatggatttcacccgttggatttgatttggcctgttggattgtaaggagtgaactcctcctttttatattagtatagatgttggattttctttcactctgcgtatctctttcctaaccaacgtccagaccaattccaatggatctcttcccatgttctgtcttctagcaccccatgcctccaatagtacaatgccacctctctgcaccaccacaaactgagcagtaatagcacactaaacattgagatgttgtgtgttactccttagcagcatatagctaaaaattcatccgaccatctattaacatcctgacatctgttaacatcctgatcaagagggtccctacttaaatcgtgcaacttttttaagcaactttcgtatagaaactttttgcaaaaaatgcaccgtttagtagtttaaaaagcgtgcgcgcagaaaatgagcgaatgaggttgggaaccaggatgttatgccttgtctaatgtggtgcaccaactgttgcgtttgtccatcgcatttattatatattctcgttgcattaatgtgacaaaatagcctataactaaaggtcttgtttttttcattatcatggtgaaaacattgagtccctataggtgggcccagtgtgtagtcccataaaaaggctatatcggcaaacaaaccggcttggagctcgaagggtagacgatgaactaatgattgtaaacagtactttatatctcctggtcagtaaaccctaaagaaaaaaatgatttatcgggaaagaattttcaaatcaagacaaacatcagtaaaccctaaagaaaaaactttgatatcattccaaatcccttgaatccagtattcaaattttgtagtaacatttaaaacatgtctccatcattgatgaattttcataaattttagaaaactagctaattaatgaaaattgagtttgcaacagttgtgtcctctgcacatgatatgcctcctaacaaatagtaaaacaaatattatgagcattcaaatctctaaatgggaaaatgagtcagcttagctccttttgtgaataacaagcctctgccatatgcccagccatgatgtggtccgtacacttgcattcggcagtgcgcaaagagagaaaaactaactcgttttagtgttttacatacgcacgtttcccaaaatattaaacggagattttttttattcaaaagttctatagaaaagttattttaaaaatcatattactatatttttcaagtttaaaagaattaatacttaattaatcatacactaatggttcatcttgtttttcgtatcttctcaatattttcattcctctcctctcaaattaatataatttaattaattcttgtatcaggaggatgagttcaaatgcccaccatagtttaaagctttatgtgtgcatctttttcttcttattccacttcttctctgaccttggtatctcaaatgtagactttagagtcatactcctacctattaccaagtgaatttaatattgtgatacccactgaaagtttcatcaaagaagtggtgggtgagtgaaagggacctggacacggactccatcaattcactgaaacgcaacaaaaatcaggacatgcttcctaattccaagccattgtccatttgtccacagtgatccaactaaacctggagactttggagtaaaaacctgcaagaatgtgtgctaccacactacagtacaactactgcttgcattgcacccagcaggttcaaacatagtccatgacctatgttttgcttttcttttattttgttgggaaaaatgtacttttcatccgttaactcttgatttggtataattttgcctcttaactacaaaaccaaaaccaatatagtcatctactctcaaaatcagcaaaacatgacccttgattgcatttggcaatggtttttgaaccatgtatgtaggtgttgaggtcttcttatatcaaagaggaatgagcactagagaataaaaagtaggcccacatgatcataaaagatgacttaggactcatttgaaacacatgattgagagcacaagaatattagaaatacatgcatgattttgaaagaggtgaaagtgtaaaacagatgattatataaataaatggccaaccgtttggttagccacatgaaatatttcacgatgttgtttgatctcattgaaatttcctccaaaatttgtatggattgaaacatccaatagggttctatgttgttcaatcctatgttcaaagtgtgtcatttaggggagggggattcctataggatcgaaatcctataaactactttgtttttacttcagatcaaagtaggtcttagataattgtggggtcttgatgaggcacagctatttggccttagagaattgtgggccattgatgaggcactgctaccctctatgacaagaagggtctcacctattttagttaaaactactctcaaatatatcaaagtggttgttttacctagtttagataaatgaggaacgaattttaccaaactacaattaaaagaaaaagactaaatcaatcaagaatttagggaagagaaaaaagacttttactttctttttcagatagtgttataggataaatgaattcatacatgcacttgttcacattccagtcacatatactaacaggcaacccatgtttttcaacgggcattattggtggtaatttatataaatattaaaaattggaaagcatgataacatgttggttattaatttttgaatcatccctacttaagttattaatttcaaattttcaattaaattagtaaaatactaaattgagagtttaattatgatggttataacttcgtatttattaattttgaatgttggaactattagcttttgaaaaactaaaactaagggaaaaataatttcttaaattccatgtttctttagcatgaactcccaacacaatctatggtcgtaataataatatgatcctatgatggtgcatatctacttcataactttgtatttattaattttgaatgttggaattaataattttggaaaactaaaactaaaaagagaaaaatatatatatttgacatggacttccaacacgttctactgtcatattaatattactatgatccatatgattaacatgggagctccttcaaagtgccacaacacgatagatccataaggtgtagataagatacatttagcttaaaattaaataagcatatatatacacacatccattgcaacttgcttgagtatcaatccgttcagcaaaatattaccacaacatgcacgaacaggggagacaaaaccacaccacacgcaatggttcctacggtccagaacagtttgcagcttcagcaagttactgtctgtgtaaacacttatccccagcttcactctgcttcagcaacagacagacaaatggctccggtccaacacacagttggagccatcagtttgttgcattgtgtatgcggttaataagttaatcctggttgagtgcaagcttatgtgtaactaaagttgaaaatcatggattcatctttatatgagcttgtaattatcagtggatggcaccagattctcaagtgtacttgtcactagacttttggagctttcatgctagcagcacgaaaccgtctcccattagcagcctttttcccaggaggattagcacagagccactgaccactttgagaacttttaagatagtagaagtaactttcggtcttaaacttttggagtatcatgcatacttcctatatatcatctttgttgtgtcagctttgatcacaattctttttctaaataatttggtgatgacaagtaaaatttgcaatgttagatttgccatgcaaaacacttcaaaacttaattaaatattgagctgtgcgttcattaattactaagtactaaccaaaatgtcagtaaaataaggttgtatgtttttccccggaccgtcgtgggactgtcccaagagaaattctcttggagcaagtttaatagtatagccaactaatagctgtcattctctattttgcggagaatctttgcagtgaaaactctattagggtttatctagatttgataatatcatcatttatttgtcaatttttttgttgaaagtgttgtcttagagttgtctcggttgaaagtggtgaaaatccgccactgattgtgattgatttggttggatcggtttatatcggcgaacacaaacgtcatcttgaacattgtgtttgatcatgagagcaaattgctgcatgttgcattagttttttttttatgtgtgcatccttggttgagtgatcatagacttactcctatgtatttcattaattaatgaaatgtcctatccttgattttttttcttcttcttgcaattataggatgcatggatcagtttctgaagagtgcatacttgtcaatggacttctccatcatgcatgcggcccaaaaccaacttgcattagcagacttttatctctgaccgatatgattagctgagtatcatcagacgaaggagcaaaacgttgtacttttcctcgatgctctctttctacttgaacctgcagtttgttgtacttgtctgtactgattcactgaaggacagtgaagttcagaagcatcagcaagctagtagcaagcaggcaaaaattgactcgagacgatatgatgctgaggtggcggctaactaaagctgaaaattctactacatatgaccgtacgtgttggcaacagtgacttgcgaaatcaaggctaaaattgtaagtttggttgaaattggaacgatgtgatgaaaaaattgaaagtttatgtgtgtaggaaagttttgatgtgatagaaaagttgaaagtttgaaaaaaaagtttaaaactaaactcggcccaagttgaactccaatccatcagttaatcttctacgggagcagatgaactgctcctgccaaaacacaagaaattgacagcgctgacgatgtaatcgtctgatgcatgatgtatactagctaaaatgatgataagaaatcatcgcaactggtaaatagaaaacgatgatgatgatgataaaaacagagcaatcacaattcacaaacagtagctcttaaacagaggaggttggtcagctcaatttggggtaaaaaacaaacacatggtcaaatattgcttgattgattgcatggctgcgatggtttttcaataaacacacaataaaatttattctgatttttgtttcaataaagttatagtcacttattacataattcgctcaacagagagcatatacaatctagaactcacgatgcaatgactaatgctttccagcactaaaggagacacgttattcaagtctgtttgtgtctattctaatcatggaaaactcaaaacactaactgtaattgtttcaaaaaacactcattataaaaatctacaactaaagcaaaatcatgtcgaccaatcgttcatgttgtacataaaaatatgtgcacaagatttagccaactaaaaatatctcttaaaagaaatttccatccactacgtctattactcacatgatgcacgcagaacaacacaccacaaaaagcatcgatcaccattctcctccttaattactttttaattaggagcagaatgagaaattagattaaatcatgacgactcatggggggtcatggctgccaaaaataaaactaaaaacaaaacagccgctagtagctaagctaagcaagcaaaagaacacaacacgggcggtcaaggtttatactgaagacgattacgcgcacgcgagattgtgggggggggggggggggggtggcttaatcagctcgctcgcgccatccgcgatctgacgattaattctctcttaatctgcgaattaaaagttgccttcaggtcgcagcttaacaaccattgaactgaaccactcgtcttcgctccactgtatactgaactacttgtttttgcagcgatgatgcatgatgagctttcaagtttcaacaccaatgtcgccatcgatcgacgatcgactggccacgacgcgacctaaatgcgatgcaatttgatgaatgcattccatgtcgtgtgagttcgacctcgacttggcggccggcaaattaagcatcctagtcaaaaaaataaaaaaagtaccggccgtacctagtcaagattaaattaaatgatgatggcagaaagaggtaagttaatgatcagtacggaaaatgaaatcttcggcaacatagtcgttgcgttttgggctgtagtagattggtgaagactattctgcatgcagagacttggtactgtttggttcaacgggaaaatttactatttgttaccatgcgctcaagtgttactttctcggattttcattttcatttgtcaccccatcatcaacaaagctttctgtggagattatggataccccatatctacacggcggttatattccagctgggtacatggtaccgaataaagatagaatatcttcatgaggacttgggttagattctaaacttgtatgtcaagaaaatacccggaatcctagtcggttacgattgtattttatctgtaattccatgttcctttgggatatggattgtattttataaagcggatcccttcccctatataaggaggggtccggatgcctctcggggcgcgatttttctcagatcatacaatcaataatacattcggcggaatcatccccggacaggagtagggtattacttcttgaataagaaggcctgaacctgtatttctttgtctccaaacctatccactttccaagcttgatagccacccccttttagtattgctgaaaccttgtttcgacagttggcgcgccaggtagggacagcgtcaagtttttgccgactaagtgcgatgggttctgtctccggcatcgacgacttcgcctttcctcccgggcaggcgttccggttcggcagcctcaacttcatcaccaatgacttcggcaagatctctctccttgactcggattcgaaccagtcggggagagaccaggtccccgcgccgttcggtattccgaactcggccgaggcctactccaagaccatctctcccgagttggtttcaaaccactcggacgagatccaatctactcctcagcgaccagatcaagatgacgggtcctatccctcaatcctgatgagacttcctgatgatttggccgctgtcttcacagccaaagcatctcccactcgaagatctagacaagccccggcttcggccccgatccaatctagatccagggaggttggcgttatactccaacctcttgggacagtctcgacagaagagttggatggctacctcagctcccctggtgtcagttctcgactaatcgaggtcctcgactatgacgacttcggctaccactatgactacggcgacttcgacaactttgacgacagctatgaggataattacacgcctatctttttcggcgtattcatggctgacaacgaaatggaggaacaacgccgagcccgagaagcggaggaagagcgcacacgacaagaaactgaacgtcgccgattggaggaagaacgacagcgacaagagcgagaacgactacagcgtgagcaacaagatcgcgagcgagttgcaaaggaggctgaagatcgacggcagcgcgccttggaatctgggcgacgagcgagagagctcatcgggcaacaagacgtcaatggaacagcggtttttcgcaccccccagcagaactcggttgcagcaatcactctcctcgacaccctcctcaaggaagacgcactcaatcaagctgatcatgttgtcaacatcttgaaccagacgaagaccatgattgctgcctcggttccagccaactccgcaagcacccgcaccctgactggtagccgagtccctcaccttcgatctcaggactatcaccagccaagcctcagcatagccggcgccggatctagtcgcaggagcaggggacatgatgaacgatctgagtcctggctcacagtctatggtctcgtagtccgcgcagcaggaggagacagcaaagccatggcgaattatctacctgtggccctagcagattctgcccggtcatggcttcacgggctaccccgcggcacgatcggatcataggcagagctacgcgaccacttcatcgccaacttccaaggcacttttgaacggcctggtacacagttcgatctctacaacatcgtttagaagtctggagaatcccttcgagattacatccgacgcttcttcgagcaacgcaacaagatctccgacatcaccgacgacgttatcattgccgcctttattaaaggcattcgccacgaggacctagtcggcaagttcggacgcaaacctcccaagacggtcaaacagatgtttgaaaaagccaatgagtatgccaaagccgaagatgctattacggcatccaagcagtcgggcaccacttggaagccaaagaaggatacaccgaccgtaggagggagtggaagtaacaaccacaaggatcgcaagcgtaagcccgaagaacttgtggcaacaacctctccattttccctacaacgttcccgcgtcaacaccttcgacaagataatgaactcccaatgtccgcatcatcccaactccaaccacgtggccaaagattgcttcgtctacaaacagtttgcggagcaatacgtcaagaatgcacgtaagccctcagacggagatcaagtcacatcaaagaagaaagatgatgaaaacgatgccccgactggttttcaagatcatcgcaaagaactcaatcacatcttcggcggacccctggcttatgaatctaagagaaagcagaagctaacagaacgggagatcaatgcggttcagcctaacacgccccaataccttcggtggtcagagatagcaattaagttcgaccgctcggatcatcccgaccgagtggtccacccggggcggttccccctggtactagacccaatggttcgcaatgtcaagctccgaagaactctcatcgatggtggcagtgcactcaacatccttttcgctaagaccctggacgatatgcagattccttgcacggaattaaagccgagtaatgcacccttccacggtgttatcccaggattatcagctacaccactcagccagatcactcttccggttactttcggcactcgggagaattttcgcacaaaaaacgtttgtttcgaagttgctgatttcgagacagcgtaccatgctatactcggatgaccggctctaaccaaattcatggccgtcccacactacacctatatgatgatgaagatgcttggtcctcgaggagtcatatcactatggagcgacatcaagcaagccgtcacatgtaacaaagaaagttgcgagatggcccaaacccgcgagatcactctcgctcgcgaagagatccgactggctgcgaccacggcaagcgaaggagaagtgcctgcgaccaagctgtcaaagaccgaagaaggcgacgacaaaactaagaagattccactagatccctccgatcctaccaaaactgctgtaataggcgctgagttagattgtaaataggaaagcgcgctcatcacctttcttcagaataataaagatatttttgcgtggaaaccatccgatatgcctggtattcccagagaggtgattgagcactctttacatgtcaaggaagacgccaaacccatcaaacaacgactccgccgttttgcacaagataggaaggatgcgatcaaagaggaattaaccaagctgttagtagcaggcttcatcaaagaagtcctccatcccgactggctggctaacctagtactagttcggaagaagaccgggcaatggcgcatgtgtgtcgattacaccgacctcaacaagtcttgccctaaagatcatttcgggttacctcgcattgaccaggtggttgactcaacggctggctgtgagctactcagtttcttggactgctattcgagatatcatcagatccgactaaaaaaatccgactgcttgaagacctcgtttattacaccctttggggcctactgctacatcaccatgccctttggattgaagaacgcaggagcaacctatcaacgcatgattcaaagatgtttttcaactcagatcggccgcaatgttgaagcttatgttgatgatgtagtcgtcaagaccaagcagaaggatgacctgattgcggatttagaagaaacttttgaaagcattcgtgctttcaggatgaaactaaaccctgaaaagtgcatcttcggagtaccgtcagggaagctgctcggatttatggtatctcaaagaggcatacaggccaacccggagaaaatcaacgccatcctcaacatgaaaccgccgagttcccagaaagatgtccaaaagctgactggttgcatggcggcgctcagccggttcgtttcgcgactcggcgaacgggggatgccctttttcaagttgctgaagaaaactgacaatttccagtggggacccgaagcacaaaaagcctttcaagacttcaagaaacttctcactaccccaccagttttggcctcgccacgtccgcaagagccgctattattatatgtgtcggggacctctcaggttgtgagcacggtcctggttgtcgagcgtgaagaggaaggccatattcaaaaagttcaacgaccaatttatttcgttagcgaggttttggccgactccaagacaagatatcctcaggttcatgtcacaccctaaaaattcaaaatatataaattgttgtttaattggaatttttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcataaataatttaaattgaaaaaggttttaaaaagtcttcttttggctttgggccgaaagtcggcccaaaacccttctctctctcctcggctcagtccggcccagtccgccgccgcgcgcgcgcgtccgcccgctgacaggtggggcccacctgtcagggtcgtcgtcaacctccggccgccgccgcccgaaaccctagtttcgcgccgccaccgtttccttccaaaatccggccgctcctttccgtttccggtgaaattgattgaggggaaacaatctttgggatctcctctaccttttcccctttggaagggtcggctaattcgttttggaagttcgtggaatcaagttcgattcggatcggtctctttccttcaaaccccgatctttccttcccgtcgccggccgccgtgggccttcgccgtcgcctcctagcccctttaaaaggttccccgagctcttctctacccgtcgccaccttcgccttcgcctctcgtcgtccgtagtgccctagcgccgtgtagcttcgagccgccgtcgtcgccgccgctccagccgtgcgccgccgtcgtttcagccgtcgccgtcgctcgggaaggtcgccgtcgtgatcgtcaagtcgccgccgttctcgtccgccgcttcgccgccgccgaagaccgccggagcaccgccgtcaccgtcgacccgatctccgccgccgtttcaacctcgtcgccgtcgccgtccgttgctcttccgccgcctttttggtcgccggtggtgacgtcatcgccgacgtcatcgtcgcccttccccgtgagccggtcgtggaccgttcgatctcggccgtccgttttggatcaagtcgatctcggccgtccgttcgtgtgaaccgccgccgtgcgcccggtccaccgaaaccctagcccgctgacgcaataaatctccttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctgttttctgtttagattccgtcgtttccggagagtccgttttcgcaggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattctttgttatagcccttttgttcttggttactttattccttgataccttgggttattataacttgactagttgagctttatatattggttcagctagatattagatgtgattgcttatccatacttagaaacattagcacactattgggataacttatgactcactattattttaatgatggcttaatgattgttcacgatggtcaatcgtgactggttaattaattacttgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggagcaccagactgagaagtggccgagataagcccacgggggtcgctggggagtccatgccttgtttataaggggtgattatgatccaggaaaggtgcgctgtagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattagctcctggtttggaatggtatattcctggtttggagatagaactgtgcagccgggatggttgttcagaatggttgggcctatgcaacagggtatgttgtatagcgttgggttaatattgtttaatacttaactgttttattaaattctcaaatgtttgctgaatgctgcttttgcaaaaagatgaaaccctactatgccatcctttgttatcctgtgcacttgcatatttgctgcgtggcttgctgagtatgtcatatactcaccttgcaatcattcatcagaggaagagttctacaatgatgctgatggtgtggaggattaggtgtagccttggtcaagctgcttgtggagtggagccgtctgcgccgtttattttattttccactgcttagatctttattgattgagaggaactatctacctctgtaatgacattttattcgcctattaattagagtaataattgtactctattatcaatttgttattgtgtgcctcggctgattcctggacgagggttcacacacatgtaagcgtttggaattttggatagaaattccgggcgtgacagttcaaaagttattatatggtgtcttaattaccgtcaggaaattatctcactattttcaaagtcactcggtcacggtggtcacgtcgtttccactcggggatatacttcataaccgcgaagcaaacggacggattgcgaagtgggccttagaattgatgcctttggacatatctttcaagccacgaacttcgatcaagtcacaagctttagctgatttcctcgccgagtggaccgagtgccaagaagatatgccagaggagaagatggaatattggactatgcattttgatgggtcaaagaggcttacgggtgctggagctggggttgtcctaatttccccgactggagaaagattgagctacgtattgtggatacatttttctacgtcccataacgtggcggaatacgaggcgctgctccatggattaaggattgccatctctttaggcattcgccgactaatcgtccgaggagactcttagttggttgttaatcaagtcatgaaagaatggtcctgtcaagatgataatatgaccgcttatcgacaagaggtacgcaagttggaagataaattcgatggacttgagctcacccatgtccttcgacacaataatgaggcagcagacagattggccaattttggttcaaaacgggaagcagtcccttctgatgtgttcgttgagcatctttatgaaccaaccgtgcccagaaaagaaaaaattgaagccatgaatactcaaggtgtaagcatgattgaagcagactggagagaacctctcataagatttttaaccaaacaagaactccctcaagacaaaaatgaagccgagcatatttccaggcgcagcagactctgtcattcacgagaccgagttgtacaagaaaagtccatcaggaatcctgcaacgctgcgtatctttggaagagggaagacaattgctaaaagacatccattcaggcatctgtggtaaccacactgctgcacgaaccattgttggcaaggcttatcggcagggttttttctggcccacagctgtttccgacgccgacaaaattgtgcgaacatgtgagggttgtcaattctttgcccgacaaactcacttgccagctcaggagttgcaaaccatcccgttgtcttggccattcgcggttttggggcttgatatggtcggtccattcaaaaaggcagtcaggggttatactcatctctttgtagctgtggaaaagttttccaagtggattgaagccaaaccggtcgtcacaatcaccgcagacaaagctagagatttcttccccaatattgtacatctgtttagagtaccgaatcgtatcattactgataatggcactcaatttacgggcggaatatttaaagatttttgtgaagactttggcattaaaatttgttacgcctctgtggcacatcccatgagtaacggacaagtcgagcgcgccaatggcatggtacttcaagggatcaaagcacgagttttcgaccgactgcgtccctatgctggcaagtgggtagaacagctgccgtctgtactttggtctttacgcaccacccctagtcgggctactggccagtcgctgttcttcttggtttatggcggagaagctatgctaccaagtgaggcagagtttgaatccctccgatttcgtaacttccgggaggagcgatatgaagaagatcgagtggatgatatcaaccgactggaagaagcccgtgaagtagccctaatccagtcggctcggtatttacaagggttacgccgttatcataatcggaatgttcgatcgcgagcctttttagtcggcgacctggttctgaggagaattcaaactacacaggatcggtataagttatctcccttgtgggaaggaccgttcataatcgctgaagttactcggccaggttcttaccgactcaagcgtgaagatggtactcttgtcaacaattcttggaatattgaacaccttcgtcgattttatgcttaggcatttcgtttgtatctttcctctttgactgctaacttcaagtttttccttgaagttttcagtcagggggctactataataataatggaacatgatttttatcaattcaatttgcttacttgatttatcattgccctgcttgattttttgacttagacaataaggactgaaagttttttaataacttttgcgagttttaggctcaataaggtttgacaaaagcttttaagaaatcagaggctaagtttgaaatatctagcatagcataaattcatcagtattgtacaaattgatcttccatcatcatcagaatcactgttactaatcagtgtcagttttttcatcgtcggaattatcagacccagtcgaccgaaggtcgacatcttggaatctctcaactacgtcagcagcaatcttgtcagcggctttttgtgcatcattgatgaggttgagggctgtttcttcgcttgtcccgtctgcaaacccatcaacgacgtcaatatcgattttggggtataaagatttggtcatagctaatgccatacttgctcccatacttccagcctccctgatattcttgaagtaagtatccggagcgactctcagtttgtcgaagatcttggaagtgtcaagtgtactcggaccggcgttattgaagaacatggcttggatgagcggggtagcggcattaacgactttatccctggccccttcaagcctattgatcttgttgactaagacatcaaactgtgcctgggacttgattttgcgatctgcacgaatagattcgtatcaaaagtggctataagaacatggggaatcagttatcattaccttcaacatcttttaaggccaagtccctctgctttgctagttcggccttgtccttctccagagcctcgacctgcttctctaggtcggaaatcctggcggcttgcactgtaatgcttttcggttaatcgatatgacaaggaaggcttcacgaatacgtcagacatatatggcatttacctttggatgaaccacttaattcatagttagattcttgaagctcggagattctattcctcagatcatgctcagttttcctcgcgagctctctaacctcatatagctggcttctggtagcttcaagagttccaagatgagggactaatttctcaagagttgcggtcttcgcctcattcctgagatggattctctgcaatacgaatttactggcgtttcagcaagacatgaaaggggacaattaaagccatgcatgaatggacttacatttacaatgcgagtagcctcgctgagtgcctttttcagcaagcatacttcctcatcttctttttgtttgtttattacgattccttgaggttgcctatcatcgtcccaccacttgactaggatgggagggcacgagtcttcagctgcttgtatacggggaatttcttcttcatcaccagtcattggtcctaatgtatccattgacaaaggttagacaattgatcagagtcatttggatcaacacggtttcaggcaaggtgtttacctgtgaggatttctggacggggacgagttgactcttgcgccttaacgggggaccctggcatcgggtcgttgctggcgtcttgtctacgagggctgtctgcccgagctccaacttctggaatctcttggcttggcctagtgtccgactggttttcagtcgggggctcctgattaattccggctccagcttcggccgactcgtttcgagtcgggggttgatcaccagatcctacattatcggttgctggctggttgtcactcggctgatcctcggcagttggcttggtttcttttaagttcatttccctgctggtcaggttagagtcttttccagaaggatctatatcagatggtttcctgcaagtttgattatcagtattatttccgcactaggtgcgcatcaatgcaagggagatcgttatatgatttgtacctagaagacttcctgatctttggcacagggcgactggatgttttcttccttggagtagcctgcttcggcagtttcttggttgcctctcggtctccaggctttctagcagtatcgctttcgtcgtcacttgacaccaacttccttttgcgtgaatatggctggccggctggattggaggtatttggccagtcttcagaacggatcttgggacccccgctcccttgactggtttggtggtggggtgatcggcgttgaacgactgggggatccgacttcatcaaagcaaattcctgggcataatatccttcattgttaattgattcaacaaaaagacaagactatattttgtgaaaggttggaatgtttgattacataccagtggaggaggattgaaaacattgaatggcacgactggcagcaagtgcgaatagctgacgacgatagcattcgagaagatcttgtacatcctctccttcataaccttaaagttaagagagtctggatcttcacgatttggatcatgtttgccgtcaaactcaaaagctgtgcgggacctctctttgattagctagccggctttttatgaagtgccgagtgatctgttctccttgcaaaccttgctctttcagctttatcatgcgctccatcagttccactacttgggccgcctcatctcctgtaggcaatgaattccatgtatcttggtagaccggagggagacaagagtactcgggaagggctgattcaggattttgaacatagaaccagttggcgtgccagcctttgtttaaggtcttgaagggcatggagaaatatttttggcttagtgttcccctgagttggaagccagcgcccccaacaacgcacggtctgctcttgtttggctggggtttaaggaagaagatgcggcggaacaaggcgaaatgaggcctaatgcctagaaaagcttcgcaggcgtgaataaaattggcgatgtgcactaaggagtttggattcagatgatgcaagctgattccatagaagttcagaattccccggaaaaatcttgaagtgggaagagaaaacccgccatagaaaaagtgagaaaataccacgacctcgtgtgtatcgggggtcgggaatgcctcaccaaatgccagccgccacccgatgatctccttcgttggaagaacgccgtgcgccaccatctcttttagattttcctctgtcacatcggagggcgcccactggctctcgaaactttccctctcctccgccatggatgtgagctgaatggtttgatttgaaccgaggtatagctcgaggggaatggggaatcggagcggtggatgcgcggagaagtttcgtgggattttgggaatggattgaagcggattgatgaactctagcttcgtcggcgcggttatgtactgtagcaaggagtggggaaatggtgaaagtcttggcggggaagacgaagtgacgcttagacttcggagtttttagggtatcgggagtactaatgggcttgggcctgtatagtactttggcccaatattacaatcagcgtggcccgttgtgatccctagggatttaggcactttttgctttggcaatttgtgctcacaatgatgtggcccgatgctgttaaaatcctttttaacgcggttcaataattctttggaattattatgatgaaataaaaaggtgcccggcagaaaggtgttatgccagttttgtaagctttattaggctgcaaaagctgtttgggtagatttgagatgactagtttgctaatagtcattctcttagcatgttatatgcttattttggttgtggtgagggtcatagcctaggctattagactcgttgattaccatgactttttatcatatttggtggagtgtctttggagtttttactcggattcctgtcaaataagtctgtttgagggccttttgagcgtttatcacacgggtcttcttatattttttctcgatatattaaagctaagaagcagtcggctgggagttttactgtttaccacgagtgctttgttgtataatgtttggttgtaaaaccactcggttcttgactttatgtttagttttttaactaaccacatagtcgggggctacacctaattaggtgcatctactcgatgcaccatgttttattttcgcccttcacagtctttggttccagtactcggcaggctgaagcaggaagagttgaagtactcggattattgttttttgttttgagatggctatttcgtcgactgcaaaggtctcgggggctactgtggagattatggataccccatatctacatggcggttatattccagctgggtacatggtaccgaataaagatagaatatcttcatgaggacttgggttagattctaaacttgtatgtcaagaaaatacccgggatcctagtcggttacgattgtattttatctgtaattccatgttcctttgggatatggactgtattttgtaaagcggaccccttcccctatataaggaggggtccggatgcctctcggggcgtgatttttcccagatcatacaatcaataatacattcggcggaatcatccccggacaggagtagggtattacttcttgaataagaaggcctgaacctgtatnnnnttctttgtctccnnnccctccncctcttccngcttnntngctgntggnctnagatgcatctgttcaatcaaaanacacgggggggnngggggnggttatgnagatacanttgcactagttcgacnctttcagataccggccgaaagagncnggagngaaaatgacgcgtcttacaggttagtctaactccagtcg

SEQ ID NO: 78161 - DNA, 6135 bp, Oryza sativa
  unsure (1)..(6135): unsure at all n locations
cgcgcgactgactgcacatcgccatgtgcncatcacaaattccagcacaaagagagggagagacgacatgcgagatggaggtcaaacgcggacgcgtccttttcggcggcgaccaccgctggccacgccatactagagctacgcgtagaggcgggaagagacgagggcgagggctatgcagaggcaagggagagctctccacctcgcactaccatcctgtgacgctagtggccacctcccttcacgcagcggagctgtaatacccccgagttttaaattaatatatctcgcggaatattagagcaaacgcgcaaaagttcaacttttaaaccattgttcgtatagacgatcgggaaccgtggatgcgtagagctcgccgagtagtgcaaaatagactataaatttatagtaatcggagtccgaacgaagtcccgaggattgaatagatgtgagccgttagatcttatttagtctctttatataaccaaccaaaaaaaacaaacgaaaaaaaaaagaaacaggagcgattctcctgtagccctagccgccgcacctcctgcgctctgccgccgccgctgctgttcctctcttcgccggcgccgccgctggtgcagccgtcgccggtcgccacagccttcgtcgtccgcagccggtcgttggtgagctactgttgtttctgttaatttccctgctgctgccgaaccctgctgttgccgatctgatctcttccttgctggtggtgcacggcttgctgttgctgccgatattcgtttctgctgctgctggcctgcaatgaacaggaaggagggagagaaggcagagaagaacaggaaggaaggaaagaaggggaaatttgatagaagaagggaaatttggggaatttggtgaatatttccaaattcttcatttttcttatacattagtactgctaggtaatccgttttagtctatagttgtttctaatttatatttaagacgatctgtttccggttttttcgaatttattttatatcgaacgctaggctgaaaccgtattttcaaatctggtattaaaccatcaggaatcaggttagttgtcctaaataaagtttgtagtcattgtcaatatctttccaacggtgctagtttcactcgattccgataaacggtttaggagaaacagcaaaaacagtactgctgaccgggtccggaaatcaggacagcagttcgtttttccttaatctggaattttcagagtcataatctgattttgtgctcaacatgaaagttgtagacaattttgtctagatgtccaaagttgtattatttgctagtttccattagacggtttgtgagttactcataaaacagtaatggaacagctataggttatttaatacaaatcgataaaaggtttatatgttctaggtttcgattttagtaaatatcccttgtaaccatcgttagttgaatatagtggtttatgcgtagttttgctccacaggtgtggagggttccaacgttggaggagttgagtcggagtatcgaatgagttaaggcaagtacaagacggacttatgtgatggacaaaactgagttgttttgtttggctttacttgcataattattattcaattgcttgttattactgattgtatggctatgacgttatgctacttattcgtgttttgacccatattcaaattcatgacgttattcatgtttcattattccggatgttctgtttacattatttaagaaccatgcgtagccatgggagtgcaatttggatctttattcatgatccttgagaagcgctgatcacgcttgctcggcttaccggtaatgctaagaggatattcacacctgcccgggagggaactactatcttttgacttctttggtttaaaaataaagtaaatccaacccttcatgttggtttcttaatgcataaaacatgcgtatgttttactagttcaagattgtatttgctgagtattctttactcactcttgtgtttaatttggtttttaggtacctaatgacatcgatcggcatggggcgggagtagcacccttggactacacattattattgcacacaattgaaattagttttagactatgatttttgctcagcataagttttgcatagaacttgtaaaggtcatttaaggttctgatccttatttttcacgtgggatttgtggagctaggatggtttggattgtgtggtttatatcggtattgacctttcttataactgtctgtcgtgatgtccgtatttttaggggagactctaccaaaatttctaataattttaggacttagtttttgagtgtattttggtgtggcattctatgtacgtggttacctggggtattacagttggtatcagagcgggcggtaggtccatgggaagtgactgggtaatgagatatataaatcaacataaaattttgaactagagttcctaaccaattaaaaaaaatactttctcttagggtaggaaataataagagtagaacttgggttatatataaacatctaaaagaacttgacacactggtgcacaataggaatgggagcatgggtcattcctagcatttatgtttctgctgcatatatatgtgtatgattgtgtttccttgcatgccattgtctaacctattgttaaactaataacgtgtaaatgcttgtgtttgatatagctatgccgcctagagtgagtgtttggttggctaacagaggccgcgggagaggcggaggtagaggtcgtggtaggggccactataatgaagaagttgaaaatactcaggataatgaagaggttgggaacaactcggttgctgaatcccctattcctaatcgtggaggtcgtggtaggggccgtgctggaggccgtggaagaggttgtggtagaggtcgccataatgaggcagcatcctcgaaccagaaggaggatgagcacatggaagaggagggtggtagccattcagctgctgtctctgatgatgctcctcgagctgctcgggggatgacactcactagatggacatccatgcgcttagacacatttgatgggtctggtactcccgttaatgctgcagactggttacgcaagatggagaagtatatgaggggatctagaatgactcctgaggagaaggttactttcatgccttttcagttgactggtcaggcggacatttggtgggatggagttgttgaagcgtggaaccctgatcgtggtgctattacttgggaagtttttcttcagcagttcagagctaagtattatccagaatcatttagggacaagatgagtgatgagttaaacaatatccaacagggaagcaagactgttgatgagtatgaacgggagttcagcagtattgtacgctttgtgcctagcgtggcaaatgatgagcgtgagaaggctaggaagttctttcgagggctcaatgctcggtatagagaagtgatgggaagaaacccgcctactatatacctcaatgcagttgaggaggctcaagggatggaggttgagctccaaattactactgcgcagaagaatcgttttggcaatgtcactggtaatgagcagaagagagctcatcaggaagggggtgagaactcgcagcgaccacctttcaagaagtacaaacaaaatcaggtcactcaaccatcatctaaacctagccagtggggttctcagcctaatgcagcttcacgtccaacggagtcttagttgattcgccctgtgccaaggcaagggctaatttgctttaagtgtggaaagaatcaccattcagcagagtgtgggtttactggggcatgtcgtgggtgtggcaaagctggacacatggagttggtatgtaagcgtaacccaaattctatcatcaagtggcaaaagccgagctcctattcagcaacctcttcaacagctagctatcctcgaggtttaggttcatccactagtactccccgtggtgccgtttagatgatgacaacttatccacttccttaccagcagttcacacataattacccaccaccaccattaccaggacagtattggcccatgcctcaatcttttgctccacgtgctccactccagttgcctgcaccgcctatggcgcatccttctgcttcagctccacctcaccagcaggtctcagcctctactaccccagctatagctggagtctacaacatgcctgcagcttcatcccttggtcgcccggatgtcgttacaggtacacttttagttgattcgcatgatgccctagttctgtttgattctggtgctacattttcctttgtttcaatcgagtttgcgaaaagagctaatctatttagtcaagaggtctctcgatctgtccaagtcagctctccagggggtataatctctagttcagtagtatgtctaggttgtgcaatctctattgatggggaggaatttgtggcaaatctaattgtgattcccttaccgctctttgatgtgatcttgggcatggattggttgaaccgatatcgtgctgtaatctcttgtttctggaagactattaccttggaagctccatcaggcgaggagatggttttccaagggagcgcgcctccgcattctcttttcgtgatgtcaaggttatttcctgggcagcgtgctgtaaagacggggttattatgggccttagccgagaagtcatccaagcctttagtgattgaagatgttcctgtagtgcgagattatcctgatgtttttcccgcagaattgccagggatgccacctgagcgtgatgtagagttccgtattgatcttgttcctggtacacaacctatctccagagccccgtaccggttagctcgtcctttccaagaagagttgaagaaacaattagatgatctattatctaagaagttaatccgacggagtgtgtcgccatggggcgcacctgttatttttactgagaagaaggatggaagttggcgtatgtgtgtggactatcgggccttaaatgctgcgacaatcaagaacaagtacccattgcctcgtattgaagatttgtttgatcagttaaagggagcgaaggtgttctctaaaattgacttgaaatctggttataaccaaattcgagtgcgagaagaggatattgagaagactgcattttccacgaggtatgggcattatgagtatagagtaatgtcctttgggctgaccaatgctccggcctattttatggaggcgatgaatagcatgttgcatagttttctagataatttcgtggtggtgtttattgatgatattctgatttactccaaagatgtagaggagcatgagcgtcatctgaggatggtactagggaccctacgagaaaacaagttctatgctaaactgaagaagtgtgagttctggcttcctgaagtggctttcctagggcatgtaattaatcagcaaggtatctcggttgatccaagcaaagttttaagtgttgtcggatgggaaaggccgactaatgttaaggatgtgaggagttttttgggtatggcggggtactaccgacgctttgtgaaggatttctcgattatcgctaaacctatgacgatgctcacacataaggatgtgaagtttcagtggacggaccaatgcgagtgtagtttccaacaattgaagcagaggctggtaactgctccggtgcttactttgccccaacctggtaaacgtttcactgtctattccgatgcttcacgagtaggccttggttgtgttcttatgcaagagggcaatgttatagcttatgcatctaggcagttaaagaagcatgagcagaattaccccactcatgatcttgagcttacagcagtggtctttgctctcaaaatttggaggcactacctgtatggagaatcttgtgatattttccctgatcataagagtctgaaatatatcttcactcagaaggatttgaacttaaggcagaggaggtggctagagttgattaaagactatgatcttaacattcaatacacaccgggtaaggcgaatgtggttgcagatgctctaagccgtaaggtcgtttctccaactgtgagttgtttgataactgattttgaacgnatgnatgntnngctaaaggcgagtgcngacgtgtccgct

SEQ ID NO: 78162 - DNA, 3820 bp, Oryza sativa
  unsure (1)..(3820): unsure at all n locations
attgataatcgatttacagnagtncatcatatttaagaaccatgcgtagccatgggagtgcaatttggatctttattcatgatccttgagaagcgctgatcacgcttgctcggcttaccggtaatgctaagaggatattcacacctgcccgggagggaactactatcttttgacttctttggtttaaaaataaagtaaatccaacccttcatgttggtttcttaatgcataaatcatgcgtatgttttactagttcaagattgtacttgctgagtattctttactcactcttgtgtttaatttggtttttaggtacctaatgacatcgatcggcatggggcgggagtagcacccttggactacacattattattgcatacaattaaaattagttttagactataatttttgctcagcataagttttgcatagaacttgtaaaggtcatttaaggttctgatccttatttttcacgtgggatttgtggagttaggatggtttggattgtgtggtttatatcagtattgacctttcttataactgcctgtcgtgatgtccgtatttttaggggagactctgccgaaatttctaataattttaggacttagttttttagtgtattttggtgtggcattctaggtacgtggttacttggggtgttacaggagcggaggtggatgggaacaagggagatgtatgggtgctagctagtctcgttgaccttgtctcagtggctttactgctgcaaagttggagactcgttttcagatccaacgccctgctccacctccatcatttgttgggaccctcagagaggatggaggtggggccgaatggctcgaggtcatataccctgtggcccgggttaactttctggtctgacatgaagatggcagtgccgaagctaggtgaggaggccaccggtgccacaaggaggatggcatgctccaaatgtagatgacacgacctaggtggtggtgatggcctcaagtttgttcgccatcaccaccgctcggccccttcaaggggagacgacgtcgagcgggcctatgccaagatcttgcgcccatttgtgcgaggttcgagcaaggttggggaaagaaagaggggaaaataagagtaggcgttgatatgtggaccttataatttttaaattttttttccttgtcacttacatgtgagcagttagtcctacatctactttttaatacctggatgctgcatcagtcaaatcaccctaaaaaaagcctcgaagagtttgttttgtactggattttaatatttgagaaggcgatatattcggttttgcggtggtgtacaatcatattcggccaatagtccagggagtcaaaatggaccttttagtaaatagtaaattcattaaccgggcctatgcaatgtaaagcggaataagttcatttgaggtcccttaacttgtcaacgaatctgattttcgtccctcaaccagaaaaccagatacaacgggtccttcaactatcaaaaccggtacagattagatccctcggcggttttgactgacgtggcgcctacgtggctaatttgactcagtcttcatctgacgtgacattgatgtagcgtttacgtgacaattctatccagaaaaataataaaactcgtgggatccacacgtcagtttcacacacaaattaataaaaaatggtatcatcctcacccctcctcttcctcctctctccccatctcccctctcttcagaaaagctggtccattcgcgggatgatgggctcccgcgctagcatcacgaaccgcaccatgttcccggagtcgtcctggatgccgtcggcgagcacctggagcccgtacagctcggcggcacgggatgatgcgatggcggcggtggacgagccgccggatattgttctacacctcccgcgccttcttcctcctcatcatcctccagatcccgctcttcatgtcgcccccttctccctcccaatcccctctgatttagctctgtttccgtgtcgatcgtgtggtcaatcttagcaaacgagcaaacaatggttgcctcaaaatagatcctgtatgcatatcactacttgtagctagtaggtttgattatagtgcatatgtgcgtgtgatgagttctcgacgagcaggacggcgcggtcggcgatccagagctccacggcctggaaggcctcctcgaactggtcgcaggggatggtgttgcaggtggtctggcagtgggcgcgggagaacggggtagcgcacggcgggcggacggccgtggatctggggatttgcgcggggcgcggcgctggcgaggtttcaatcctccagaggcgaggtgttcgtggctggaaagggcggcgttgcgcagccgttttgacgatggtttccctggcctaccggcgagcgcgcaagagagagatggccggcggccggtccactccatttcgtcgtcgccggccgcatctggtgcccatccccccagcgcaagagagagatgaagagaggggagatggggagagaggaggaagaagaggagtggtgagttggaccgacatatggggctcacgtgggcccatctttttttaattatttactctgtgagactgacatgtgggtcccatgggttttattatttttccggattaaattgccacgtaagcaccatgtcagatgaagaccgagtcaaattagccacgtaggcgccacgtcagccaaaaccgctctcaaaaccgccggaggacctaatctgcaccggttttgatagttgaggggcccgttgtgtctggtttttcgatcgagggacgaaaatcggattcgttgacaagttaagggacctcagatgaacttattccatgtaaagccgtaaagcccatgaggtccgtgaagagcagaactgggcctcctccattccatctcggcccaaatcgcgactcgactagctcccccctagctagggtttcactacataaacacgctcacgacgcctctcccctctctctctctctctctctcctgcctccgcttctctcccccgcgccgccgccgcctccaccgaaagcagcagccgccggcgagccagccagcagcctagccatgtcggaatcgaaggccgccgcggcggtgaccctccgcacccgcaagttcatgacgaaccgcctcctctcccgcaagcagttcgtgctcgaggtgctccacccgggccgcgccaacgtctccaaggtgcgtttcgtttagggtttcgcccgcgtgagggtgaggggagggggagagagcgaggctgatccgctgtattgtgcgcgttgtgcaggcggatctgaaggagaagctggcgaagctgtacgaggtgaaggactccaactgcatcttcgtgttcaagttccgcacccacttcggaggcggcaagtccaccggattcggcctcatctacgacaacctcgacgccgccaagaagtacgagcccaagtacaggctcatcagggtacgcacgcatcgctcagaactttgtgccatcactctgcattctgaatttgggattgagctagcggaatggtggttgttcgcctcagtgctcggttgtgtatcctatcctgatgcgcgaattgacgcgcgcacactgtaccagtaagtccttgttcggttaggcttggattcaatccgggctaatccaatccgagccgggaatgacaagtatagtaagaaatttatgatagatacaatgagagaccgggatttattccgggccgggaaccaatttacttatgatagagacaataagagatcgggaatgatganctnctgtnccantagatangccattcatggccac

SEQ ID NO: 78163 - DNA, 1788 bp, Oryza sativa
gcattatcagatggctgctcaatattccttttacccctatgttctttgttatctttccaggctatgtttgaaattgctgtaggatgaccatctttgtccagtttggcatcacctttgtagtcagcatgtatccgtctgtcggctcttatgtcattgtcatctgctctattgtccgtctttacatcagtctcaactttattgctcggaaattcaaccctgggatcactgtagacatctcgagtgtcagcctttgcctcccgaacatctaccttagtgtcccatggatctttattttgctttgattctaatctgccatcagatgagattgagtggtccacaaagttggaggggccaataggcatcctatgtgccagagagggcctcttatcatcccggggctcaatacgttgaactttggcaaatctcccatcatgttcaaacgaaccatggaaatcactgctgcctggttgaataattttcccagaagggcttgagtacaagctgctgtcatccaacggccgttttgccggtgtggagtgactaccctcctcatgcgacctcttgggtgcaccactcattttccctcaaaaatgtcaacagtccttcaatatgaaccaagaaacacaaatacaaaaggatatagcccaatgcctttgacacaatgcactgccaaaaaaaaatgaaaatttaggtcagaacacatcagttactttcttttttccacataaccagattgtgtaatttagagtaagacatgatgtataaggtatttcaccaacaacaagaacatttaagggtgcttatgggcacatctaaaataaccccctacaacctcatgtgcagtaataaaaaatctggaacaatttagtagtaaagagcatgttggcatctaacaatccacaaaacgtcaatctaaattcaatccaaacaacaagaaacaaaaaggaaggtgttctgctaaaaagaatctcctttgtttcttgacatcttgatgcagtttggatatgaaaatttgtggcgtagaagatgccaacatgccctatcttactgttctttttcacataatctatcatcactatttgcatggtttttaagggctggaagcacccttggggagtaaccgatacaccgcattccatattgacctcagtactctgttcctagttcaccaaacaagattcagctgtatattgcaccaagctccctgttatcgactaagctactgttatactgtagtccatcagaatgagggaaaatcttcaagtttgtaaatgttcaattctacaggaagataagtcatgaaaaaatgatttgaatgtattctcaaacaaattacgtgcagccccctcgtcaatttccatgccagcccagcaccctcctctctcagctacatcatgtcttgccatttttgcggtgtccagccggactggtacaacaggaacagggtggaatcggcacccaacagaattaaagatcatttctttacccccaatttcattttttttatcaagagaatggcgtagctttcactagttcaaacgaaggagtggcggatctaacatgggacatgggggttcacttcagttgaacccccaaacccaaacctcttttttttaaaaaaaaaaaaagaaaaaccaaacctttttgggaaccatcaaactgttattagtgttaagggttagggaaaatttctagaacagaagcggtttgacgcaaattcgagaaaaaaaagtgcgtgggtaaagagagagatgggaaagaggatgtggttcctcaccaggatggatg

SEQ ID NO: 78164 - DNA, 4533 bp, Oryza sativa
  unsure (1)..(4533): unsure at all n locations
tatgtgcnngaatagaatctctctgtgtgtcagccgcggactcgccggtggtgagcggcgggtgaaaacccagctcggccttagccggaccgacaacgatggttcattccccctcctgagggcgttatcgtgttgtctcatcccttaagagtggttgccgggtgaaagcccagtcttgggctcttttgagcccccgacggacggcggcggcagttttccatcgcttctctccttggagacgtcgtttagacatccccttgctgaaaccactcaaacgattggtgcaagcacactctagatagagttaggctttgtgttggttgtgggcgttttttgggcaatctcgtctatgttcctttgttggtctagcggcggtcggtcacgctttgcgggggccggtccggtactagccttctcctagacctgtgtgttggcgttgtcggtgtatgggttgggggatatttttttttcttttttcctggtacgaccttccagggtcttgtaatttttttcctgctctatcagtaaaacttcgcaccgtctcatgcgagtccgtcaaaaaaaagtatacaaggcattggtatagtataatggactaagcatgatgaagttatattatagttaattgaaagtttagaaaacctatgaaattttttaagattgtcggagatatgggcccgggggtatgcgaagtgaggggaatctacattcccatcctgccacgtgtccctacagcctggtcctacccccgcattccacgagtcgcaggagcggccggaggggggaggggggcctcggggtgccgcgtcatgcccctcgggcccttgcaccgctttgccccaaggccctcgcccagccgccatttggcggggggagcaagtgaggacgaggcccaggctgaacctccttttaagcgcgcagcgccccaactgctccctgtcgaatttaatgcagtggggcagacgtgcggcgtgcccgactggcgcgtgatggtcaagaatgaccggtctgtgaccggcctgacgccggtcacgtctgactagacagacaaccgtgctcccacgtcgcatctgcctccggcggagtggaggtaggtatgacccgtcccatcggagggtcattcggagggcggccaccacaagtcttcacccattaatgagggaatgacaggactgtcccccatgttaggcgagagacggcgctgggccccgctcaaggataagctgtggtttagctttcaagcaaaggcacaggtcgagttccggtcaaggtagggtgggtccccatccgagagaagagtaggtagaggcggtgcatgtggtatcccttgaggtataaaaggaggaccttgctcatcgagaaaggggatgactctcggaaaacctgagctcgaggaggagggaactaagtgtgttctccggagtttaggaacccttgtaactctcagtctaaatcccatacacaggagtagggtattatgcttcatagcggcccgaacctgtataatttggttgtgtgcgagctagctaggagccttggggacggatacgtgatttctagaggcaagctttttcccctggccgaactcactaaagggggggtctcacgatctcccgctagagaggatcactcctcgacagctggcgcgctaggtagggggaagtcgcgcgctttaaagagaagtcgttttcttctgccccaagtttccctcggccctcgacgatgatggtcgaggtcctggaggaggaggcggtggtgtacacccctactccgcctgggagtgaggatgctagcgagagccgcggccctcgtcaccgccgccgcaactctccaactcctccccgccgcgatccctcgcggagggaggaccccacccagtcgggtggttcggccctctccccgcccccgggcggagggaggccacgacgcgtcagggcacggcgccgcctcacttacggtgacggcggctcgcctcgaggcgcacttcaggcagcgggtgcccttctggggcatccccccgtgaactcggagccggagacccctgtccagcgctggttggacgacgtggccaacttggtcaccactgcccaacgggagctggccgcgggcagccgacccgtcgtcaccggtacgtcgcgtacccccattaccctctcctcgtcagcgaggaagagggcctgtcgatcggccacggcctcaaggcggtccacggctccaacatcgtcggaggcctcgggaagccggaggcgtcacgatggcctctacggggagcaggacgctcgaatcaacatcgagcgacgccgggacgagcgtcgagctgctcgcatgggggaaggcgcctcctcatctggagtgctgcgttcctcctcacgaggcggccctcctcccacgctcacccctagagggactagttgtagggccttcgtggcgagtctccggaatgtttggtggcccccgaagtttcgccccaacctcacggagaagtatgatggcagcatcaatccctccgagttcctccagatctacaccacgattatcgtggcagtagggggcgacgaccgggtcatggcgaattacttccccatggccctcaagggtcaggcgcggctggctgatgacctagccccccgactccatcaactcctgggttgtcccccggatggtcattcggagggcggccaccacaagtcttcacccattaatgagggaatgacaggattgtcccccgtgtcaggcgagggacggcgctgggccctgctcaaggacaagctgtggtttagcttccaggcgaaggcacgggtcgagttccggtcaaggtagggtgggtccccatccgagagaagagtaagtagaggcggtgcatgtggtatccccttgaggtataaaaggaggaccttgcccaccgagaaaggggacgactctcagaaaacctgagctcgaggaggagggaactaagagtgttctccggagtttaggaacccttgtaactctcagtctaaatcccatacacaggaatagggtattacgctttatagtggcccgaacctgtataatttggttgtgtgcgagctagctaggagccttagggacggatacgtgatttctagaggcgagctttttgccccggccgaactcacgaaaggggggtctcacgatctcccgctagagaggatcactcctcgacaaagatagtttatggaaaaagtatgaattaccccctgaagtatcgtggtcgaccaaatcaccccactaaactcgaaaccagacattgctcaccctgaactttcaataccggataaattaccccctcgaccgaatccagagtggttttgtcccatgtggcgtacacgtggcaatccagtcagcattttatttttttaaaaaattatggggcccacctatcatacctctcttctcctcttcctcttcctctctctcgggctcaaagcgtgcacggcgcagggacgggcggcggcgcgctggggcggacgggcagtcggcttgcgggggcgatgggtggcggcgtgctagggcggacgggcggtcggagcgcgggggccgacggtgggcaacgggcgatggcgtgctgaggcggacgggctggcgacgcgcggggagggcgcagcggacaacaggcggtgccaaggagggcgttggaggcgacgggctacggcgacaagtccatcatcccctcgagctccgcagctatggcgacgaggcgatgagtcctcggctcaggccggcaccgtcgaggtcatccttccaggcagaggtggcagtgctgctaagacgacatgaggtagcccttgtcgtcatcgtccttttggatctcaaagtctgggaggaaggaggagagaggtgtggagcctcttccccggttccgacagggagtcggcatgatccacggcctccctctctctctctttctcggctcaggcaggcggcgggcgatgaatcctcctcggggagggcgtggcaagcggcacgcgtggcggggagggcacggtgctctacgacaatgagttcgccgcccatccacatcgtccccatcgactgtcgtcgctgtcaatcggagccacacacccgcgccaacgatttcccctccctggccgtcgtgcccgccgctgctcgccttcggccggagtgacctagccatgcgcactgccactcgccacccagctccgtcctatgcctccgcgtctcgcgctgccgcgtaccgcatacccccgcgcgccaccggcacgccatgcgcgcgcgagagagaagacagaggaagaggggaagaggatgtatgacatgtgggtctcactattattttaaaataaaatgctaactggattgccacgcgtataaaacagcttagattcggtcgagaggggtaatttgtccgatattaaaaatttatggtgagcaatgtctgattttctatttaggggatagtttaagtcaaccccgatagttcggggtaattccatactttttttttcctcttttttaacgagtttactcctgtgactctcatgacgtttggcc

SEQ ID NO: 78165 - DNA, 2992 bp, Oryza sativa
gtgagagaagaggcccatataaagagccgaggcccaccccacgaaagagcaaaatcgcttataatgagattggccgcaccagagaagccccccacatataaaattttttgagccgcgaggccgcgaaacacccttatgatggtaacccatggaggcgccacggtatttaataattaaggagaatatcgccggacgcgccgacaaagaaaataataaaataacgagagcgaggcggacccaaaaggggtgtaaaaagatatggtcccgaacgagggaacatacacaaaacggcgagggaataacgaaacagaaatagaagggtctataccctcaaaaggacgaaacaatgattgtgtccgcgagacacagagaaagaggttttgaaatacaattttacagagggaaaaaacaacctatttttccgagaaaaaaaaacaaccactgaccaaaacgggggaaaagatgaccaattttaccccgaataggcacccaggggaagaacacccgatttttaattgagcgaatagagagatgatcaagaggacaacatacttgtcaaaagatggaataaaagaaatagtgagacagcaaataaaagaacgggaaccccaaattaaggtgtacccttaaaatacgaagttagaagcaagagaaatatttggaaagaccgtcgcggtaggggccatattcgcagaaaaataatctgccacaaggaacatttctacaagcccagaaatttaaagaccccaggggttaaacatatccagacggaaagaaaaacgacagtcaaccgaaaacaaactcccacaggggcaaatatgatccaaaaaagacgagaaagaacggaaccaggtggcataaatgagaacggccaaacatgtgctaaaaaatcaatggcgtcaaacatttcgaaacggagggagtattatggtatttgttatttgtaccatattgcccttcaggatgtctcgtagtctaagagtaactagtacaatttctctaggcttgcattgctggaaggaatcatgtttcaaaggagaatagcacacatgttaagaatttatcaagataaattatccttttgtcctctttggattatcatctaacatttgtttcaattgccagcaagagtaaccattttaaaggaatgccgtttcgtcatgtcatcaaaaactttgtaattcaagggggtgatttcgatttcaatggtgctgcccaggaatggatactgaaagccaaagccagtggagaaaacgctctaaggtttgtccccaaatcaatgcacatatagaattctgttgaaaagtcttggttttgccagacttattttttttctttacactacgtgtatttctatgattttgcagtccaaagcacgaggcattcatgatcgggactacgaagaatcctaataataaaggatttgatctttttatcacaactgctccaattcctgacttgaatgacaagcttgttgtatttgggcaagttatcaatggacaagatattgttcaggtactttacattgaattctctctggatgcattaattcagttgcagtttccatacatcattggaacctttcatttttcatttatatttaatatcatttttctaaaaacaatatatttcatgctgagatgttcatgtccttacctcatgattagtattgttacatatttgtacattattttgagttacagtagtgctaatgccaataggaaattgaaagagttagacatgagtttaataggtgtgctaatggagaggatatgagctaattcaatgtcattatctacaaatgtatcagacgcatgtgcttcaactggttgaattagtattttctgagtatgttcattttaatgagactttttgcttgtttgatgacttaaacaggagatcgaagaagttgatactgatgagcattaccagccaaaaacccctatcggcatactcaacatcacgctaaaacagcaagctttgagctgatagcttgttgtccttacctgaaaatgacttatctgtactccaagagggtccatacatcgcctccaattgctgctgaaattgattatgattatggcttcctctagaagcccatgggttgcaaagaaagaaggcgcttaatcttgcctggcagctaaaagcttcttccgtctcatggagtagttgtgtataaatttatccctggtgtcattcggctgtcagtttttgcaggcattacagtgtattttgatgcttggttgtttcattgtaaatttgaagcccatttggatcatgaatcatagaacttggaattcatagttagttatgaggaataagttcaattgagggccctttaactttacaccgaatccgattttcgtccctcgatcagaaaaccagacacaacgggtcccttaactattaaaaacggtgcaaattatgttccttagcggttttgagagcagttttggctgacgtggcgcctacgtgggttaattgactcggtctttggttgacggggcattgacatggcgcttacatggcaattcgaccggaaaaaatataaaaaccggggacccacatgtcaatcttacatagaaaataattaaaaaatttgtgggaaccctgttggcccccacttgtaaatccaaactcacctttcctcttttttctctcttcttttcccaattccctcttttttaatattttttccccttctcccttttttttttcccggcaagagcgggcaaaccttggaagagggcgggtggaacccggtcccccacccggccaaagacaataaactttgaaggaggaaaccgcgggcatttaaaagggaggggaggttattttggaggccgcccatgggcccaccctctgggcgggggcttttttactctaaacggggggaaaggggtcaccccccccgcgcccagggaaaagagagtgtgaccgccttcctcaaaaccgcttctcaacggatttgtaaatatcccccgggaggggg

SEQ ID NO: 78166 - DNA, 3457 bp, Oryza sativa
  unsure (1)..(3457): unsure at all n locations
gatgttcnttaggtgaccatcgatggccgccggaggaggaggagatgcaaccatgcggggaggtgtggcggtggcagccggaagaggaggacgtccgacgtgcgctgctccccccgctagtggcggcggcgcgggggcctgggagtcgccaaggatgccgaggtcgacattgatgtcgtccgcagccacggccatggcgtccccgtccgcatccggcgtgcgccacagaagcggcggcatggggagcggcgcctcagctgttgcggcggcgacgtcaatggggggaaggggaaggggaagctcctcgctccggtgggctgccgctgacaagctcggtggtggtgaaatgcgacggatcgagtgccatcctggcggctgggggctcttctccgacctctgctccagaccgccgccttcgtcctcttcacccatcgccagctgtcgtcctcctcactccggtgggcggtcgctgacaagctcggtggtggaggcgggttgcggcggagggcggtcgccgctccctctcccactggccgccgtcggctgcacacctctccctccgtctgtcgctatcaagcccccgcccacggcgctcggccatcgccggcctccctacatcctccctcccttttattgccccggcttcctcctccagctcgctgctctcgccggtgggcgccggtctcaccgccccctccagctcgccgctctcgccggaagaagagaggagaggggagagagatgaagagagggagatggggagagaggaggaagaagaggaagggtgagtttgactgacatgtggggcccacaatttttttttattattttctatatgagactgacatgtgggtcccacgggttttattatttttccgggtcgaattgccacataagcgccacgtcaatgccacgtcggacgaagaccgagtcaaattagccacgtagacgtcacgtcagccaaaaccgccctcaaaaccgccgagggacctaatctgcaccggttttgatagttgagggacccgttgtgtctggttttccgatcgggggacgaaaatcggattcggtgtaaagttaagggacctcagatgtacttattccaaaaaaaaagtgagaaaatggacatttggccatgtttaaaacgcgcggtttgctggaatgccatcccaaaaacatgtttctttaaaatgccactatgaaacacgtgctcaccgtcgctttgacattttgaccattttgggcattttgaaaatcatttttgctggaatgtagggtgatgagacggaattgccctcaccggcgtcttgagcaggcgggttcttgcctcgtgccggttgcggtggcgcagctcccaccgggagcccagctcgccgtcgtggtggcgtccgtcggcggccgccgctccgcagtcctctgctgcgagggcgcggctgctccggagccgtaccaccgcggcggatggagtgcggcggccatggaggtcgcgctcggcgggctcgtcgtcgctcgcccggcgatgaagcgcttaaggttcgattctcgaaacatctgcttcaactctttttttctgctgttcctttctgattctgcatcatcacggcttattgcaaacttctttgtccatcgatcgcagaacgaaataggctctcttcttttgagcctgcagattgctcttcttctgtatcttggttcttgtcccatggcgcagaacaaaaggctcttcttttcgtcttctcttcatcctgcatataggttcttgctggagaccttcctcttgtgcacatcattgttcttggctttgctgtagacggagccccaggccctcagcagctgcagttgcgcgcgcaccgcgcctcgcagtccgccgacggcgagtgctgaaacggcaggagctccttgttagccagctccacgagctgcctccgcacctcccagtacagcccgccgacctcgccgctcgtgcagccgccgccgccgacggcgcataccgagccgtccgtcgtgttggccaggcactcgcaccaggcgccactctggatttggaggttggaggtgttgaggagcacaagagtgggaatgaggatgcgaggtggagcacggcgaggtcgagcatggtggagttgacgcggaggaagccgagggcgaaggcgctggcgagggcaattccatcttatgacccgacattccagcgaaaatgatttcaaaaatacataaagtggtcaaaatggcaaagtggcggtgagcacgtgttccatattgtcattttagcgaaacgtgttttcgggatggcattcgagcgaaaccgcttttgaacgtggccaaatgttcattttctcggaaaaagtacaccagaggtccctcaacttgtcattgagttacaaaaacgtcctcaaaccacaaaccacatatgaccccggatttgtccgacgtggcggctgagtcagcgtaggacccacgtggaccccacatgtcaggtgtccacgtcagcacctactcctctcccctcttctctttctccatttctctctttccttcctccctctcgctctttgctctcgcagggcatggggatgccggtgacgaaagatggtgcggctggcgacagcggctccccgggaggcgccgtgctgctcaccggtaacgtcatcgtctgggccggcacgtcggtcctcttcctctacgccggctaagtcctccttgtatgaacttcgcactggtgcaccaccgcatccgacaagtggatgacaccaagcaatcaacctcggacttcacggcacggctcctcntggatgagaacgcgtctcacggcctccactcccattttcntccaagcccactccgtgctaagaatgttcgcgtgccgcctcgtcgatctcctccactcgccactctacctcccgcgccgcctcaccatcctggacatcgcgtcgcaccggtggtcgaagcccaacgcggtggcctcggcgctcctctccccgctcctcctcgccgccgccaccgcacccaccacaaccgccctcctctccgccttgctcgccggcatcctcctcgccgctgccgttgcggtcgccacggacgctgcctctgttgagttgtgatccaaatttatttgcacttaataaaggccagcttctgctgtagcgaagcggaggcccattgccagaggcttgggccggagcccccgcggtacggatcgttatcccttttagggttccaccatatatatacctcttgtaagccgccatgcggcgttgaaacctcaccccgatatagtaaagatattttgctggctggcgcctgtgtttttctctctcatgctttgggagggtttttccacattaaatctcgtgtcttttgtgattgatctattgttctttattgtttatttgcccatcgtttcctaacaagtggtatcagagcttgttatcagattagggtttcgcgatggcatcgataa

SEQ ID NO: 78167 - DNA, 17071 bp, Oryza sativa
  unsure (1)..(17071): unsure at all n locations
tgtggtnnnnnaatggtagccctctacctcccgcgccgcctcaccatcctggacatcgcgtcgcaccggtggtcgaagcccaacgcggtggcctcggcgctcctctccccgctcctcctcgccgccgccaccgcacccaccacaaccgccctcctctccgccttgctcgccggcatcctcctcgccgctgccgttgcggtcgccacggacgctgcctctgttgagttgtgatccaaatttatttgcacttaataaaggccagcttctgctgtagcgaagcggaggcccattgccagaggcttgggccggagcccccgcggtacggatcgttatcccttttagggttccaccatatatatacctcttgtaagccgccatgcggcgttgaaacctcaccccgatatagtaaagatattttgctggctggcgcctgtgtttttctctctcatgctttgggagggtttttccacattaaatctcgtgtcttttgtgattgatctattgttctttattgtttatttgcccatcgtttcctaacaagtggtatcagagcttgttatcagattagggtttcgcgatggcatcgataaagtatgatctactgctgctagactataagacgagattctcgctgtggcaagttaagatgcgggctgttctagcgtaatcttcggatcatgatgaagcgttggaaagcttcgggaagaggaagaaggatgaatggaccactgaggagaagcggaaagattgtaaggctctgtcgctgatccaacttcatctgtctaatgatattttgcaagaagtgttgcaggaaaaaactgttggagaactttgacttaaactagaatcgatctgcatgtctaaggatctaaccagtaagatgcatatgaagatgaaattgttcacgcacaagttgcaggagagtggttctgtgttgaaccacatatcggtcttcaaggaaatcgttgccgacctagtgtcgatggaggtacagtttgatgatgaagatttaggtcttctactgttatgctcactgcctagttcttatgcaaatttttgtgacaccatactattaagctgtgatgaactaacccttgtaaaagtttatgaggcactccaaaacagggagaagatgaaaaggtttggatcagtctgatgcgtcgtcctccaagggtgaagcattgcaagtcagaggcagatctgagcagagaacctacaacgacaacaataatcgtgacaaggagctggccgttggatgcgatgaaggaaagatcatgggtaattgccctcggtgcagagcagcagtgctcccccggcccttctcatccctccctatgcacaagggcgacgacactcccctgtcctccctagacggcaatggcagcagcctccatagacggcgagggtggcagtgctcccctatcctccggcatatgtaggcagtggtttgcaaagatgctggtgtgtgctctgctttcttggtttggttatgattgtatgtttttttatgaaattctcatcttctgttgtggtgaaaagcctttatggcttgattttgtttgcagcttcatctcttatgtctacaagatgtttggtcgtgttcctcaaattttgaaggtttttggccagcaaccgggcatactcgttcattttcctcaaaccttaaaggttctgggtcagccacaaacggatcagaagcaatatcagacttattttgcttcctgcgggaaccctgcgatctcttcacaatctggatgtgcgcatggaagaagggaatcggaagaaaatacatggtgttgagtttgatggatgaacgacatggatgcgagctcgacacggatagggacggcatacaaaattcttgggaaaacatcttagatttttataatgggtaaagaatatatatacaccaggtgatttcctgctttttcctacaggaattactaagcaattctcaatatatttttttcgacaatcaagctaggaataaaaaagaaaaaaaataaaacatcagggtttatcattacttattatgaaacaaacaaatgatacacacactttaatgtaaaacatattaataagttaaaatattgtgcaaatgatgtagggataattgttggatatgattgcatgttgatttgtaaaattaaataatttgtatatgatgttgtatgcttgcatgaggttatatatgtaattattgctagtgtgatgatgtggcatggttgcatgtggaggtttagacttagtgtgctataactttatataaagtatatatatatagggggaatatccagtgaaaacccgtgaaaactatatctaaattcacgaagaaattactagagataggtataggcatgaagtacatcaaatttgtcttttttgtttttctcaaatgaagttgagtttggacttgagatttgatatgaatgtatttcatgcctatacctatttttagtaatttattcatgaatttacaaaacttttagatatggttttcacgggttttcacttatttgatggtttttaccgtatgtgccccatagatatagatagatacccaatgtgtttagattaatgtcaagtatttattatttggtcctaacacaatcgaatgataaacaatattttctttttctccgattatggtggtaacttttatacctctaaagtaattacaatagcaccttttccctattagcatgcggcatacatgaagctgatttgatttttgggtgcatcttaagattttaactgttaggtactggagattcctagaaatattcaccatagagtacttagcagctgtggggcagagaatcttctgggtagtcaccaatctccaacaaaggctgtttttagtttcacattaaaattggaagtttgaagaaattagaacgatgtgacgaaaaagttgaaagtttaggtgtgtttagtttcacgccaaaattgaaagtttgactaaaattggaagtttatgtgtgtaggaaagttttaatgtgatggaaaagttagaaatttgaagaaaaagttgggaactagatcacctttgtgtgtgtaggaaagtttgatgcgatggaacagtgggaagtttgaagaaaaaaattagaaactaaacaaggccaaataaaaaaaatctagcatttgcgctctctatctctgaagccatcatatttactcccgtggaatcctatgttcaatgctactcccatttacacgtgcatgtcaatattttccttcatttgatgtggtgaatcggatacaaattctgcagctgctttaccgatttgaaacaatacaatccggtccatactccatacataacgacactcaaaattatttgacaaaaacatcttgaatttttataataagtaagaaaaaaaattggcgacaaagggatgacaaaaacactatgaatcttttaaatacgcaaagataaaagaaaaagaaaaacttatatataagtatattggactaattattttaccagagtttcacttttgcaatgtttttttacttataatgctagtcattgttactaatcttgtactgtgaaccatctctacatactcatctctctaactctctcttcttcgccttcgattcctaatggtcgttgttatcaccgctagcatgtcttgttgcttaagcttgagctatgcgtctgctcatcgcggagctcgagagcctctccttccttcagagctcgagatcaagatatgatggaaagctgggtttgtcacggtagaattttgtttttttttctttttgttggttgatctttttctttttctttgtctgaaattgtactttacatcatacctatcatacttatgttcaaaagtgtatttctaaatcatagcccttttttaataagccgtacggcttataactaacatatggccaatctatagggccgaattactatgatataaatgaaatgcaccacatgttcacgttgatcattaaaaacttttaggacatgtacaatgatgattaatagtggtctctcagcgttactaattaggaatatttgttaacatggaaaggagagacaaaatattgttgctataggtaacaataactcaacaacgattcttcacctctataatatggatacatggttacattagggtgaaaaaaagaaagaaagaagaatagtaaaaggaatatttttcagttaatggttagagcctttatcgtttcaactatcataaacacacggtctctaaataataaataatcttgtactccatatgtcctaaattataagacatattgacatactttgaccattaatttatttcatattatgttcctaacgaatatgaaaccagtgatataacatgcataatatttagcatagatatggttaatatgattattagttaaaagttatcgagtgtgatttttttaaaaactagcgcgtcgtataatttaggaagaatggagtattggctaagagattatacttgtctctactctctactattaaatatgccctgaagctgatgcataggaagctcagggagtgatgccacgttagatatctaacagtggaattttcttcttcatttacctctggccggtatttaaaaaaaagtaaaattcattctagtccacaaataaccaaagtggcatattggactaggggtgtatctctatttccacttagcaccactaatctttataatctgttatatgttggattatgtatctaggtttgttcatgtttgagccatgctgggtggtaatttccggtgagaccggccatcggtgctcggtgcatggtagctgggaagcagttgacacaagggctccctcgagcctcgaaggctcctacgccgtccatgctcctaaacacacccaattccacacatccaacaaaaacactctttcaagggaccgacccctccgcttgtggctgtggctggtgtgccgtggtgtgagcttggctatcgacatgcagataacactacgatatgtccaccatagtgtctccaccaaggccctcactatgttcacacaggtggtcatcacgcgttgtcatccgagcatctggccatgttgccagcattagggccaagggtctcggccaacgccacctcgatggcttatggagggtacttaatcaccgaggtcgctagttggttgtgcagatagctagacaagtagttcaaagctatcatatggtactcaatcttggagcatgctatccagggaaaaaacaatcttgagaaagtaaaacaaaagaacattagcatcatagcatcaacgctggcgttggagacgcgatcgtaccagacgatgatgtggtgcatgtcaccgatgacctcctggtatcgctctctggtgccaccacaagcaaaccaaagcgactagtaaattagacccaaaaatataacacaatgagtaaatcatatccaaatctataatacacaatgagtaaacatgatccaatctacaattaaaattagatgataacggcttgtttggtaactcgatggaagaggattgggagtttatacaagggaattaatgatgagattaagatggaaatttgatttttaatcctacggcctgtttggcaagagaagggaagaggaatgtgagtttgaaggaaggagttgatggtgggattggtcatgggagttacttttttagtccccatcccttgtttggtttcacatcgaattccctctaagtctcacgaattaacaggcctcccccaggtaagagattggtgggaattggaccccttaattccccatcccaaaccccctcaaattcctaagttttccaaccaaactacagacttaaactcccatatatcataaactcccattccccatcaccaactccctccaaccaaacagaccgccaatatcttgtttgatagagatgatggaaattgatagggagtttagttggatgttaggtcattaataaaaacggatggctaagatttgcttagataaagtaaaggaggaattccctcccagttacctgcccctacgcaagaattaaaaaggagggagttccttcctcaattgcccatcccatcccaccaaaattcccatgtcttccaaccaaacaaaacacttaatagcatcattcctctaaactcccaatccctcctagaaactttctccaactagaagtgaaatgagagacctagcactagtccaatataccactttggttattgaacaaagtgaaatttacttaaattttcttcaaaaataaatccccacctaaacccgcgtcgcctcctcctccgccgccgtcgcgtcgccgtctccgagcgcctcctccgcctccgcctccccctccccctcgcgccgtcgccgtcgccgagcgccgccacttccgcccccgcctcgtaccctcatcgccacgagccccgtttcgccccaagcccccgcacagatcggacccgtggcggcgctcctccaccgtcttacccccgtcccccgtgctactactgcgcgcccagccgccgcagagtagggcttctcccccctgtgccggcggcggcggcaggggttcgtaaggctgcggggaagatggctagcgtatacatcccggtgcaggggacgaagaaggaggtgcgggtggcgctggaccagctccccgccgacgcctccgacatcctcgacatcctcaaggccgagcaggccccgctccacctctggctcatcatcgcggtacgctctccctcactccctcccttcctagttcctagtcctcgcgacgaaaaccatcaacattccctgcaattaatcgctcggagttatagctcgtcggaggcgtgattattaggagtgattcggcgcgtcatggtgcgaggtccactaccctcgggcctcggctatcgcttccttgaaaatcttcccttggggtttctagggccacggtctctcgcttaatcttgcctgcagatgcgcatctattcctgttccagtgttggcattttgatagatttgtcaatgttggttcatattttcagtttattcgctcaactacgtgatgttgtacttgattagctttgttcttctctggttgttcaaagtgaacgaccatgctggtgaggtgccagaaattagtgatgttcatctcccacaagttgagtgcttgcgcacttaatccaggactagccttctgatgaaacctgtacttgtggggaccctctctttcaattgctctcctgagtcttgacaaattgagcctttccgagtggttgatttaactgttgtaaatttggaggaaacaatcaattgtattgttttgttcacttgtgaatcttgtgttgacacagagagaatacttcaagcaaggaaagatagaacagttccgacagattctagaggaaggatcagggccaggtttgtttttagtttctatttctctaactgtagggctactggtcaaccacaccatcttttatttcttacactaatttagattctcattgttacttgaacgcctgttcttgttgaatagtctcttctcccttgcagaaattgatgaatattatgctgatgtgaaatatgagagaatagctatccttaatgctttgggcgctttccatactttcctggggaaggttgagagagcacaacagaaggaagtccatttcaaagaagcaactcaatgctacaatagggcatcaaggatagatgaaactgaaccttcaacatggatcggaagaggttctattatttagagagtttcaaatatcttcatctattgtcttttatggcttagtgaatgttatgcacagcttcttttaccactgctgtggttctattatgattttctgcatattcatttgatcttgggattgtgtggttaatcccgtggaagttttatgtttttgtcatttttgcatttaaatttaatctattaaatttgataatactgtacttagttgattgtatttatttcaaaatgttcttccaacgatttcagtaaaaaaatgttcttccaacaaagctcaatttggttcaaagagatgcagcaacaagtatgggactgtgataatcattttctaatattcataaagaacgttttcatgtgtgtctaatctatttaaaaacatattattttccatgtgtttgttgatgtcacacaacatgtttgtggaaatcatctttgtttgtgaatatcttggctcttcgagacctattagtgttggattagtcccacagagtctaatatagtgtttagagaaatatgttgctccttttagacaaagcaaggagccaatggaggaagcctaagagttgatgtgagtttgatgtagttttgcatagtgacaaccatacatatatatatatttagttcatatttacctccgttgatttatatacatggtatgatgaaggtgtggtgtaagatgtaaagtttggttcctcagactgctttatagctgttttcaacaatcatgtcttattttgaaggtcacattatttataatctctgttaggtgaatgctaacatcttacagtaggaatttcgattgtgcatgtcatggaaaactatcttgttgcattgcaaacacatggggaagaggaaaaactatccttttatagttgcaactattaagcaaaaacttgtggccacgattcattcttaatcagatcgagcacatattattattttgatcatgtgttccagtggcgttcttgattttgggtttaatttcttactacactatttgttttcacaacttaagtttcatgatttgagcttagcgcactcatacgagttctgcagttaatgccatttcttcaccatattaattcatttgaatgattaccagcataacacttcatgattttttcctaacaagtatggttttaagtatgctgatttattgatgttgttcttcaggtcaactctgtgtggtcaagcacgatttgcaaatggcatctgattcattcaagattgtattggatgaagatggaagcaattttccagctttacttggtcaggtaattttcttgaggatttcaaaaatataataacaaaattgtggtatgtcgggtggaatcatggtatgtggggtttgaggttcgcaattcgccatttaaccccccaaaaaaagattcactgggtacgcctatgtgattcacaaataaaaaaaatcagttcatgaatcagagattggattgggtatttatgggggttgataccaaataaccaaaacgtgtcctaccaatttttttggcaagatggacagtatttatgaactgtttggattgaagcctgtttggcagtgcccacgctcaaggtagtgccctcatctaccctacaaaatcatgacctacaaaatttgacaactagttagcaaaccaaacgtaaggcaaggcagctttactctacaaaattttagtagtgccaaaacttaccaattctttggtagggatgagaatcagtcaaccaattcacccttatcattaaagtcaaataacaatatttacttaattcaaatacattcaaaaggattgggagttttaaaggaccaaatggtgaaaaaaattgtgaaaaaactgatattaggattattaaggaagataatgtaatgggcccagtcctccaggcacaccggattgtttcctcgctgtaccttctctatctcaatcattggcgcaaaacagctggtttgacttttccgtcaaccctagcgttgccagccatgctccctcatccttgtcttctcgccctttcccttcttgttgctctttgccgccttctcagtagagatctttcttctcctggaccgacaaagatgcatctagcagcatcttcagtaaacaagtggccattgtaatggtggcagaggtgatgttgacgataagaagcactggtggttactctggttggtttcccctttccactcctctcctttgctgtccatggggttgctgatttggttaatttgtgccaataagatgtcattccctattgatctgagtcgcaagtgtaccacaatgcatttcatgtgattggaactgcagtacgcgtcctcttggtatgtgtccagtaactacttgaagtgattgtcattaagtatgtataaattctgaatggccacagattgcttcttgtaatggtttactctataatatttattcaagttttgaattttgagcttgatatgaacactgaacggataaacctatgacagcagccaacagaagtattatcctatcatagtgtctgtgcattgcggtggatctcaaacaaataaactataagttcttaatatgttcaatgcaaaatatattgtcatcaaatatctaaaaagttgtacagataatcaatattagctaaactggccatttggatacacacaaaataacaaaataagagaatgtgtgtaagtacattaaaaaaaagattgtcgaagagaagtggtgggggtaaagcaagtgctatcattctacactgtactactgtaggtaaatatgacaacctggattagatggcttcacaccatttcttcatatgcttactagatctcctgcattagtttatctttgtactgctccctgtattttggctctttagcatgcagcagataaagatcgtaacaacctattgaaggcactaaaaagtacaatgtggtagtcattgtaaactccagcatctttcttccaattattgtaaccttcaagttataaatcctatctgtgcaggcctctgtttatttcctgatgggtgactcagagcagcaacacaagaaagctctggactattataggaactcactggatctctataaggttggtgataactcagcacttgagttccttttgacaatgccatattatttgctgtgataatattttaacttttataaacttcgtagagagccctgcgggcctataccagctgtcctgctgctgtaaggcttggtatagcattttgccgatacaaacttggtcagtcagataaagctcgacaagcttttcaacgcgttctgcaggcaagccctatttctgtcacttttatagctgtatagaagatttacctcggttaattgattaaactaaactaacctttcacagttggaccctgaaaatattgatgctttagtagcactggcaatcatggacttgcaaacaaatgaaggtaaatgctctgtcctaagtactaacaagaatccttttttcacaaattttccctgaagtctcgcaacttgtgtatagctggtggaattcgcagaggaatggagaaaatgagaagagcttttgaaatttatccttattgcacattggcactcaaccacctagcaaaccattatttctttactggccagcattttgtggttgaacaactgacggagactgctctctcttcaagtaatcatggactgctgaaatcacatgctttctataacttagccagatcgtaccacagtaaggtgatatactctgttcatacacccacgggactatttggttattcttttacttgttctctctgttgaaaccttggatttttttggttgctactcttgtttataaccctcaatcaaacttttaccaaattcagggtgatattgagactgctggaaggtattatatggcatctgtcaatgaaatcagtaagccacaggactttgtgttgccattctttggtaagtatattctcattttagggactgttatgacatcacaagccaattggtcatgtgctgcagtgtatctcaacaaacatacaccaccaactctaaaacactcaaaaccaacaagttgtctttattttagcctttacttgatcagcatgtgagttgtgattgtgacctgtgtgatgctttgggtgcattggatcatgtttagcagtttctgttttgggtctgttaattatattgattgaactggtattttcttcaggataccatgatatatttcttttccttttgctgactgtctaatggttagttcattagtataatgttggactatggttttctgagctgtatgtggaagctgaacgatatgacagttgcttgtgtcattttgaccttgaaactcccatgaggcattgtatgacttgtttcaattgagaaatgtagattttattttatttttgtctcggataggtgaatctcgattgtcaatttgtctattttgcacttctaactttataacctatggtacttttatttatgatccagtcacaatgcgcatgcactacactaacttaaaagttattatacttcttttaccatttctatatgcgcgaagctgttgttgaactgtaagtgattcccgatctttctgtatcaacttaatgggttgaactgattggcacctacctagtgacaatttaaatataaaatggcatcccacttctattccacttgcaagggagctcataggtagggggagcgatggagtataaaatgagttgctaccttatcaacataaacttctggctgaattggctggtgcatgctacccaatatcaatattcctttttgcagtcatcatcatagcactaatagccttttcagattttgtccaacgaagacttcaaactcttaatgtctattttgcactttcatgtggagtgttgatgttttcttatcttttccttgattgattaccttttgtttgacaattgtaaataaaatcatgctatctattgaatcactttatgttcttttttgtcttctttcttctgattgaggtttgtcaaacgtgtgctagcagttctagtagatatttttttaggtcaattgagaataattttcggcatttcttatgttgtttgttacaaaataatgatttgaagttttgaaccaggacttggtcagatacaattaaaatttgcagactacaaaagttcattagctagctttgagaaagtgttgaaggtgcacccagaaaattgtgaaagtttaaaggtgagatgaggcttccattcaatttcatttgtttgagaaggggctatctgtatgaattaattaatgttgctctgtcaaggctattgggcacatatatgcaaagtcaggtgagaatgacaaagctatagaaaccttcaagaaggttacccggattgatccaaaagatcatcaggtgatctctctctctcttgctcactcattataagaaacattctttcaatataatcttatcatgcttcttctgtacatataaagaataaggccctgtccatgtgagaggaacaccactgaacccgtacccagttttcaatcttcagacttttttgattaaaaaatgtggatgttaatatgtaaaccataggaactgagtgctgctaggttgtctgagtgtactttttgagcaccttcctgggctcaacacctggtgcctatcttcttaggtgaacggcagagcacatggccattttttattttaaatctgggaagcatgtcttagcttttaagcatggtgatgatcctagagtatttattattgaaaaataccgcccttaactaatactccataattagttcattgtatatctgtggtgctctgtataacctagaattgaaattgaattttattctcaatctacttaccctacctattaatttatgtacagttattctggtttacatttttaatatgctaaatgtatttataagagcaaatgttccgaatgttacatcaatattgtgaaatgttgtattatttcaattcacttgtctgtttatcgtagaaaagcatgggcatttatttctaatgggttttagatatgactaaaaagattaactaagttggctgaaagttcgaatttctttttgctctcttgaacttctattcctggtcatggtcatacaatctagatgaaacttgtaaccttcaagtttcctttcttaattcaatgatatgcaagccttttttacatattcccgaaaaaaggtttccatttatttcccttcttaaaaagaggaatttggggttatggtgtgcactacacccatcccctcatcaaggtcttctgtgagttgtgactagatatatgtagacgtgtgtgagttgtgactagatataattagtaaaaagtgcattctttgcatatgtgtgtattatattttttctgtcatgtagttatgtaaggacaattattttgattcaccttttactgtagatcttacaatatatttatttggcacccattgcgatgtgctggcaggctggtagttttgtttcaaacctctgatcatccacttatttagagtaggacatattatttagttacttcgtgtttgtgtttgacgcttcttgcattgtgaaaaaaaaacaaacttacaatctattttctgggcacatatctgattttgtagcccattatgttcaatattatgtatataatcttgttcatccatttttcaggcatttatggagctaggtgaattattggtacaatctgattgggctactgctatggaatacttaaaaacagtaaggctattcacttcgctagaagtttattctgttagcctgtatcagattctaccttggatgtatgtttcagtcatagagtttagcatataaattttgtttatttaatttgttgttgatacaaatgtgtactgctttgttttttgatccaattaacgtgggtcttgcttcagtttgaaaatatgaaatcttacctagcagttcacaggctcggaatctcctaaagaaggcaggagagaaaatacccattgaattgctcaatggaattggactacttcattttgagaagggagagcttgaggtttgttactgcacactccatataaaatactttacagtcatttataactgatggtatttttattgtttgctttttcagatggctgaacaaagttttaaggaagcacttggagatggcttttgggtttcaattatagatggcagtgtaggtagctccgtggttaactggagtattcagtatagggaccagagtttttttcaacaacttgaagaagagggaacacctcttgaattaccttgggataaggtcactacattgtttaactatgcaagattgtttgaagagctccatgatactgtgaaagccagtctcttttaccgcctcattattttcaaggtactgccattcccaccacatgtgtgccatcatgcagctcaacagagtctgttctttcatatagtcatgttacgatattaagtttacccaagcaggggagcatgcactgaaaagaatgtgaacatatttaaattctgacctttgctcacacatcctattcctgatgtttattggcgtcgcagcctccaaatgtttttatttgttacgttgtgatgtttgcatggagttccatacctttgcattttattttgtttgtgtagcatcactgatatatgcagtggtggtctctgctttatagtcttcccttgttaaattagttgatgtgttttccatgcttatagatgatattgcatcaatcacagggtttgaaaactcatgatataagatataatttccatgttcatcaattatgacagttaagaatgatttatattcctcagtaatttgatttgtcttgattattacagaaaaatttaagatatgtttaatgccaaggcttgtgaaatgaccacaattattttatattgcatcttgtttgcatgtatgtttatatgtcaattgtcatagctcatgtcacaagctattatggatactattatgcttgaaaagatatatacttccttcataaccatttgcccattatttccaaatatatgtaccaaataattgttccagagaatatatttggtacataggtatttgttgtacattctccctgaaaatgtgaaaacaacaggaccccttttgaaactatttttttagggtactgtgtgctgtacattctaattttaactccttttatttttacatgacagtatccagactacattgatacttatcttaggttagcagctattgcaaaagaaaaaaacaatctccaactgagcattgagctggtgagtatgaatgcttctgcatttttcttcttcttattattaagaataactataatatatttgttgtagataggtgatgctctaaagatagatgataagtatccaaatgcactttctatgcttggaagtcttgaactccaaggtgatgaaacctggcttactgcaaaggagcatttccgtgaagctaaagatgcttctgagggaaaagacacatactctatgcttcaattggtatgtgagcttacttaactctagtacatttatctacttatcactttactggtttgattaacaaccttttgttcgaaaaaggcagatggtttgtgtaccaaattgggaacaaacttgttatagactttgttcttatttttcttttgaaaactaaagcccaaatggggacttaaattacacaggaagatatggataagaattgttatggttaaagtgaagaagtaaactcctcgttatgaattagttgcctgtaattactgataactttgtttggcgtgtaatgtctggacaagtgctaccagctggcacgagatgatgcattgagctttatatattttggatcactagcatatcacccaaattaccattgaggtaggggcatgctaagcataatctaaggttgatgttttcccaccaataggtttacatctgcttggnttgatgcantcatattatgtaactaaatccaatggtttttcttatatttaaaacgaattttccatgttggttcaggggaactcggattaccttggtgcttattcggctcgtgaaaaagccccccaaatttggggcccttcctatggagaaaggccaggaactgntttcaaaatgttgtttgttttatgctcaacaccaattcaggagactcagggtttaatttgtggtaggtgggctgataaaaatacccgaacaacccgctccaataaacttgccctcaaggggtggattaaatggtacatgtggacaagggccaataaaaattaatgagctttgggaaatatacaaagagacaaattggcttttttttctcttttgggaaaaggcagagtggggaacactttttttgtggggtgggaaaagag

SEQ ID NO: 78168 - DNA, 4366 bp, Oryza sativa
  unsure (1)..(4366): unsure at all n locations
ccccctgcaaagcgcgtcgaggggaaatgatcaaggttctaacccgcgcagggttccgggtttaacgcataaaaaaattttttttaaggctatggaagccnacgtgattcccaccatatatgaacttttattgggttttgtaaggggaaatacggtcaacctctcattggcaggaataaaagcaactaagtttgatggtatgtaaaactagattatcagataagttctttaaagtaaaattttgagattatgcacccccaatttttggttttggatatatagatttagttatgatcaattcttatttacatgagcattaggctttaatagtgcttaagctgggtccatccggtctatgtatacttccgtgcggcaaagccgcagttattttctagtgcaacctgattgaaggtggatgaatacaagtgtatgtgttttaattctcaatagcaaatccagcaagtggagtaataatacatgcatattgccatgtcggtatacgtgctaaattaatgcatcaattggctttactcctctctgctgatctggttcatctctaataggttctatcataataaacctaaagaaccaaaagctaagtacccagccacttttacttacctcctacccttcatagttcatcacagggatgatgtatcttgcaggcctgtctgccttcttcctcctcttactaatttccaaaaattttcttggttatatcggcatgggagttgtcaggatatacagatggaggtgaatgttacagcccaggacgaagtagaatgaacaacgaagaacagttaccacaatcagagcctatttgagacattcctgcacgaggttgtttcttggaggaagagggaagagacttcgtggccatctccatctcgaggatgtttgaaatctttctgaacatgaacaaagcattcctttcactcttgaataaatttatcttgctttgtgtatagtgtatagatcgaccctgtcaggccatttttgagatggcacacccttgaaatatggtcatgaccaccaagatccatgttcactgctcgagctgctgctggatttacgacttattactctactcaccgataacttcaagattttactggacacgtgcaaagctgtcagccaagattttgcaacaattgagaactctctattgagtgttaactaatttacgataagaccttggacaaaggatcgtagcaattgaaaccacaaggataacgttgtgcattggttagaggttacatatataagtacgtcactcacaaaaataaggacaaaataattcgaaagaattcatcgtacctaagagaccacagtaccttccatgaatacaaaaactggtaggagggatacaatacggggtgaacgttatctcttccagatctgtttcccccatcgattccattttctccccgatcgagcagctagtcgctttgtcctactcgttctccattcgtcaactcctttggcccagtcaccatactcctccttcctccctcgaccctagaccatcatccccaacatcgatgacatcaccttaacctctttctcttctacagtggatctatggtatgagagagagtgggtatcattacttgatcatgtatggagccatcaacataaggaataaaggagatatgttttagttttaatgaggtagtggttaatgtataaaataagcctaacgttagcagaaatcctactgtatctaatggctaatatttgaatgaagaacaatccaatggctacgcttttgatgatgtggctacacgtaattgtagataatggcaacatatcctatgcacacagaccctcacgtgtacacacgtgcacaccaactaaaaaatgtcaccaaaaaatctagaaaaaatcatacatatactttcaattgtattacacctagggttaaaatcttaacgtcaaattcattatattttagctgtaacaaaaaaacaaaaaatctgatagttttaaggttgcaattttgtcagaattttatctttttttgttattctctatgtagaatgaatttgaagatgcgactttgcacgtagatgtaatactattgaaagtacatgtatgaattttcctagaattttttgtgataatttttagttggtgtacacggtgtgtacacgcgagggcctgtgtgcataggatacgctcccgtagtgtggctaactatataggaatagtagataactctgaaagtccaaagaaaaactcaagagtagatacaaagatgaatatcttatattggtgcctatattgtagagaggcgtcactctttatagcgttacatacatgttgctcacttgtgtataggaccatgtatcacatctctttactcctcccaacctcctatcttctctgctcctatttacacacccctgtttttaaccctcaaactttcactactccctctttatagttcacatgccctcccctcttttctccctcacttccctgtttaaaggttcagtgattcttagtcactatcaaccaatttcatattagggtgaccgatacatatatcaccaccacatgtgaaacacaaggtcgattacacaatttggcaagtctttgctgccgtcagttcattcattggactaaatcttaattgttaactataactagcctatctgccttctttctccactttcctccaattttctagggcatagctcatcagccaagcactgctggttcgatcggcttgggagttgtcaggagatgcagattatgaataacaacagagcacaggatgaaataaaacaaacaatgatgtggtttatttgctttgtttgggatgctactcgaacaacgaagcatggcgaacacgatctgagcctaccggggacacaatcgcacgaaagttgtctctgcaagcaagacaggttgcaaggctcattgtttggtttatctagctttgaccaagcctcataggtggttaccgcacctgctgtgtaagcggtgtatttttgccgtcgcaggagagcctcagtgatcaaccttttcctggttgttatgggttagattgccatcaaaagcaaggatttttatcgtctaccaaacaccataggattatccttgctcagatccaaacgcaccctacctagccatcattccttagccaggcaatattccttcaggcaatggattgttctgagtacataactttattttgcttgatgtatatactttgccaggcaatatttttttgagatattgcacaaagcataagacccaccaacatccatgttctttgcttcaagctgctgctggattaattgtgtgttcgtatcagacacgcggtgtgctgtgtgaaccagcaagcacatgcgcccaagcagcaacagaactcactgatgatgaaattgcaaacgaattatttaaataaaattttgaatgtgaacaacaaatttgagggaaattgaaaaggtgaggggaacagctcaacagcatgctgcctctgccgctgctgttgacgtcgctgcacacctgcacctacaccgtcgcaggagcgttgctgctatcaacttcgccggaggggcgcttttgcgtaccggccgtccattatagaaaatggataattagtatttttctgaaggaagggaaattagtacattacttatttgataaatgtatttggggaaagtgaaaatatttttttgttagaacaataaatcatacttcctccacttcatattacaagtcgttttgatttttttttctaatcaaatttctttaagtttgaccaaatttataaaaaaatatagtagtattttcaacataaaaccagcatattatcaatatattcaagactagagttaatgaaactaatttagtattttttttatgttgctgaacttttcacaaattttatcaaacttgataaagtttgactgaaaaaaaaaataaaaccacttatacagtataaaattaagggagtaaaataatcgatggctagagggagtaaaataattgtatgctgactcttaccttctccctagagcgataagatggagcactctaaaatgactcgacgatataacttgggacaaaggattgtaacaattgaaaacattcctttaaagaaagaggagtgtgtttggacctgagcacctggctcaactaaaccacaaggataacattgagaatcgattatgaggttacagagataaaacgcatcactagcgtataaaaactaagaagtcactattcattcataatctatgacaaagtaaaagaccatacactacgggcctattcggattacagggtaggaaaaaatgcaggaaaaatgcaggataggaaaaccgtangaatatgaaaggaaatcacgtagaaa

SEQ ID NO: 78169 - DNA, 6983 bp, Oryza sativa
  unsure (1)..(6983): unsure at all n locations
agataatctggcctttgtttggggcgcccccgccccccaaatatttttggtttttttaaaagcatccttaacagctaacaatattgatcctccaaagcctatttaatggtcattaaaaagattaatcctttatatttctctaaactccaccagatcatccatattacatcctctaaatcttaaccctctaaaattttaagagtaaccttcacctaccatccatatatattaatttttcttttttcacctttcccttatcttattattcaccattcactcgaattntagaaaagnggngcagaagaagcgggaggaannnaagnanaacnnnncnanngcnnannnnnngannannnagnnnnnntcttactatacttggcattctcggctcggattgaatccaaacgtaaccgaacaaggcctaagctggtttgctagcatttaggattattttactttggattttgtgagaagcagttaggaagttgtctcgtgatgtttagattagttttctgatgtggttaataggtgcagctactgtccgttggaaacggttgctttgtttcgagaggtgttctgggcattccgtgtgaagttaggtttgggaatttggtgcgattagtcaaatcgtgtctcgcttagcacttgcacaggtagtttagccaaggttacatgccagttattactccctccgtattttaatgtatggcgccgtcgattttttttatcaacgtttgaccattcgtcttattcaaaaaatttatgtaattatcatttattttattgtgacttgatttatcatcaaatattctttaagcatgacataaatatttttataattgcacaaaaaatttgaataagacgaatagtcaaacgacgttagaaaagtcaacggtgtcatatattaaaatatggagggagtacattttagtgcaagtgaagtgatagctgagtgagaatcttagtgtcaaagtaatggaggatttgggaaataaactgcgttcatgctgaattagacctagtgggcatttatacatcacaacacatggtactgttgccctttcctttttctagccttagtgttgtgatctatatatgccctttagggctaattcagcatgaacatagtttattctccattcctcaaatcatccattacttttgacacttaaaagtatatcaatgtataactgagggtcggtttggtttgttccttgctaaaattttggaatgccaaattttggtgcggcttattttggttgcaaccgcactcttaagacaaccttaccagaattatgggaatgcccatgatcctatgttgcataccaaaattttggtggcaaaccaaataatacctatcccatctctaccctaccaaaatttggtagtgccattacctgacattagcaaattttggtatggtagagaaccaagccagccctaaatcagctacaacattccgtggatttcatttgggataattggtgatatcatccatgattagattggcactctggaatttgccccatactagaactactcccttcgtttcatattataagacgttttgacttttttctttaagttgtaacttaaagaaatttgacttagaaaaaagtcaaaacggcttataatttgaaacagagggagtaattgataattaggtctagaaggtggcaaatcctttgactacccaatgggtggcatagaaaatggacgcgactccctgaatgttgtgtagatggcccaagtagattcttagggcgagttctaaacagcaaggggaaacagctacttcctcgtcctctgtgagcattgcttcccaaactgctaaataatgtgtttcatgcaaaagttctctatatagaggtttcttcaaaaatcaaataaatcctttttctttctagtttttaacaattaatattcaactaatcatgtgccaatggcttgtcttgttttgtgtgccataaaaaacactaggctcagttcggaatgagtgttggcttgaatttttgatggcacgcaaaacgagccaagtcattatcacatgatcagctgaacaagctgtagaagagatacttctgattagcttatctagtgatatgtagtttgggtgcattgtatattagtatatactctattcctttaataaggtgtattataaagtcaaaagactaagtgtatactttggccactagttactcataaactaatttgttaatgagtacataactaaattatatgaaaatacattgccgtataattctattcgtatagtttctacatgttaaatatacttgtaatttgagtaatagtggttaatgtttataagcttcacttatataaacttgataatatattaatattccttataagaagaaacagaggaagtaggtgatttgtttaatcagggcttgttgtatttcccttgggatagtgtggcttattgttttggatgttaatgctatctcaaattcacactggtgatacaaactttttatctcaaaacaaaagaaaattagcactctagtatgatggaatgcaattttttatggtgattatctattgatttaagataacaatatactatggcaaaaacgcaaaatattttagtatggaaaaccagttttagtgacagtcattatcagcatatgcacttctcctgcttggtactgaagtgttgctttggctacttgcttgaactgtattgacattatggtacacaaaatacacattatacctttggttacttgtttcatattattgattgattcatgtgaaataggaactgcacatgcaccgatgtatgtggagtcattgacatgtttgaatcactaatgttttgttattctccacagaatggtcttgccactaaggtagagaagtcacgtaagcagatgaaggaacggaagaacagagcaaagaagatccgtggtgtgaagaaggtcagtaccaagtatcaacccagcattttgagcatttatgttaacaatattgcaatagtatttaggtagcttcaacttcagtcttcagtgcgtgacctaacttcgtgttatctgctaattttgtagacaaaggctggagatgctgggaagaagaagtgagagatgatactcatcttgcagtcttgatgtgttcattatcaaaaccttgctttgtttagagctgtctccttgtggcaatattactgaatgcttaattataactagaaaaattttgccacttatgttcttgcaatgttgaggcatctgtagtgttcttggattttgaggaaatttgtcggactctagcatatatagtactttaatcacggcgcatgttctttgtgtcttctaattcagatttgggttatcctgtttcaacaatgcaatgcgtggcttgggtacgaggcactgcaattaagtcgtattttgcaaccaattaagttaccgtgattagtttacataattaaatcgacttccgttcggtaaaacaaacgaatatgaaatactccgtctctaatctcaaaatatgtgcagttttgtattattcacattcttatttgaaaatattttatgattattatttttattgctattagatgataaaacataaatagtactttatgtaaatatttttaaatttttcataaattttttaaataagatggacggttaaatattagacacggataactacggttggataactacggttgtacttattttggaacattttaggacggaggtagtaattgtttcgtgtcggcatcagataacagtacgttgtctctagttacacgagagcaagtgtgttgcttgaacattaggaacggtactgtcctaataatactgcaagttctcatccactgttgcaaatcgtcccactgggatgattttacagaaaccaccgtcgtatcattaacaggttaataagcagtgccagtttgtcgattaacctggtatgagatcaactccaggttgtttgtcagtgaaatcccaagggcaatttgcgactattggttccccatatacactagcagttcatcagttgacatgaaaaactcagaaaccagagcttccctaactgatcggaacacatagatgcatcttgcaggggataggaaaggaaacaactgatcaggatccacaagactagacgtaaataaactacgtcaaacaagaaaactgttccttctcgctgcaaaggaaaccatagacctgcttcaagtttcctctagatggtcttgcattaacagcatatttgcaaacaaaaaccagcctcttcctcatctccaacttcgtgacgtctcctttcagaaatgaattgccatgatcaaagaatccttggaacaaagagcaattaattaaagatacgtaaacttgatgtcgtgaaattattaaattgttggaacatacctaatcttctataaaaataatttgatatcgagagcattattatgttttgacatgatttaagatgagtagaaaactgataaaaatggcacaacaccacaaaattacctttttaattcaagagaagcaaaattgatacaaagataagtcatcttctaaaataaagaagttgtataaatatgcttaccatcgcaatcaaataatcgtgtaattatcgccaaggccacacagatgcttatatcctctcctgtaagggaaataaaacaacaatgaagggctcacttgtacaaagaactgtcaggcaaacttatggttttacttattacagcatgatgaagaaagcatgtgtaagctttttcagatagggaaatgtgctagctttaccattttgacagcatattagtagcttcttccctgctatcaaattcctgtttgcaaagctaactgcttttggaaggtttttcatcaacgaaaaccggtcgtcctttgatccctaatagcataaaagtacaaaatgatgacaatgtttacatactgggaaaactaaaatggtcagaaaaatttcacttaccaccataggtagttcaaggtaagaattctctgatgaagtcaaaggtaaatttgatgtgctgtcacagttcagtatacaatccacttcagctaaggaatctccaactgcatagatcatgcatacagaaaaaaaaaaactatcatcaacagtacgcctgcatcatatgaaactttgtatgtatcttgaaacaacaaatttgattaaaggaaggttctaactagttgatatctatgattctatccacatctacataatacaaaaacttgtagacaggctagcacacttttttgcagtatacagagatatgcataaaagaatgataaacagacccgctaaagaacaaaaaaaaaaaatcaacagatcaacgcagtacatgacaagatattgacaagaaagcacaaacaataataaaacaaatatgcaactgtataaataatcatgttttgtaccttggagagttgatgctactgcaaggtttgatgtcccaatccagaagagtatatggccatcactggaattttgtttgtccatagcagtaacggtaggaggatccgagtccattggttgcacaatacttgtatgatcaccattactgaaaggaccatcatggcttgaacacttcaaaggcttagctgtaatttggggagaatattcgcctctctgtgcacgatagaccctatctttttcaacaatatctgcaactaactgattacaaaggtctggtccaccatcaagcagatcatatgagtgcttccagaataatgtaggagtgagaccacgtgcccaactctcttcatcatctccagctccaggaatatagtgccagctgaactctgaagtcatcctttgtgtagctactgcaccagatgcagatgctgaaactaatatgataggggtgaaatcccatgattcaagctctggaacttcatttaaccatatccgtgtcctttgtgatatccacaatggacgtagtggtttcttcaaacttaacgcaagagaacgaatgtctgcaccacatgattcaaattgggttgtccattcctcgatacgcccctctatagcatttttctcagtctctagaacccatacaggaagatgcactgagttatcccagtttgatgattcagagatcttttcagcgtctttgttggctacagcagctgactaacatgcaaaattacaaaatatcatgaggatgggtgaacatggaaagtttgaaattcaaacaaagggacaaatgagaagaacaggaagaaaggatcatataacaggaagaacaggagacataaatcacattgtgaatttcaacagccttatttctgttgtttgcctttggttctctatagtgatcacttgggcccagattttggcatactctaaggatagtagttactagttaccaaaacaggcatcttatgcatttttactgtacaaatttaactatatcaatggaaagccgtgaaatgaggtacatgtgcacaagggttatttactgtataaatttaagtattaaactatagcaataaaaagccttgaaatgaggtaaatgtgcacaaagggaaagggtagagtgacataatgccgttccagtagaactataggaagccgatataccaaccacatccaaatccactccacttaccttgttgttagtctgcagccgatacctctcaattgctcggttgaggacacaacaccaaatgggtatggtctttgacatgctgtcagggaaacgtttccctctccttgttgaatcaacaattatgcaccctcctctctcccctgcccagagaaaaaatagacaaaaacaaattacttgtgttaaaggcattttgcactcatcaagcatcatatttagcaagtgaaaattcttgaaaaaaatcacaattacatgaattattaagctggatattacacaaccttccgagaattcgaattattcgcacagccacactgatattatattacttccttccgttaaaaagtttgaaacgctaacttttaatattggttgccat

SEQ ID NO: 78170 - DNA, 22320 bp, Oryza sativa
  unsure (1)..(22320): unsure at all n locations
gtgtgaaaccttgacnatgactgaacactggcacanagcnncataatgtgtttgaccattcgtcttactcaaaaaaattaagtagttatttattcttttcatatcatttgattcgttgttaaatatactttcatgtacacatatagttttatatatttcacaaatttttttaataagacgaatggtcaaacatatgctaaaaagtcaacggtgtcaaacatttcgaaatggagggagtattatatactgaaatgttcgaactatttgaccatggttattcgaaataactgaattagcaaacaatttaattataccacctgcttcgacaggtaaaacggattgcagtgctaaactctagttctagacgcctggattaaacatatagcatagtttagaccaaatacttcaacaatgagtaagggggggaaccaggagcagaccagcgaggagggcgaggtggaggttgaggcgggcggtggaaaaggcccagttgcccgcgtgcccatcggtggacttgaagtagcaggtggcggcgacggcgcggggcggcaagtaccagagcccgcagcggaggttggcgaccagcggcagcgccggccacagcgccgcgatctccgccacgaacgcggcgtcgtccgccacgctccgcagcgcgttgtacagcgtgctctcccgccgcttgatgcgccgcgccgccttgtagatgctcagcgtcgacggcccagcggcggcggcatccgctgactccgacgacgccgccgccgccgccattggagagacgagaaagagagagacgctggcttgtcctaatttgggctctctaaactggaaatagagtgggccaaaacccattaataattagcaaggttatgggcctaatttcgttctatatggtgggcctctttaaagtcatggtccaaatacggcccattttctgctgatggtggtcgttaattaggtccattctggatgatcagcctaacttcggctcgtcagttggaagacgaaatttttggggaataagttcactttatatccctcgagatagggtcgagtttaatttgtatccctcaaccactaaactgggtattgaacgtcccccaacatttaaagccagtgcaaatccagtgagaaaataataaaacaaatatgtgaaggacacatttatgtgggtatatggctaaaaaaatggatccccatctcataaaatatatggttcaaaaaatggcttgagaaattcacgcaacggttcgctgaggtgattgatgcagcccccatctcgttctctggcgagtgcaaggtgcagaaggcgcaccctctcctgctggtcaccgttgtccaactcctctcttgctgcccaccgcccacatctatggagggagaaggcgatgcatggaggcacgctggccggaggtgaaggaggtgggatctcccactgacatgtgggttttttatctttttatttgactgatgatatatggccccacatattttgcttaaacttttataattttgcttttagtgtcatgtcaatgtccagtgggatgaggaccaagtcaaaccagacatgttgatgttacgtcagttaaaatcgtctagggaccgtgtttgcactggttttagaaggacatgattcaaactcgacgtcaagatgagggagctgaaatgaacttattcgtagttattgcccatgtaaaattagcggtaggcttaatctcggcctgttgtttgcccaattttgtttttttaagagcatcctcagcagctcatccatattcgatcctccatatgcctatttagatggtcattaaaaaagattactcctttatatttctctcaactccaacagatcatccatattacatcctctatatcttatcctcttatattttaatagtatacttcaactaccatccatttatattaatttttcttttttcacctttcccttatcttcttattcaccattcactcgaactctcgagaagcggcgcaggagaagcggggaggaagtgaggagaagcgggcgaggggcaagcggcggaggaggaaggcggcgggcaccgggcgacggcggcaagtgaggggtgatagcggctggcgaggggcggcggcggctagcgggcatagggcgacgacggcaagcggcggccatgcgcggggcgacggcggcagacgagggaccacgcgcacgctggcggcaagcggcggccacgcgcggggcaacgcggcggacgactgtccaaatctggtatgtctctctccacgattcgctgaaaaaaaaaagcaaaaaggggcaagggagctctccttcgctagctggggatgacgacgatggaggtgaggtcgcgccagagggagatggtcactgaagtccggattagagcgggagaggcggctgttgcaaaatggcgtgaggagagagacactccatttttgcctcttctctcttctaatttggcacatccgctatttttggagtgcctggtagcgcatctgctggaagccggtttttccccttctatacgccaaatgaaagatggaggatcggttagagtagctgttggggatgctctaacatagccgacggtcatcagcccagcgccccagctcattaacatcaagttacgggtccaatttgtggcctcattcgggcccatgctaaattgtttgtagggcctcattcaacgaagaagttggcccaaatttctcctgtcaacaatctcgatgggcctaactatttcctcatattgtcaggcagtttgaaacagtttagtatgttattttgatcgattttgatcagtttgcaagagtggcatcttgattcaccttggatgctttaagcaggtctaacggttagccatttcatattgtctgtgcccatggtatggaccaagaaatgtgtttgtcatgctttgaaacattgcagagggtctatgctgtagcatatttttcaaaagttgaaactgactctaaagtccaaacattgacagcctgagacaaagatgaaaaaaaaaagcctcaagaagtcattagaccactccatgtgtttcaggatgtttgtttctgtccactacctcagctactctaaaaaaacatcctgctcacatattctaaaccaattacactgagttattaacatctagctagttaattacttccagcagaaattaagcactcggtaggttatcaatgttcgctcactgtcaccgaattgtcagcttgtcggctcactccctgaagttgctaggcagtccacctcacgaatttcctgtggttttcagaatgtgatttcctgtggttttatctgactgattttgaattgtttgtttatagcatttgtcctgattaaaggatactgctggggaaaaggacacattggagcaaattggttcaaccatatgcaattcagtcaaatgaggttatatatctgctccctatatcagttacagcttgttgcagagaactactggctcactccttatctaaaaaaaaaaagaattactggttcacttgttagacttaagtagcagttgattgatatctattttcagatcatgcctactacaaattagtttaaaacaattcaaacatggtcctcgttttaattgattttcaagttttgctgcgctttcttgcaatttatatgcatatatttaccagtgtgttggatgtcactatccaaaggatcttattaaataaagtgcatgcaaaatgatggccaatattaatgataacagcatgtttataagtttagtagctagactaaaccaccgtgtaaactgcactgattttattttaaagttgtcttaaattaaacaagggagttattgttcaacttactccatatcttggccaaatttggttacctgaatatttataaatctagctaagtttaaaatatccatttattcatctgcttaattttttttcttgatccatagatttttattagataatatagatcaagcatcttctgactcagaatcaataatcaatttgcaatgaaaactgcaccagatctgcttgatggccagtccatacgtccatttcccggttgccattttttggcgccatccaagctcgtcaaaataaagctaataacaaatacatacgtagatgcgtgccatcaaaattaagtcacattatacaacgaggaatcatttgtagttgtctaagaaaaagaatcttttgtattccttcatacagtactatactttataacagagagctgatctgtttagaattgtgttccatgtttctttatgccactcttctctgaaccgctatttattctagatctgattttcttcagggattttagggaatttttgtacaggacaagacagcagggatggcacgagatgcaactagggacaaatgcagtgaaaacctataaattatcattagatttagaaatggatgtatgagatttagccacgtcacccagagtgaaaaaatttactccaagatttaagtatgaataatttttttaatggctctttttttttattcaacgacagtttctaggttttcaatacatatatgatttttcactgcatactttcccgtaaaactttattatactatgatatccttgatataactagcttgcttgaataaattttcattatattttaaaaatccgtgtagtatggccaaactacgcacgcgacggtgtgaacttgaccgtccgtctaccacagaaattcagagagagagagagagagagaataaaaaagagaagatgtaacatgcatgttgcatagatggctacgtaccttgttctatccggtgtcctgtgctaagcttttgcagtccagattctcttcttgttgttctaaattctaatcaatccgtttgccacatgcatatgcttcacaggctgcgactctctcaattggtccaattatttggtcgatcgatcgacaccggcgctggcaaacggattataaagaataatcgaattgtgttctgtactgctagctagctgttgtgtatagcctttgtataggcttgtagcgcggggttcctccacgatacgttttgagatgtatcgcactaggcaaaagtctcttcattatctgcctctcaataatctacgtacttgactcggataatcccatgtttcatggtcagcaatgtaatggaagtggcaatctttgaacagacaaatcatcacaaaaagaaattgagtatattgggctttataatttttaacaccacacatatatcttgacaacatggtttgtcccctttacattagtgacttaattttcaccggatgggaaagggacactactaaaaaaccattttcccatacagacaaaacctatttttccatgcggttgagctagccgtctgcgtcaaaagttctacgaaaatagcgatttttccatgcatatggcacatccacgtgtgaaaatcatattttcacatgtgggtgcttatgtcgttcgcatgcgtgcgaaaacaaaatactgtgaaattttttttccaaaaatcgaaaccccaaaccctagcccgccgccccctgcttcttcgtcgatgccggccgtcggaggctgagcctgccgtcaccgaggtcaccacagccaccgccagatccgcgcgcatggggagcagagcgatggctggatccacacggtaggaagagggggtgctggatccgctgtcgtcgcacccgcagccgccctcgctagatcagttgcgctacaaccagaccgcacacgtggggggggtgagcggaggccggatccatgcgggagggaggcggtggaagaagaggtggaaccgcccagcagtggaggaggtggagtcgtgcctctcgcccgccggctcccagtcgcctcctcgttggcagtggtgccactcgagatcaccgagccaactgccgccactgctcgcccgcccatccgcctgctcggaggaagagagagagagagaaaggagaggagtggtaaaaaagtttgaagtgccttagaggaaaaaagagaggaggggagaaaaaactttgtggaggagggggtattttcgcatgcagatcactcaagaggtccgcgtgcaaaaatctattttttcatgtgataccttaagaggactgcatgtgaaaataactcattttaacacgtagcccattaacagattcgtctgcgaaaatagatttttgcttgcggacctcttaaggagccgtatgtgaaaataaaagtcgatttttacatacgtgaccaatttacggtccacctgcaacctataggggtcctcgtacagaaagaacgccattagctctgtcatgttggatcacgttgtcagggttacagataaggcataccttctatcctatgacttatcaaatataccggattggtatacctcatatcctacgatatgtttccgtatgcagtaaggaaatacacaagatattatggaaaatatcctcacgggctagatactatcaaaatcctactcggaaaggataaggactattctatattgtgcagggttcgttgtctccgagttctacttagagactaaggcaactcatagtataaaaggcacacccccggaagggttcggatcatcaaatcatagcgccgacacacccagcatagtttacgaagccgaaggactcaaaccaaagccaccgggagatctcgtcgaacaatctcgacaaggatctcgccgatatcaacgagttcatttgtccctttgtactatgtggttttccatatcaattccatattaaactggattagggctgttaacttacgaggggcttgaaccagtataatctttgtctcttggctgcttcgatgtcgtattatgtagatcctcataccaacgtaccccagtaccctatttatccggtctacgaatattcccgtcgacacacgtcgtcgatgatattggcgtcacaaaaatatccattcatagaataattcttttaaggatctatttgtaaaatacaatttttaaaacgaccaacaggtgaaaaatccagcagcaccgccgcgtctgaggctttactatttatttatttttgttttttccggggttgtactactttgtagcgcgtgtctgggcgatggcgtacgggctcgtccatacacggaaaaatcaaaacgatccaatttcggaagcgtgccggtttgatgcaggcgtagctttttgtgctgatgtaatttgtcgcattagttattagtcatcgctctacgtacgtacctgacccgaacggtcacgtactcacgtatgtatgcgcgggtgccttacgtacttcctccgtttcacaatgtgagttattttagcatttttttatattaatattgatgttaatatatatatatatatatattcaataacatcaatatgagaaaatgttagaatgacttactgtggaaggaagtagtactcaacgtgacgaaagcaacacggtgtgatctgcggtttagtttaatttgcgtcgtgtaacatggttattaatttgtcacaacagtactacagaaagacgtataaaaatgatactatagataccgaaacaaataaaaccgatatgtatagtgctgttctcttccacatgaatatccgtgacaaatacatgtatctttcggtataaataggtgttggtttttataaaaccgatatcattcttcttcctttagtgggaacaagatacacatgtccacaattccacatgtagtttaattaggttgagttcgagaggtgaggtcgggaactcacctttcgcgcacgtaaaatggagtgacatattttctcatgattaattaagtatttactaatttttaataatggattaatatgatttttaagcaatttttatatagaaaatttttacaagaaacgtaccatttaatagtttgaaaagtttgaagagcgtgcgcgtggaataggagggaggtgagttgggaactcactagaaagaacatagccttaggtagggcaagtgctataagcatctaagtacaatcccatagatgccacctaagcttaaatgatgaggtggaggagagaagaggggagagagaggatgaatcacccctcatgcaaggaacaatttcttaacaaattttaaggaagaaagagaaaagagtgagactgattggatgagagtggataaaataaatagttatgtgcattaaggctagtatattagaggcaatgtggtatatgagatgtccactaatattatatgtgacaatcacatctaaacactactacacaaaagggattcggtgccggttgggaatcccctttggaaaaccggcaccagagaggcggtactaatttgaaaatcaaaaaggtgctggttacttagaatagacaccttttaggttcaacgaattaagaaaatgccggctcgatgcgtcggctcgatcgagccgatcagccctccttccacatccgcaagaacagaatgaacaagaaaaaaaattggcaacattcatcccacaacattcaaagatggattcatccacatatcaaattttggcaacattcatcccacaacacaaattttagcactcaaatttatgcaataaaaaaaatcacacctcttcagtcatcgttgcacggtcagtcgtctttgagacgtcgcgccacctcccgtcggtgaacccgccgctgcatctcctccacgatcccgtcgcccatgctgccgcctcccctctcactagatctagcggaggggagggctcctccctgcaggcaagccctctgttgcctcccctcctcgagcccgccacctgccgccaccttctcgagcccgccacctgccgccacctcctcgagccctctgccgcctcccctcctcaagacaccccgccctccactgagccggatccagccaccctgccctccgccgacctgccggccccacctacagccgacctcgcccgccgctgatgcctcccctcccgccgcatctggcggaggggagggcgcggtcgccgctgccgcctctgtcggccagccgccaacaacgggagagaagggagggggagagagagaagagagcgagagagaagggagggagacagagagaagaaaccttatctcctcgcgtcgcctcgtcgtggtggggcccaccggctcggcttgatttatgtgggtgtgtcagtttttaattaaccgacatctataatatattttaggtgccgtttttttttaaaaaaagacacaaaatataataggtgtcggtttttatttagaaccgacacctataattacttaaaagtgccttttttgtgatttcaacccgtggaggtgggaaaaggcctataggtgctggttttagcactaccgatacctatagtggcgatacctatttgatgttttgtagtagtgaaacttgccttagcccactcccatccacagttacttttttccttttcttttttgcatgaaatagtttcaatcctgtatccaacattgtcctccaatattgctgtagagctttaggccggattgagaggatacggtgaattggaagatgttggagatcaatatgctggtgcggtgcagcagagtagtagccagcctaacatactaagagcaagtttaatagtacagcccactactagctccaattcatttatagccaatctaatagctaatttatacaatagttgcttactatactattaatatatggtcccacatgtcatacacacattgcgtcttggagtccatgctgcagctggctacagatctatagcctgctactcttctctctcatccttatctcattaaaatatatttacagctggctaatagcctgctattgtacctgctctaatgcacgtagcgcgtgtgctttttgcatagttgcatcggtaatacgcggcactgtaacgaatgcggctggtgatgatagatcaaccgtacgtgtaggtcctctcaaaaaaaaaaaaaaacgtacgtgtaagtgtaacttgtatactcaaaatctctatctcacatgtacgttacatataccctataaaaattcaatataatacaataatccctcattttttataattttatattataagttgtttgactttttttctgttaagtttaactaaatttatataaaaatttaacaacaactaaaataaatctaatattgaatatattttaacaatatatatgtttctttttggttgaaaataccactatattttccacacaactggcctggatcggatagatacgatcagatccggacgggccggcctctcaacgtgtaaaaaatcactggttcgacctacccaaaattgggttttgcagggagccatccagctgcacataccggacgacccacgtatggctctggtcccctcccccaggcgatggacgacggtgactgcacagtgatctcatccgatcccatcttctgtgcagggatagatggaggatgatagctggtagctgtagtacgtggccaagttgcacttgtttgtactgcacattgtacatttgtacccacacacatacagtatatagtgccattgttgatctcgatttctcgaatagtagtagcaacatatatacgcattaacgtggcacgaactatttggccaatctttgatggagaggcgaactttggctccttcattccttggatggaaaaagctctcgcgatcgcgacgctgacattctctccggtagtggtagcagtactagtactgtgatgcgcagtctggcagtgatagatcaaggggtgctgccaaacagctcaccccgcaattttcctggtaaaacagtactccctccgttttaatttcaagtttgattaagtttacagacaaatatagtaatatttataatactaaattagtttcatcaaatcaataattgaatatattttcataataaatttatcttaaattaaaaatattactattttttcttacaagtttgatcaaacttaaagcagtttgactttgactaaagtcaagacgtcttataacctgaaacagaggtagtacatacatgcatagcgctagaatttttattgattattctaagaaattgatgtgtgcaaagtttggaatgcacgtagcatcagattcgtattttctgttgtgggagtttttaatttatcttggtggacaaatatggatgtggtcgtgaaggagggaggaatatggtatggacacatatcattcaatcctcatgcgaaaatggtggaataattccacatgatttttaaggactagaaatgaattgaatgaaaatcttgtaaaattcttgacttaaagaaacccttatccatatgcataaaatttgatctcatagctagaccaaactcatttgtttgaacagagttcaaaatctttaatgagaattgctcaagcctatgattcacttttcgaaaaaagtgagagagggggtggggagggggcagtgttccaaaaatagccgtcgcctttgccgattgttaggtgctcagcggcgagtccctacccgcgatttgcccctagtcggcgtgctaggcggactagtcgccctggcaagggtttggtgctgctcggcggacctcgtgcggaggtcacacatggaggcggtggggcttgatgcttctcagataagctcgtggaagtcttctcgcacgtggcggcgtatgtatcgatcaggaggagactagaaagaagaattataatccaatgacctttatacatcatggcccagttggcccaggaaaacacgtggaacacgagggttttctcttaatctggtccacccctcctgcatggaacacaaggaacacgaggggcgtctttgtcttcctcttgtagcgaagggcatcgacagcggtgagcacggtaggcatcctcttatgtcgttcaaatcgtcttctttccctcttcttataccctctttctctctgcttttctccatctccctccccagcatggccgatggtggtgtcgcctccactagatttgcccctctggtcctccttctgcaagtctacatggtcttttcccctcctagtcgctgcctcgacaggtttaggcgctaggcactggttagccgtccgaataaaaaacagagaggaatttcaaaggatttaaatcctattggaaaaaaaaatcatatgaagtcctctggaacaaaggattgggtcactagaattctgctgaaattcctatggaatggcatgtttttttgggaatttctctaaagttcctatcaagagctccaaggtcttggatttttttccatttgtgtctatctctcttctaaatcgtgtgttttttcttaactccatccaaacattttcccgtgtagttttcatgtgtttttctttccataggatttaaggtgcaataatattcgaatcttacgttcctattcctgcattttaagaatcctatgtccaaaggagtatagagtgcttagggttagttcaatttactagttcataagccattccccgcacagaaaaatggtagctcattagtgcatggttaattaagtattaactaaaaacatttcaaaaatattaatatgatttttaaaacaacttttctatatatatatttttaaaaaaacaccatgtagaagttcagaaaacaatcgtgcataaaacgagagagcaaaagatgggaaaggggagtgcacaccctaataccacatactttatgtagtatcaaatcattaatggttcaaatctactacagattacaaaatagacaaatatattatacaagttgattccacatcatctagatatgatttgaaagattatatatatagacattagcattttgaaccactgtttatgcccttaaagggtatcatttgctcgctttagaaaggtgagagcatcccaatttttttcacaactcccctatgttaaaaggatggttgtggtatgtgtgcttcttgatctatggtatactagcaatcatagcatcccatgagctgttttagagaccaaaccatgttctggtgattgcaaaaataattctacttcattcgatttcaaatgcaaatcatgttagccattaactattttctaaataaaaaccatttacagaacatctagtcattctttaatcttttttcttggtaaataaaatgctacctactcaccggtaaattttttgaataagacgagtggtcaaacagtacaagcaaaaactcaaaatcccttatattatggaacagagggagtactatagaagcaattatattttaggagcgagggattagtgtaaaagaacgacaacaaaagccactggattaattttcttaattcctatgagcaaaattaaaatggcaaattatctgtaatcatgacagttaaaatagttatcaaatatattaataggttacaattgaacttagagttacaatagatgctatgaggtggagtaaaaagtcaaactttgtgactcaacaactctttaaatagagaagggaatgtcacaacgtaaccatgtcaactggaatacaatatagcgtagacatgcaggaagataatgacgacaaggccataaactcgtagcggagatgctatgttgatttagaagaaacgcctatagttagaaccatgagatatgggttcggttgaaccccgttaagaaatatcgtgcgttcctatatcataatgtagtatatctgaattgaacaatagttgcagtgatcggaaatgttagttgtcattttgctatatcttgctatatcaactaacttttataacaattattattttattggcaactagttatagtcccgtgcagtcaagtgcattgcaacgatttctttatccaatttagtgaaaagatttgaccagagtgggttgattggttttttatatcatgatcggattcttttaagaaatcggtttttacatgaggaaaatggtttcttttgagaaagtgagggaggggatgaggggtggatgacttctttttaagtactccctccattttaacaatgtaagtcattctagtatttcccacattcatattgatgataatgaatctagatagatataatgttagaatgacttacattgtgaaacggaggtagtagtagagagacagtgataatggttggattttagaaatcaggttttatatgaggaaaattttttttaggaggaagtgagagagaggatggagggatatactatagagataaagataacgatagaaataaagataatattctgccagagattccacttcattaatacttcggttccacattccacaggaatcctgcaatgaaaaacaaaaaaaactgaatctctccaaccaccattgatttccgatttcagagcccatatttgacctccatgcatttgcaatcaacaggttaaaacggaagccgcgtccattcaaatcgcttcgataaattgcccaaaaacaaaaaaccgaaaccaaaacagaaaaaataaaaggtgaacgagggaccctgccgccatacgcgtcgagtaccattcacttgtagtgtatatatactgccaccattcactcgttccccccgcatcgcatcctctccccacacaatccccacccggcctagcgagcgagagagagggaagggttgcgacttgcgactcgcgagcggcgagatggcgaaggacgtggagatggcggtgcggaacggagacggcggcggcggcggcggctactacgccacccacccgcacgggggcgccggcggcgaggacgtcgacgacgacggcaagcagcggcgaaccggtacggatcaaacccgaccccgacccctcgtgattcccccgtctcgttaaccctcctcttctcctccctccgccatggatgatgatgtggctgtgctgttgtgtttccgtgcggtgcgtgcgtgtccttgtggtggattggattttttgcggtttttgcttcctatttttgggcgcatatatgcccgctttatcaatctcgcttagagtcgagtggatcatcctactcatcaaaagggaggtctagaaacacggtgcacgcgagatttctggtagggaaaactccacgaaaagttggttcaaattcgagacaaagtagttcgaattcaaaaaaaaaaaaccgaaacgtttcaagggatcggaaggcgtgaacaaccatggtcctagctggacccttgtcatctcctcggtttctgttccaatctagcgagcggcgcggcgccgcctcggatggatttttggttggtgctgactgcttgacttctgcgttttcttcctcccttttcccggaaactcccatggattttggttggttggtggcgctctggtgcggtaggcttcgtccatagccaacaccgccaattaagccgccatgaatggacatcgttgtgcgtatgtatcgtggtaaaaaaaaatcgaactacagtgttctctgtgaagtgaaaccctggagaatttttactgcgttcaagataaacggtgtgcgcttttttttttgtgtttgtgtttccctttttgggttccccaacggagcgcatgcaagcgtccggcgacgtgtacgctgggtttttttttccagcacttcgtctagatctgtctgttcctagagtccaaaattaattaattaattaattaagtatgtagaggttcaaaattaattaattagttagtggaagcacgggaggtatggtggtggagtcgtggacacttcacacattaggattaaaatccgtgcatgaattttagtgagatcaactatatatcgcttcacccatcaagactaaaatcccgtgttaaggcttgtttagttcataccaaaattgaaagtttggttgaaattgaaacgatgtgacagaaaaattagaagtttgcgtgtgtaggaaagttttgatatgatgaaaaagttagaagtttgaagaattattttggaattaaacacggcctaaaattttaatgagatcagggatatatcgctagtttattagttttcatcttttagggcatatattagggaacatatttataaaaatgtgtgggttttcgagtctatttgaattgtttccctaccaattttttgtagtgccaaaatctaggcaagttttggcactaccaaatatttggtaaggtaagattgttttttatcatatttggtttgctacaacatagagtcaaaatgtgaaattgtagtaaagaatgttcataatgccaaatctatattaggtaggagtaccaataaatgggcttcaattcaaatcaaacacaagtactatttaaattaccaaaatattggtagggcagtttttggtagcaatccaaattagcccttcatcttttagtgtttcatgtgtatgtgtatgtgctatctaatcgaaaaaaaaaattagttaatcaagaattaactaatttttatatcacgtgaataatttggcttgcgccgttccgcgtcgtgcgcgctgtcggatgctggatgcaagaggccagagccaaccatccacagcacctagcacagcagggggtcgcgcgctggtcaacagccgcgtacccccacggtcaacgcgcatcagccactcgatctgaggcatgcacggtctagatgatgccacgttcgcaataaaagctccccctgatcaacaagtgacgtgctgtttcacggagtgtgacgtggcacgggcagtatagtacgtgtacgtgtgaacacacgcgcatgcgacagcgcatttccacgcgtgcaattctgactcgcaaaaagcgtatagtagtactagctgcttttttgcaatttgtattccttgaacggcacaacgtgtttggtggaaaattcataaaagtcaccgtactttttgacgaaaaacggatatatgcttggttgagcggtccactttaagctaccaatatcgattatcttatcgttagtcagcttcagtgagatcatatctaaagtaactggtgctgaactcgtcaaggaatcattccggcggcctgaaagcccctctttggatggctctgcgcctctgcctggccgcttccgatcggccggaatctatgtcctcgtaccttttacgcagcaccaactgatgattgcgtgctttcaacatattttggtttggaacgcagtgatctcgtattttattcgaaatgcgtaaaagctttgttgattctacggaaacgctctttggtttgtagaaaaaaaacccttcatatatcttttcctttgaaattcctttgtaatgacaatcttgtaaatagtttggaatttttttcataagataatatcatccgacgtgactagggattttaagtttttgtttgcgaccacttatcttatttaaaaaatttgtgcaaatagaaaaaacgaaaagctgtgcttaaagtactttggataataaagtaaataataaaaagaaataataattccaaatttttttaaataagatgagtggtcaaatagtgcaaataaaaactcagaatagggacggagggagtagtttctaaggcctggtggtcggcatgaaccaatctttttttttttctagctgtacctaaacacctgttttaaagttttctttctcgtagaatcatactgtatgtagaattgaagaaactatgccatcctattcatgtgcttttacatactcttccctattcttatgttttgagttttcttccttctagagggcccttgtttctctgtaatgtgaagttctttagtgccaactgccaagaccttaatcacggactaagggtctgtttagcggagtttaaaattctgatcaacaaccagctggtagccaacttctaagaatctggaaaaattagattctataactacagcttctcagaatttataccaaaaactgatctatttaggggagattctgattctggaaaaagctgcaggagctaaaatctcccttaaacgggctctaagtggatccactatatatatagtggacttttgtcttatctcagttctttcaacggagtactaggcacagcccatattgtgaaggagaagaaaatggccagaccttttgactgcgaggcatgggctggatagtctttgggatgaggtgaccgatgcgagggtaatagatgcgccgtagacctgctgtttctgaccttttggcgcacagctctacgcacgacaactctactccgtgtaggatagtgtaggctagtgtagcggtactgagtattccgtattcgtgctgtacaaccgtggtgtgctccctgcgtacggtggtttggggattttttttcacaaaatatgtggattttttaaaaataaagctatctaaatcttgcggagttattggaatggtattttttgggataatttttcatgacaggtattgtgcattgatataggtagtgggcctttttgaatggttaaagtgaaaatatttttcactgaacgctttctaaacgtcaatgcatttatgaatagagtagagagtactatggagtctgaccttctcagatgggagactctctagctaccgggatgatactagacctttgtgttcatcaagagatcacatgttcacatgtgtaggccctttatatatgttgagttgttgacttgtgttcttcagagggtgacagtctccatggctcaatgatttgtttggaattgtctattctgtttcagttggcatgggacatgggtcttgtactctgtcccaaagtgtgcatgtgtcctcatccgattaatcaaggcactgtgttaatcattctttagaaactcattaactgtatgcatacatagactgattgaggggctacagatcataaaccatggatgcatgtgggtattaatcattttttaccctcggtttggtgcatgctgtcactaagtggagtgaacttgttcacagttgagattatgagtaaatatcaaggagacaagaactgaaattcgaaaggaattaaagtcataaatgaaatgattgaattttcagaatgttgaaggactgaaaacttgtgcaattcgttgagcaggtaacgtatggacggcgagcgcgcacatcatcacggcggtgatcggctccggcgtgctctctctcgcatgggcaacggcgcagctcggctgggtggtcgggccggtgactctgatgctcttcgccctcatcacgtactacacctctgggctcctcgccgactgctaccgcactggcgatccggtcagcggcaagcgcaactacacctacatggatgccgttgcggcctacttaggtaaatactattccttccatttcaaaatatatggagctgttgactttaatataatgtttgttcattcgtattatttaaaaattatataaatattatttattttgttgtgacttgttttatcaatatagaaactagtcttaacttatacttttacatatttacactaaaattttgaataaaacgaatgtcaaacgttatacgaaaaatcaacaccgtcatacattttgaaattgaaatggaggtaggaataacaagctgtgtctacatgaacatcgatatgcatgcgtcagagaatttagaattttttctctgaattcagagatgtcatacgagccttgttgctgttcttaaatatgcaggtggctggcaagtctggtcctgtggtgttttccaatatgtcaacctggttgggacagcaattgggtacacaatcacagcatccatcagcgcagcgtaagttctgaagaattgatctgttcataaatcacaatggcatactacaattctccattgctttcacaactcaatgctatgcacggttctgacttctgaggttaatttgaatgatcttctacagggctgtgcacaaggccaactgctaccacaagaacggccacgatgccgattgcggtgtctacgacaccacgtacatgatcgtctttggagtcgtccagatcttcttctccatgctgcccaacttcagtgacctctcatggctttccatcctcgccgcggtcatgtcattctcatactcgaccattgccgttggcctctcgcttgcgcgaacaatatcaggtgaagaaatctttctgaagatggtatcagtgtcactgcatatatagtttgtaagctttctcatcatctccatgtgtctgtacaggtgctactggtaagactactctgactggcgttgaggttggagttgacgtcacttcagcccagaagatctggctcgcgttccaagcgctcggtgacatcgcgttcgcctactcctactccatgatccttatagaaattcaggtaagctgtgcacagcaaagttcagagtttgagaaacatttgagcaacagtcacaaacatgtctcagtttgtttgcttgcaaggtttttaagtaaccgatgatgagtctgaaaaaaatggcatttgaaattgcaggacacggtgaagtctccaccggcggagaacaagacgatgaagaaggcaacgctgctgggggtgtcgaccacgacggcgttctacatgctgtgcgggtgcctggggtacgcggcgttcgggaacgcggcgccggggaacatgctcaccgggttcggcttctacgagccctactggctgatcgacttcgccaacgtctgcatcgtggtccacctggtcggcgcctaccaggtgttctgccagcccatcttcgccgccgtcgagacgttcgccgccaggcggtggccgggctcggagttcatcacccgggagcgccccgtcgtggccggcaggtcgttcagcgtcaacatgttcaggctgacgtggcggacggcgttcgtggtcgtcagcacggtgctcgccatcgtgatgcccttcttcaacgacatcctgggcttcctcggcgccgtcgggttctggccgctgacggtgtactacccggtggagatgtacatccggcagcggcggatacagcggtacacgtccaggtgggtggcgctgcagacgctcagcctcctctgcttcctcgtctcgctcgcctccgccgtcgcctccatcgagggcgtcagcgagtcgctcaagcactacgtccccttcaagaccaagtcgtgatcccgatcacgacggccttttttttttgcttttgcatcctgatgaaaaaagatttcagaaacatatgcacaacaaatgccggaagttagccaagagtttggtcaccagctcggtgcgttggtcggtcaggaggaggagggttcaacttgtgtaggttaagaaatgctagagagtatggagaccatcttcgattgctgctcatgtatagaaaaaagaggaagcttcgtattcatgtaatgaatcggaatgtttaacaaacaaggcttgttctgaactcttctcagggacaggcatggataacagattaaagataaatgaatgtgttagacaagggcagattagaagcggctcttaagcttcacacaatggttttttctctttcttttattaatgaaaccaaagcagttgaacaattgagcaatatgattaatgagaaacgactggaggtctcactcctctttataaaattcgatacagaagttcttgctctcatatctaaccttttttttatatatatatattttgctagaaattgctttggcagtgtagaggattgtaccaacccaaaaacatgtcactagtgtacttatgcgtgatgatgtcacgctctcaagttttccccttcttctttccttaaaatttgttaaataaatcatccgaagaaatggtttgaattaacctagagctaattccctaattaataaatgcaattaataattggaattggcatcgtgggatttttcttgggttccacatgtcgcaatgcattaacatgatttttagcggaattttcagagccctataaataatttttaaccatttaaaatcatcaaggtgcaattttaatcccaggaaaatccttttcctttttcttttttcttttccttcctttttttctcttgatggaccgtcggcccatctctctcccgcgcccccatccttcttgctgggccggcccaagccgccttccttctcttcccgggtcaccgacaggtggggcccacctaccgccgaaactgcccacgccgccgcggttttccgtcctttttcgcacccccacttcgtccccaacttgtgcccacgtngttggcctcttccctctttatttacacccccacgtngccggacaaataaggggacaccccacccgtttgcgcccttctctgcctataaaaagaaatccccgagtgtaatctcttgtttccccaattggcgcctctccatacttctaccgcgccacactgtacagttagttcttcgaccgacgcgaccttcgacgtcttcacatgatggaccccaccggctatgaaacaccgccttaacttgggggttgttttttgcat

SEQ ID NO: 78171 - DNA, 2182 bp, Oryza sativa
  unsure (1)..(2182): unsure at all n locations
cgggccttgaatggcatatcagatcgtacagnagctcatcaaggagaagaagaagagaagagagaagagagaagagagaagagaaggagaagagaagagaagagaagggaatgaaatgtgcagctgacatgtgggccccacatacttttttatttttttttgactaggatgccacatcagcaaaaccacccatatatactacctagggacgttgagtaaacggttttgtatagtttaggggtgaagatttctggttttgtggttaaggacgttaaaaatctcgctattaaattgagggacctctggtgaacttattccttccgtaaaaaggaccttgatgactaagtgggctccgattctagggccatacccaaaacccagcccaagattcgttttctgcgttgtgatttagcccataaagaccacaggcagacaggctcccactaccactaacgagaagctaccctcgagtccgacggagaaggggagggctaccgccttctgcgccgccgccgccgccgccgcggcaggttggccgcctccgatcgagtcccgctggggtgaggtgagctcagcactgtacttcttgtgcagtatttttggtttcctagatttgcccggttctcgcttggctcaaactcgttctatccctagcttgccccggcgcccgccgcttgttcgacaaaatggctgaccggaagaagtgcaaggcggcggcggtcgccaccacggatggcggtggcgaggaccgcatcagcgcccttccggacgaggtcctccagcgggcgctctccttcctgccctcccgcgacgtggtgcggacgtgcgtgctctcccgccgctggcgccaccagtggaagtccgtgcccgccctgcgcatctacgcgttcgatgattgccgggacgtccagcacctgagtgatttcgtcaccaactttctgctccggcgcaaccggttggctctacatgaatgcgacatcacatgctttgacgagggagacggttgtgaggtgttcggggagaacgccagacagtggatccggtatgctgtatcgtgccaagttcgggtgcttcgtgtttctgttgaagcgcacacccgtctatttggtgcgcctctcaaagcccagcgtttgaagagattagaacttttcagcgtggagttgggggccttctcccttgatttctctagctgcagggagttggaggagttggagctgggaggttgcatcatcaaagacaaagtaaagcagatcttatcagaatcattaagacgtctgagaatcgaaggatgtgattttttccgaaatcgcactcgcatttcttgcccaaatctcatttccttggagattaccgattttaccttgtacactccagtgctcatgagcatgccttccttggcatcggcatttatcaggtttggtgaacactgtgctgattcttgtgactgctactattacggcgaatttggtcccgattatactggatgccatcacagtacagttaagggcaatggcactgtgcttctcaatggtttatcagatgccatccaattagagttgataagtggtgccggagtggtacgcttgagccgccctataagaactcctagtgttttttgttgtcagctacatcttgttgacttttcttatccatccaagagaacattaagctttctacaaaacaagctatctaagtgtattgcctgtttgttgccaattaacaattgcggattatcattatattaacatgtaaacatcctttacagttgtttctgacatcatactatattaaactgtgactagcagagcttaactagttatccatgttaattttcaatacctggtatatcatgttcttgtttactatgtcttgttcatcagaagatagcaaaaccaagtacaggttataaatctctgcatcttcttctacctaataattacttgaaatataaaaaaacccctacacacagctcctgttcaatccagtatttccaaatctgctattatgaagttagaccttgaatttattctcatcaatttgtgcattgtccagttcattttcagaagggattttagatgttgccctacatttaacaagctgaaaacactgttgctcaatgaatggtgtatggctgatgaagtacttgcagtaggnggcgtgtcaatcgatnntcaatgcccgg

SEQ ID NO: 78172 - DNA, 30621 bp, Oryza sativa
aaataagcaaccatttttgcctctgaatttttggaaattacatatgaatcatagtaaagatcctctggccggaacttccttgtattatacccggaaatttcggtcagccccttctgcctatcagaagcccggaacttcctgacaaaatgtttgaaacttcctgtcttacagggcaggaacttccggtcattttgcccggaacttccgggtgtctgaccagtgaagggacaagtcacctcacttgcttgtggagctttaccttctctcacaaacatcaagcattctttcccatttaccatcacacgcttagacacaggacttccaccagaaaacctgagcccgtgtccatccttgttaggatgagcggtgatggtcttgtaaagggcatcttttgaatggtatgtcttcatgcatccatatttcatcaatgtgcccaacctttcattctctttcttaagagcttgcatagcatcaacattagtatcataagagttcaaatcaatattgtaacacctagcacaaccattactagtagatgggttggaaggattagaaaccacatttggttgataagtgctatttgaaagagtgtcaaattgaacttcaagatctttatgacttttgtctaaattagcaaatttgtcttgaagagtttcattgacatccctaaggctagctagagaaccattagccaaattaagctcattagctagttgttcatttttagcacattctttagctaggctctcctctaaggcatggttttttttcttctcaagaataagcaattcttcttgcctttcgagtgattgtctttactatccaaagctctcattaacttagccaaatgtggtatagcgtgtttgctaaagctcttaagcacatcatctaattcattatcactttcctcatcactagaatcaacatcaagagaggtgtgagagggattttaagtcatcatcttgcggccttgtgccatgaaacatgagttgtggcaggagtcgtcgtcgtcatcactcaagttgttgaagagatgctccttgctttaagaggatgacttgaaggtgacggtagcaacaccaccttctccttcaaccttgtcttttggcttgggctagggcttgacttcggaatcttcttcatctccggagtaccacacctccgccatgtgtgcctccgccacatgagcacgctccggcttcttcttgcctcccttaaccttagcttcatttgacttgggacaatcggcaatgaagtggccatatttgccacaattgaagcaagctctctttgattgcctctttcccttgtcatcttccttcctccctttgccatagccactcttgcgaagaaagtgcttgaatctcttgacaataaaagccatctcttcatcttcactttcttcataacttgactcttcttcttgttttgccttcaaaaccacttcttgatttttgatcatggtggcattcttcaccatttgccttacttcacgagcttcctcttcttgcatctcatgacacacaattcttccaagaatgtcacttggggtgagcctcttgaagtctttcctttcccgtatcattaatacaagagtgggatttcttggaccaaaagcacggagaagtctcttgaccacaaagtgatttgtcatgtcctcactcccaaatcatttaatcttgttaacaaggatcatcatcctatcatacatctcttgaggtatctccttgtcatccatcacaaatcttccaagccttccttctaacaatccaatcttggcctcacgaacggcgggtgatccctcatgagccaattgcaaagtatcccatatctccttggcctcctctcccatatctccttggcctcctcaagtccatcaaccttgttgaactcctctggattcaaggcggagagaattgcattggaagcttgagcattgcggtggatgagttgctcactccgaggtgagctccatgtcatcatggggtacatcaatacctgtacaaacaactttccaaatacttggatgcaaagaaattagatgcaacttcatcttgtgcttccaagcggcgtaatgtgtcccatcaaattgaggaacacgcccggaaggcacggagacaaagttatgaggaggaacattaagtttgccgtaatcaaagtgaatagtagctcccttgggtccagtatccttggtgctagaagcgtctcccttgtcatccaaccccccggttccctctagatgcgacatcgtggatcactccaagcggtgaaacttgaatcaagagcaccttgctctgataccaattgaacgtgcagagatgtagcctagagggggggggggatgaataggctttcctgaaattttctcaacaatcgcagcggttaaattgacagggcccgaaacctcctggtgatgaacaccggaacttccgggcaggatgagtagcccggaacttccggagttcttgagccaggaacttccgggcagcagagataatttgaaaactgagaaaaaaaacaggtcctagctaggaagttcaggcacacatatgcacaagatgaagatcacaagatatcagcagattcaaacaacgaacatgcacaagagagacaaagacaattttttcccgaagttcggatcgcacggatcctactctccgttaaggtgctccaaagagccgggtctcgattaaccccttgcctcacttatgcaaagatcccagaagaggtccacagccttcaactcaacacttctagatcattttctagaattgagtgaccaccaagatccaactcaaaattccttctagaaaagaccacaagtgcaagttgctctacctaggacaacctctgaaaactcagcacaagaatctttactcacttacctcgtttccttgcggaggtgaggaaaaccttcacaaactttcccgggacatccataagatctttggaagctcacgggcgacacctaaccatctaggagaagatctccaagagtaataagcccaagtgacagcccacaaggtatccaaagtgctcaatcaaccctaatcttcaagccatctcaaaacactcctacgctctcatctattctctcaatctcacaagataggctctaaatttgagtggaggaaacaaaggaagcttgggagtgactagaaaaccctagaacatgaatgaactaaagtggaatggccaaagggtgacctggggacgaaatccatatatataacggctaggtgacgtcatctagccgttacttacaagtttgaacgggaaacctgccaggaggttccgggcaaaagtgccaggaacttccgggcagcacttaggaaattttttgctttgaaacaacgcccggaagttccggccagaaccttcgggtagccctctctgtcctggggagaaaatcatttttcaaaaatgattccaaaaatcttttgactcatggatatgactaagagcactgtgtataccctagaaccacacttgaaacccctcttaatagtacggtttttctgaaactcaatttcgaaagtgaaaaacctagtctaatcaccttcggtcctttttgcacttaggaacattcaaattggggggtcgccttgcattcttagtcatcacaacatgctttgggactaaactcatgtaaataaacttgataaacacgttagtcccctttaaccaccttgtcattaatcaccaaaacccactagtgggtttaagtgcaccttcagccagtggcgtagccaggaatttttccttgggtagtcctagttcgcaggttcacatcacatgcttaaagtttctaacaccaaaaagccgatacacaagtacaaatttagtaaaaatgcaatagaaataatgccttgcaacattcataagtggcttacttaacaagcaagttctcatccaaaatcttaggcatctaagtgaatatgtcaacctagccttattctcatccgaaacattcactatggtattatcaattggtgcatctttcacaaataaattatatttctcttgagctttattgtgtgcacttgttaccgcacccacatgtttgtcaagtgcattggatttgttccaattcctccaactacccttaaaataattactacttccattgccaaacaaatacaacatactatgcaaaacctagcatccttcgccacattatattcaagccaactatacttatgaaaccaaacaaagcagaagtgacgttgcttaccatatatatttcttgtggtggatcatcttcgagtacaggagcttcgtcattaatatataggaacttgtggtggttcctcttcgggtacaggagcttcatcaccaatcctctttgcttttgcttcatggttccgaaataacgatgcaatatatctgctcatcttcatgttttaccaatcctacaaactatggcatacattcactaatcaacattcaacaaccacaatttacaaagtgcatactcaatcattctcagattcaggaatcacaaatcgatttatgaagcaggagtggacactggacagaggaactgaggaagatttcattacctaaagtagagcagccgatgagccgagcaggaggctggacggtagcggagagccgaagacgggcacgggcagacgggagatggccggcggcggctctgcggcaagccggcaaccggccgacgtccggcagcgaggcgacagctagcgacatgaggagcgaaggaggactggaggagtcgtgctgtcgtcacctcgtcggccagacagccccaaactcggcgcggcgccggcgtggatggcggtcggcggacccacgggcgtcggcggcggtgtggctcggcactgggctgcgccggcgttgacggcggacggcgaacgcggacccacggccatcggcgcggcgcaggcggcggtcagtggcgacgtggagcgggcatcgggcacgaagggagtagcggctggaggtggaagcgctccagcctccaggctcccccaactcaaccctaactcttcgtgggctgttactattggatttgggccaaaacggctggctgggcctaattttttctgaggggtgggggtctctgggccaaattctagggtagtcccgagcccaccgggactaccccttggctacgcccctgccttcagctacatcacatcaaccacaaatcattgcattacctagtgcaatcaacactagatctgcatcaaatcaagttcaaaaataaaataaaaattaactaaccattaatgaaaccaccagatacgcactgtaaacacctaaacaaaagtcccaaatcacaaatatagcaaatacttgcaaaaaaaaaaacgagagtaacaaaaataacagaaatcgacaatgaacaaaagcaataacaaatggcacactcacatggctttgatcagcgatgcatggcttcctcatgccgtcgtttatgcagaggttgctgtcttcacggccgcactaccactcgcggcactgctcctagaacgtgttcaaatctagaatgaaaccatccgcctctgcctccacctcctcgtactctcatcatggatgttgcggtggctactgatgccgacaacaaacgaaggggaaggaagaaggaagcaaaacatgaaagaatcaacaagggaataagtactcaccagagaatctccgttgacaacgagctcctcaccatcgaatcgtctagaagtcgctccggcgaaatcacctccctttcaccatggcgacatcgccgctcccctgcctctcttagagcttcgactatatatatctctctctctcacagtctcggagtaaatgagaaaaatcagcagtgggaccagaaaacaggctcagatttttcaaaaaaaaagtgaatagtggttgtgggacccaccaagcccaagaaaacagaacccttcaagcccagcccaaagaagaaaagaaggatggcccgaacaaaaaagtccatcccacaaccccgtgaatgcacgtctcctccctctggccacgcccggttcaaatgccggcggtgagcagaaagccagagacgtaacaaacttttctccctccgctacggctacttcttcctccccacgccaccccaccccacgcagagaagccctcgcctcggcgcctcgccaccgcgcgcgcgccgcctcgcccaccaagtgctcgaccaaagttccgctccgcctcccgccgagcggcgagccaagccacgccacgccacgccgagaagcgagaagccgaggggtagctactcgccaccgggcgcgcgctcgctcgctcctgctcgcctcgcctcgccaccgcgacgcgacgcgacgctgcgcctcgcctcgccaccgcacggacatcgatcgctcgctcgctcgatgatggaggttttccgtggtgtggagtttgcggcgctgcggctctggccgtgtggctcattcctccacgccgacgaggacgggaggtctgtctaccacggcagcgtccgcgacggtgacgcctggttgcccaacgcggtgtgggctgtcgaggagctcgtcgccggggcgtcccatacgcgctacgtgctccttcgcggcgcctacggccggtacctcggagccggagcccccgacgcccgcgaccgcgaccaggagcgctgcgcctgcccgctcccctcctgcccgctcccctgctgctcgctccaggcggcgcagcgcgaccgagatgatgctgagcccgacgacatcatgtggcggcctatcggatgctccggcacggacattgccggcagcgtcgtccttctgcaggacaggtccgggcgctacctgcgagggaaccagggtttcctgtctcgccaccacggcgtctccgtcgacgtcaacatcggcaacgagatgacgttgcggtgggaggttgtgcgcgttcgagtccccactcgtccggagcgaccgatcgtgcctgtgagttccttctcgtccccccggattattgtgtttgttctgtttctaatacgcaattctacgaattgaagcaaatccttaatgttaattgagctgggaataaatcttgatttgttgcgaattaacagtgtgcaactgaatcgatcaaattcgttctaatacaattcttgattctgtctgtgcagcacttgccgtgctggccccttctgaatagggagatccaattcgtgactgtcgatgacgccgataacttcggtttcggttcggttcgattcactggtcgatcggtggatctcctgagagaggaccttatgcgacgtattggttacgacgacttcaccatgtgtgtccgggccggccgccatgggcggctcacccctctgttcattgacctgcctcacagccgggagacactgtgcattgttcttatcaggcccaacaccccaggtaagcatagcagcttagtttgatatgcgtgttgctgaattttctgaacatttgtttgtgtagttcggtaagcagtgcactagatctgttcagtaatgtgaattgcctttgtgttgaattttgtggaaatcactcaagcagtcctgtactcctgtgtgtgcatgctgagtatggattggtgataggaatgtgtttaattcctgcaatacattactgctcaagcttaactaggtagaaatattcatgatgttctgatgagtgatgacagtaactgaatcttctgaagcattcagggccttcctctaccttttatttgggatttttgatgctaccagtttgcagatgccacatgctatgcgaaatctagttaattactggtgttacttgttctgctcactatcccaaaccaattgttaaataataattaaagaacagttctgtttttcaggtcgttttcattcagggcatgcccctgtctttttgacgcgtagcatctgcaatttaaattggcagcgtagtactgttttttactatcatctgcaaaaatcccaaatactgtttttacttgcaagagtagtactatcacactgacagactaaccaactgcatgatttctttactatggctgcagtgaatgatcggttgctaacatcaattctgaaagctgaggatgatgctacaaaggctgctgctgtggagctgcagcaccggcaagaattgctgtgggagagggaggaagcgctaagagtccggacggagacagcacttcggcgatgggaggggaggcttcaggggagggaaagagcaaccagagtccgggaggacgcgtcgctgcagcgctggatggagggtctggggaggagggagctcgccctgacgcagcgagaggagagggtgagcgggatggaggcaacacatcgagcggctaccagcagagataaaccctctgcacctctactgaagaaggtatgcatttggatcccttagaaatatgtgctaaagtgtttaactgaacagcagcatttgttagtactaatgattttgagactcttcacaggaggataacatctgggagaaaaggcagatgtcattgagtatttcccttctgactccattggcactcctattctctgtacggccactcatacctgctgaatatgatcattacattttgatggccttcattgccatttggggattgggcagcctggcttttcaatttggattgtttggatctaattctggtgagaagtccttcagccgcttcgtctttattagtttcactgccctggtcctatacactcttcacttggagatgatggaagcgaagggatactctgcagcacctttgtcaccattggcagatgtcagtaatgtcaccctgttcccagtggtactggatgatcaaacttggacagtgattttctggatctactttgtgctcgtgctttccggacatctgtatgcttgggctacggtatatatcttcgactcttaatttatgcagtttattttatatttaactccctaataatatttgtctacgcgcaggcttacatcacagggtctgacaaagatttggagtagtccatgccttcacattttcgtgagatgtttgtttttttcacggcccgaggacaagtggcccagtagaggataagaaatcaaacaaccaatggaccagatgcatatattagtgtactgttgcaattgcaccctctcttgaccttttttcctgttaggataaacattcacgtcatgaaacttgttcttcttagcaatattatttcacccttaggtggtgctattttccttatatgatgatcatactgttgttacgactggaattgagtaagatgtatgcattcaaaataccgcgacaagttcatatttgtgatatatgctttcagacttattaagttttgttgcatgatcactgggtgaattatcaaaagcaatgcataataacagagttcatatatgtaggacaaggttatcgtgctgttttgagccctgccacaaattgagagaaatggtccactatatattgtttcatgttattctcatatctcaaatgtcaatgtaaaactctttgcagtagaatacaaaggttgatgcttgagtattctgtattgcatacatatgaaaatttagaaataatgtctcactgaataattcctttttgttgtggctgagcaaatggtgcattaactggatactggtattttgcatcagacggtcactgcatgttcttctggtctggctcactggctgactggtttgccttcttttatgattaatttgatgatgttattttgggtccctgggaataaacaaggaacgttctggttctaatatattttagaagctaatatactactccctcccttcaacgtttgaccattcgttttatttaaaaaaaaattattactatttttttttgttattattagatgataaaatatgaataatacattatgtgtgactaatttttttaaaatttttcaaataagacggacggtcaaacgttgaacacggattttcacggctgcacttattttgggacagaggtagtagcgtacaagaggaatatacagcaaaagaaaaaagagaaaataatcctacacctaaaccaattatcagaaaatatacaatcgtacacctaaaccgatttcaaaccggtcgccaagccgtctccagatcggacgagattgacacgttccaattcgactggattatgcatggaccggaaccgcgcgattccaactccgattcagtatcaaaaaatatatatatatatatatatatatatatatatatatattactccgtgtgaccttgccgtgtatcgccacaaaatagagaccgtacgcgtcgccgccatcaccaacacgacgtggatcggacggacggacgtcgttctgcaacggtgccgtatgggtggttcgtcgtcggagccggagtcgtccgatctactgtgcagcttgctcgaggaaggacgtcctcgtcctctccatctttgcaacacggaggtgatggcccctccccttcctgcctgggtcatcccttacagagtaactactccatctgtttttttttttaattttccaacagagttttttttttcttcacgatgctttttataacacaataacttaaatagagtaataatccattctccttttttgtgtgtgtgtgtgtgtgcagtggacctgcttgcccgtgtgctttgccctactgattgttttcttcacggttgtgtatccaagaacaggcaggtgtaatgccgatggccttggaaatggaatgtttctatgtgcggtttacatggtttgtgcctctattgttccgatcgtggctcttgcgactttcacagctagtccacccgttaattagagatgtgataatcagtcggggcctctaatgtgagaggggcttttgcgttcatttgcacccacttaattaatttttgtaagttcagattatgcatgtatctgtttatgattatgaaggctaatctgatatttgattttggttttgctataattatgtcgccataaatcttgttagattacagtcagatttgtatccccgggatctcctattagattcgtgccggagtacttccgtgtctctgccataatgtatgttcacacgctagttcataagaatatgattaacaccaaattattacatcaaaataaggtaataatcatagaaaaggagacgctatattttttccttgtaaatacatacgtagctttagaactcacattataaatacactaaaattacatatgtaattttaagacttatatatgtaattttaagatttacaatgtaaatacacgttgactattttttgataaaaaatgtggcggcgtaaatatagatagacccgacaaaataatcctatatgctggtggacattgtgttcctgaccggagtttttggaggaaacatggtcacgtaatcatgagatctaaaatatctcaaaatccatccattggaacccaaaaacttatcccaaaattcctattcaaatatcaaaatctaaagctcgaattttccctccaaattaattctcccttatctccaatatcaaattctatcaaaattttccttgaactcctttctttgcacctcacttaaaatcctgatcctgagttcaaatattaaattgaaaccgaattcaaattcatcaacatcccttcacacaaattcctgaaaaaatctaagatcattgttcacatcatccctttcctcatcccagcccacgcagcctccttcctcttcctcccctctcactctctcaagctcggtctcccctcttggaataagttcactttaatttgacacctttaattagtggccggatctaactcgtatccctgaaccacgataccggatatcttgaccacctcaactactaaaaccgatggactttgactcccttggcaattttggaggacggtttcatcgacatgacgcctacgtggcggtgttgatctagtcttcgttccacgtggcattgatgtggttcttatggcattagaattaaaaaataaatacgggacccatttgtcattcgcacaaaagatattgtgggagccactgacatgtgaggcccacatgtcatcctctctccttcttccttcttctcctcccgctctctcccctctctctctttctatccctatttctcttccccattggacgtacacggggagcgggggccggattggtggcggcgatgggtgagggccagagacgggcgtggggatgaaggcagtgacaggatggtggacactgtggcgaagaggaaggaggtcggccgcatgagagggagccacagaggagcactggtcgcgataccaccattgtagagctccagccctcacctgcctccgccatgacgcctgtgcacctcgcgccttatccacctgaccctcttcgttgtctgcacacacaagcaacaacaacaacaatggcatcacggccaatccccacgccacaacacaaacaagaagcatacacgtagagggtgtgcgcgtcaccttgatgtggtagtagagcgtgtggaattcgatggcggaggagacggagatggaggctggagcaacgggagagggggaaggacatgcagacgacgacgacgacgacatggaggtggcgaggcggagtgggagggggtggtggacactccagtgcccgcctcgcgccggccgttgccacttcggtccccgccagacgccaccgccaccgccgccctcgccctcacgcagtcgttgccgctccagcgctcgtcgccgctccaaccctcgctcgcatgccaccgtcgttgctccagcgcctgccactgccactctggcccccgccagctgcaaccgccgctccagcagcatccgctcgttgtcctttttgctcctccgatgaagatgtggagcacctcttcctacgctacaccggagtggcaacaatctggcacgcctttggcttggacgaacaacaaatcgcctccctgccgcagcttgaaggtgtctgggacattcctccgccgggacaacccgccactccaagagtctggcacaccatcctgcttgccgtcatgtggaatatttggaaacgccgcaacaacaaggtcttcaattccgttgacgatcctgcctcgttagttctccaacgttgtgctagtgacattgacctttgttcccaccgatgtaaaaatgctgagagcaagcaacagctccgcaactgggcctcctacctctatgtaattatctcttaatttattttccccttctcaccccctgtaacacctctcctgtaaatgtttcttcatttcaataaaaagtttaggctagtactttaaacacccgcagtagtttccctcaaaaagaaaatcccttgtgtacccataaaaactcacctaatcccttacataccctcgaattttactcaatcctctctgtacccccaaatttttcactttgattccttccatgcccctcccattaggtttccgtttgatccgtgacttaatctgtttgttacattgtcagtattttcaaaaaaaataccaaaatgcccctggcaatcctagcaaataagatcgaatccaatcccttctctttccccatcctctccacgcgctggcacgaggcgcgccgccggcccatcccctcccgtcgagagcgccgccggccaccggcctcccgtcgcgctcgccgccggcccatcccatcctgtcgagagcgccgccggtcactgccatctcatcgtgcgcgccaccggctactgtcctcccgttgcacacgccacttgcgatgcccatcctgtcgcgtgcaggcggcgtgcggtggggcgtcgccggccactgccctcccgtcgcgttggccggcgtccaaggcgcgggggccgccgtccacggccctccgtcgtggactccactggccactgtcctcccgtcgtgctgccgaagtttgctgccctcgcttcgcgggcgccgccggccacggccctcctgtcgctgcgccacccatcatcggacccagcactgccctagtggtaggttagttcttcatttcttcttcttgcccaggaacctaatttggtttgtcgatttgcaacatctatgtatggaatggaaagttggtttggttcctgcaggcatggaaatgaaattctggtgtgtgcatgatatgaattacagtattctgtatggatgatggaaatgaaattgatatgaagtgctctgtgaatgatgatgtatgatgttcctgatgctcttattgacctaattgtattttgtttcacaaatttctgcatggatgctcttctcatttcattcctatcaagtggtgctattaatggtcctaatatttttggatgctcctgatgttttgcaatgtattttctcctttgtccacagcaagttttgcactcctgctaactgtaccaattttttttttacagtggaaactgatgtcactttgattttctaacactattattttttttcaaaataaaaagtttaatgtattgtattttcttcaataccatgataaaattcttaaactcattatttagtctcatagcatacatatattgtgcagtcaacatttttcaattattttccaatctacttggtgctcctccatctacaagagtattatggatatttgcaaccacagttagctggaaaatgaaggaaacataatggggggaggggcatggaaggaatcaaagcgaaaattcaagggtacagagaggatcgagtaaaattcaagggtataaaagggattgagtgagttttcatgggtacataagggattttctctataagctaagttgatagcgacacacctgaggataactttttctttggtttgatgctacaactttcagcaaatacatacataattggcactacaattaagtgcgtgcagctgaaacggttagggaggaactgtaagagcaagtttaatagtatagccaactactagctccaattcatatatagtcaatctaatagctcattcatataatagttacatactacactattaatacatggtcccacctatcatacacacaccgcgtcttggagtccgtgctacagctgactacaaatctgtagcccgctggccttctctctcctcatttatctccttaaaatatgtttacagctggcttatagcctgctattgtatctgctcttaggagtttatgcaagtgaaacacacttttataagataatgattaagatggcattgaagtagtacgagcaagtttaataatatagcccactactagctctaaaatttaaaacatcatctatagtcaatctaatagctcattcatacaatacttagctataaaaatacactgcatcattaatgtataatccacatatctctctcacatactttattggagctcgtgctgcagctggttacaaatctgtagcccgcttttgttctctctcctctcctctctccttcacacaagcacaaatctgatgtggcaacttatatagcccgcttagggcacccgcaatggttatctataggctctctacaagagatccatgtcagcatattttcctacttggaagagattaaatgaagagagagaggaaagctatctactaacctggagatagtctatagagaaaaacgaggcaatggattagagagctatagatacccatgtagacataccattgaagtggtttactattaatctagtctattgctgagatgtacatgttttatagatagcaccttactttaccattgtgggtgctcttacgttaccttattgtatttgctctgaaatctaatacattggatgtgcaaccaaccttttaacctcaacttttaatgcgtgctagtattttactatgattgaaagcgataataaacaatgtatatctcatttcggattcccatgcatgcacttgcgtttacattactcagagcatgcgcaatgtggaatttagagagattctataggagagagacaaataggatcggtcctacacgtatgggtgatttttttcgctgatcctaaagtacaaccgggcactagtcttgatgcccaactcttaactgctcctaaggtagaaccgggcgctagtcttgatgcccaactctatcgagaaagagtctctgtcccacctatcataggcagtcatctacacaaactttattttaggcaaaatttgctatagggcatcgaaaaaacgtgtaattagtttgtggacaccgcaagaacaagaatttgctaacgggcatcacaaaaaacgtgtaattagctcctggacactcggggccttattttattatttctcgtgaatttggagagagaaacactaaataaaaacaagtttgcccttggtctcgacctggatagcgacaaagcattgggttggccggcggcggcgacaaagccgaacacgtgcagcgcttgtgttctgtccctgtgacgggtccgagtggcggcgaccatcgccgggatgctccgtgttgtggccggcgtgcgtgggctcgtcgccgccgatgacccctttggtgtggagctaacggacgtgttgactgacgacaccgacaccgatgacaatgcgcttgtgttatgtccctgtgatgggtctgagcggcggcggccatcgctgggatgctccgtgctgtggccggcgtgcgtgggctcgccgccgacgacccctttggcgtggagctaatgcacgtgttgattgacgacactgacatcgacgacaatgtccggcgactggagaacacggtgcccggcgcgtgggcgacggtggagagttgtgatgtcgcggagctgctcctcgccagcctcgatgccggtgtcccgttctcctgccgtgtcaatggcagttgcttcgcaattgcaagggagaggatcaaacaacaatttacatataaagatggagagatcacaaaaaaaaggaggggaaattttgatcgggagggagagagcacatgcacatactcgtgaattccctttcgcatatggcgctgagctagctctttccagctggctcggcggcgtgacggcgtggcggtgctcgtcgccagcgaccagagtgcttctcggttcccgtcgacaagagcatgcctcctcctcgaccacggccacgggccggagcagctccacctgcatcagcccgcggcggccaccggcggagctcgtcggcttcacggacttccacgcgcggtcgatgcgcagcatcttgagctccacggcctcctccttcctgtcgtccttgtcactgttgtcttcctcgtcttccagctcggcggcgcagatggggggaaggcagcggtgcgcgcgtgcgtcggttgctgccggcggcggcggcggcctgcgcaccattggctggcggcggtggcgcggatgtgcatgcgatgtcatgcgttggcggcctacgtgggcgcggcagcgggcggcgcagagcgggctcgcctttctccccctctgcccaacgcgctcgtcgcgccgccgccgcgcggaggaggtggcagcggtgctctggccggtgtgagggcaggggcaaaatcgtactctcaccagtgtttctctctccaagttcataggaaatattaaaataaggcctcgagtgtccaggagctaattacacgttttttcgatgtcctgtagcaaattttgcctttcttttattaaccttgatgggtcccactcatagcacttctgatgatgcctatacattacaaaaattttcaccagatgctatccgatccgtgctgtggggcccgccatatgagccccttcctgcactatacattacagatgctcttagagcaaggtcaataatataacctgctgtcagctccaacaaatagccatgtcatctatagtaaaaagtgtagctaatgtgtacaatagaaatagtatagcactaatattttattatcttaatggacccaccatcttctctaatctgcctctttctccctcccctccttcccttttagtgggtctgttttcttggagcgcgtgggtagccggcgcttatttagtcgcttgctctcgttctctctcttccgttttctcctcgagcaaatcgttagagctgacgtgtagtttttatcgccggttctggagccctattgtacctgcttttaggcgatcagacagtcatggtatgaagatttaaaagtcatattcgtcagcgcacaacgaaccgacgatgccgcaagggaggaggctgccgcttcctcacggtggctgcggcgcactaggtcgaggtagggctcggtttcctcgcatcttgcaacatgttttgtccatcttatttagtactcctttcgatgatccagtatgaaaatcatccaaagctttcaagacgtccctgaggattacgaccattgggcgcccggatcaagacgtcttcaaaacaggctttaccaaaggcatcgcgccgccgtgccaccggccacgccgccacacggcgttgccgagagccgcgactaccgcgcgtgctgctatgcaccgccgccggccgcgccccgcacggcgccgccacccgccactgtgatcaccgcgagccgccgccagtgtgatcactctaacattggtcattcatatgtgagcccatagactataggattcacatgttagcctctcaaagtctatttatggtatcatcctgtattataggagtagaaaccatgcatgtcttcttaaacttttttttttcacaacttaactggctcttctatttattttcctcacatttattttttttagagcacacgtgtattttacgtatttttgctactgttatgttatcaaaggtaggataggctatgcaattatttaagtgcttataagaaaatttccaataaaaacgagaaaaaaaaccccccctaaataagtcgcataaagctagtgcgcaaccctccatagcgagcggttcatcgccgcggcacaaaatgctccgccgcagccgccacttcctcccacccagaccccgccgccggccgagacctcgccgcgaggcccccgccgccgagccgcccaccccgacctacacccgcgacgtcgtccgccgcgtcgacgccatcctccgcggccacccctggtcggcggcgcggccgctcctcctctccctcccgggcctcgcctgggactcccacaccgtcgcgcgcgtcctcaaggcgcacccgcctctccacaaggccttcctcttcttccgcctcgccgccggcgcaggcggcgggttccgccacgaccgcttcacctacacctccatgctccacctcctcggcgaggccggccgcgtgccggccatgatgcgcctcctcgccgagatgctccgcgcgggggtggaccccgacgccgccaccttcaccacggtcatgcactggctggcgcacgccggggacgtcgacgccgcgatgcgggtgtgggaggagatgcgcgcgcggaaggggaagtgtcggcccaccctcgtgagctacacggcgtgcgtgaagatcctgttcgacgccgggaggcctgcggaggccagggaggtgttccaggagatggtggccgagggactgcggcccagctgcaagacgtacacggtgctcatcgagcatctcgcgaacgtaggtgaggtgttcgaccaaatgcctaccatgttgtttgttacctctacgttctgtactgcactctcgttgtgagctgttgatctgttgttcgatgaaatgcctgaatggtatggaagatccaatggttggtttgctcgatgaacatagcttggtgttggtcggttgcttagtttttgcactctaatttcttcaacggattgctaaatggcatgcaattagaatatgccatccattagagtacagtgggaatctcagcttgtgtagacatgttagtgcttaaattaagcacaattaaagttcaccatctattggctagtaagattaatctattgcattcattggccttcagaatatcccttttataacaaactgtcttgtaagcatacccaatatctatctctttttagatgtactcaatatctatctgaagttcttcattcattgagtcatttgtgctcaacttcctgtgaagaaaagattgaacaattgttagcattctggaatactctgtacataggtaggcaaatccagtctaggctgcaaaagtttcttagcttactgaagtgcagtaaacaatctcaaaatccttgtcaccattgtatgaactccactctacagctgctgcaacttaacacgagtactggccgatgtaagaggtgctagttgggcaagcaaggtggctgcctaggcaggataaattggcttggcagttatgatacatcacatatttgattaatgttttcacttctaatttgcactgcattaagttataatatttgtaccatcatatcctaacacaaatctaatttacttcagggaaatttgaagctactatggaaattatggacaagatgcaagaagctggtgtagaaccagataaagcactctgtaatattctagttcagaaatgctccagggctggtgagacatcagtgatgacccgaattcttcaatacatgaaggaaaatttcatcgtgcttcgccgacctatatttttggaagcacttgaagctctaaaagctaatggtgagagtgacaatcttcttcgggaagtgaatccgcatcttgcatttgaaggcatcgaatgtgacccagcatttactgatctaggctacattactgtcaggagtacgatcctgtaccttttggcttctagaaactggtccgccgtagaacacatgataaatgaaatgacccccaagaatatcaaggttgaatcacatatcctctctgacattattcaagcaagctgtgcaaactgcagaccatcatgtgggcttgcagttctgcgttacagtctaagaataggcaatgaacttgatagatctgcatatggcagccttcttggtcattacatcagaaatggttcattcgatttggtgtttgagatcgttgaaatattgattaaatctggctgcaatcttgggacatatctatcatctatattaataataaaactggcttgtgctgggcattcttcaaccgcagtgcgcatttttggattattgactacagacaagaatgttgttacgtacactgcccttatgagtgcctattttcaagatgggaaagttgataaggctctccaactattcttgcaaatgagtgctaatggagtatctgcatgcccaggtacatatgaagtactgatacatggattacaaatggctgggcggaaacaggaatctgaacattaccgaagagagagaatggagatgcaatggcatcttcagtatcgcaatgagcattcccctgaagatagcttatgtaaccatctgttttgtgattttcatggttagaagatggtccaaaatcttcatctttcattagctgaatccttccagcacctattgctgcctgaacatgatgatattgacacacaggtctgttggtatttttaattttatttaatatatacctaaacatggaactgtaaatgatttggttaatctttactctgtacttggtaggactgctgccccaaggatggtaacatttaaattgaaaaaaagaagtgcaaaagcatctatatgatttgagaaccttgaaagctgaaactgattatcgtgatgttatcaattgctatttgaaacggggaaaatccattggagtagggcagttgaagtgtttaccagaaacattgattgtgatggtaatttatagatgactctgagcagttggaagtctccaaaagactgattgtaaagaaacatcttattcaaacaacttaattcgagagcttggaagtttttaaaaaaaatcaagtgtaaggcaaactctatcttttttgcgtagactttcctagcctcttccttttgttgaagacacttctaattactgcaatataaagatagggcccgcagttttatacagtgaaaaacaaggagctcaatagttttttggagagttctgttttatttcatctgttaatacttattacaatcaatttgctgcgaattctgggacacttactaacgagtttaaaaaaaatagttaaataccctgttcagtttagttgcctttttgcgttcaccaaaattccttaagtatttccgaacttattttaagaaagcggtccattggagatcaactgcttcagtacaacttaaatgatatggatgaagacatgtcataaagaaacttccgttggcaggaaccacaattgaagagttattacacaattttgtaactttgttttgcacaagctggaattctaagttagataaacttctagtttacattttttttaaggttgagaagcaacttgttttgtagtgttgtattgatgcatgcggttgttgtgttaagtagttgtttcttattcatgtcgtgacaaactatttgcatgttcatatctattgtaagttctattttaggaaaaaaagtgcagggtgcagggtggcatcaatgctccaaatatggtagcagtgtaacttgcttagttaattcgagctgttaattagggtttactttttagtcactaaggtgcatatcatttatgaaacagtcttcccttttatgctttacattgttgactatttagaattcttgcagtctagtgttctctttgtatctatcaaccaactcaactattcaaggcaactcatcaagctttagtcctttttaaggattatgcaaagtttgctgtattgttttctcatgttgtccgctttttggtattctcagtaactcataatgaggtctggaccgttcattcggtacacaaaatcaagtactggctacatactatccaccagtttttgtgcttttgagagcatattattgatgaattactgcattgtagatgaatatgtcaaggtatagctccaatctttaaggaccgcaatacaattctgtgaaatttgtgctgagtgattaatttgattcatcttattgtttgcagatgtcattaaattatggagtccatctaggatcaccattatgtaacacaaatgctctttctgaggtgggtttgtttagtaattagtagttgtcttactcaatgcagattgcatacacagagtgatagcagtttattttgtctagtaatcatcagagttgttgaaaaatttatgctgatggttttaccttctaaaagcagcatcttcacgagcatgactgcacaagctgctacacgggctgttcacttttccatttcaatgtattgctgttgtcattcatcagtagacaacttctaaaggtgcacatggtgaagactagtgctgccacttttatcaaacctttactcagcagcccctatacaaactctctattgctcttggctgctattgcaaaaaggtttcacgaaacttgaactggggcagggtaatttactatcctgttcagcattctcctgcaccttttctgaatagttatctacaggtatgttatatgaatggctcaaattcttcataaacagagaaactagttaccaatgtcaacatgtcatggaagctgagttatcctcaaaaagctccaacagcaattttagtttttgctgggtagacatgcccatgaaatggtgataaacgattgggtaaatatgagaagctgatttataatttgtcatgtcaattcacatccagtcagcaggagataactgagctagaggttgcaagatcctttgccagcatactgcatatctacatcacagggagctaacataaagacgatgaaccaagagagttctagttgtgcattaatctagccatccaaatctaagcagcctcatgcacatatattacatagcatggccaacattgaccaaacatgttgcatcctatcttgaatctgttagttgaagacaaccagttctctccatcaggccactttcacgtttgtcttcagcctctttgcagcctgcacgaaaccaacgatgacctgcaactcatccaattgcttaaacatggcaattgggattcacaagagacgaccaagatgtcaatcaagcatggttatgcaaagctgctgtgtagaaattggagagagatgagtcttgtttatcaacctgcgacacaaagtgcctctggacagcatccactaactgctccctggatgggttagggctagcatcctgttcagcacgtagtcagaacaccattttcatggtatatttttattcaactggtggagcttgatctgggaatgattacttacgagattgaagtgacgccaatatctccataatgcagtcatttccagcttgctcaggtcaactttctgcaaatttcacagtcaaagcttcagctacgaccaccacatcatcatggagaacacataatgttacagctaacagtagggatttagtccaaatactacaaaggttgtgacagagcaaagttacagtgacactgacacatattactggaaagtgattggggtgctacaagcaatggttgttacaagcacagaaaccaaggaagcaaaagtcgcaccgtgtgagcccttgaggaggaagaaaatgacgccttggagtgggaatcacaagacatggagcggctgaaggatttggtctggaaccctctatgctgcctgctccttgacctctgtggctttggtgattgtgcgtcatcggatgctgcaagaatgggattaaacaagaccaactatttacaaacgagacgcatgcaaccaaatcgaaggacataattaggtgccacgaaaaccgtgccattattttaagttcggttttcacaagctaaattggtccgtgacacagacggcgttcgggctaattctaggggctaattgctctttacagaaaattatggtgtcgtgcatcaggtaaactgtcttttttggtccttccccacaagatagaacaaagtatacgacattattattcatagatcggcagaattttatcatgcgaacaaaatacgaaagcattgagaagatcagcatttagtatgaagttcatggggaacattgctgatgaagcaagaacatctgtgtgggatgaatatgatcttacccagatctgaactattccactgcatgttctcacagtcaaacttatcatcatcctcattgccagttggaggttcaatcacacttaaagcattcctttgcagctttacctctatgccattggtaagcacctagcacaacaagccaataatatcatttttatttgaagtcaagcaaaaattgtaggcaaacaatcacctgaaagaaaattaaacccttgcactgagcaatgcatatcctgtttaagatcgaaacctaagatctgatatatccattccaaagaataataccctgtcagggcagtgttctacaaaaaagttacaatgcaaaaaggtaatgcataaggctgcctacaggaacaggtgccccatccttgaatcgcttaggtcgcataagcactacatggtgaggtgactgcacggtaaccgcatactggtaaaccttgatgcagggatgatttttagtttgtagcttaatgaattaacactttttctttgttttgtgaaaaaaattcgggaaggtgaggtttcaggtggtgattcccttgggtagttgaaagatttggttgaaaactgaaataaatcctaatggttcaacaaaattctgcacaatacgaaatcgccttaaaagtgtgattccccctatatgtggtcatctcatttcaatgttcaatctatctgctgttgcaaggagtgcacatccaaaagacactgggaccaaccaagagaacagcagccatataatgcagctacatcagcccaacatgaccttattttggtatgattgtttagataagacatttgtgcaagaatagcggaagattataaaaaccagttattagtaacaacaaaccaataagatagtaacagagagaagcacatattgccaaacccaacatgaccccaaaaataatcacattaggtggaacgtccaaatcgtgtaatatctaaatatccaaacacatctgatgggtatcctctgccagtgttgcattcttgttagcctcgctctatgagaatgggactaagaatcagataagcacttcacaggaaaacaggggaacatatgattttggatctacttgcttagtgggaccaaacacaattcataataatatttctaagcacatcacatgaaatcagtaaaaccattattttggatccacataacactcgcaaccatatcattgtgggaccaaagaccaaaatcttgatcatatttgtcacacaaaaaacctatcttgtaatttgaactagacaaattggagcacaatggatgcttgaaacattaccccattagcatcttctttccatcaacaagacacaatgatccatttggaagacatgcagatattcccaagaatatcctcacaagttccatgtaacggtgggaaccatacagcatttctacccatacaactgacaagctggaacactgattgcattttcacccataccaacaatgcagctcacttcaaatttcgtttaaaaactagcactgattgcaatcggatttgaatctagatactccagatccaaccttatcaagcaatcttggtcaacaacttccacgactgatgctgacagcctaattgaaatacagatcaagagcagtgggagaataaaaaactgattcccagtgcaatcaggaccacaaccaaacagtgaacaaacaggatctaaatttcgatctagaatacattacaaaaactggaagataaaattcaactgaataaaaccccaagactgatacatctagccaagaattcttacttggaaccctagatgcacaacaagatctagagccagccaagtctagaccaatcaaaaccactgcattgctcaatcagcaagcaaacaaatcatgaaacatcagtatagcagcaattcgatcctgaattaatgagatcaaaacaggaccaatccaaattgcaagagattaatccggattagcaaaaattaagctaaacccccaaaagcagaaccactcactaaagcatccaattggcgcaccaaaacccaaaaaaaaaaaaacaatcgaaaaagcaaattcacattgtatcaaatcaaatcaagatctgcgaaatcgaaattaaagcaattgcgagtggggcagagcgaaattaccagccaatgccatcccccgagcccgacggccttcttgacgacgccatggaggccaacgagcaccgacttggtgcggttgttgccggtgaccaccaccttggtatgccgcggtagcacggacatctcgtcctccccccatccctccggtccccggccgaccgccgcaatcatctccccggccggatcgatcgcctccacctccaaattactccccaattggcaccagattggcccccaatttcccctgtttcttgcagggacagttggccaaattcttgatccgagaaattccccaaaattcacgccgggatcgcaccaatctggagaatgtacttcccaagaatcagagatcaagcattggggacccaagattcgctccaattccccctcaattcgcccatcctcgccataccgcaagaagccgaatcttgatcacaacaatccccaataaccacacagaaccgcaccgatcctgaaacccctcctgctccagcgacgagatcggcccaaccagcacccacaattcccccaacaattcgacaacaaacccctgcacaaagcaagaacacaacaccaattcccgatcagagaaaagccaaaaaaaaaaaacgcagccaacaaaaaccccccaccaagaacgcaatgccaatccaggacaagaaacccccaccctcacaatccggagatcgcgccaatgcggcgcccgagcccgcgcgaattggagaagagagagatagaatccgcagggaatgggagcggcgagcagagcagagtggagcagtagaagagtagtagtagcagagagagtgtatgtgtgacttttgctgctttcgttttccttgtgccggtagtactactactactctggccctgcctgctatgaatcccggggcagcaggcgcgggccaatgaggggaggacgcgtggctaacggcggccgtctgggtgtgacggagcggggtggtcggggcgaaatgacagggttgcccttggggtgtttttttccttttttttttttccttggcttcgtgggttcgaatggttttgaattttggacccgggtagagggcgggggtggtgctcggggtgtcgaccgggttttggtctgtgctttttgattgtttgctttggctctttgcgcggttgttcgctgttggaccgggtttttggcggctccgctggatttgatgtgatcatgcgaaagtcaaaacagccaaaacatggagtgtatttcacttgaaacctcctttgctgatggtctgattgggagttcgaaggatgtctgtttatgcttatgcatgatactactagcatgaaaccgtctagactctatgaaacataagggctttcgtagtgtgcatggctgtagttcaaccccagcctcccacatcagagatttcacgccacgtacatctctcccgttgccaagtgaagaacgtggagcccaagtgagatgtgttcctcatcagaattcgtctgggtggcacaaggaacggctcgtgctacatgttgggagaggcatagcctcctgagacgcccctacaccctgtgaaaaatggtgacgatgagctgattcgaggtagtggtggtcatcccaagctgatccacacgtggtcctcatcggcgaggccaccaccctgagctgctttgttgtccccaaagcggtggcgctagccagatcatgtgatcctgaagccaaatcaggagagcttcgatggagcggcagcgacgtcctcggtagaggcgcaggtgaggagaagggaagatggcaacgacagaggatctggcatttaggacctcattgtcatccccgctccacgctgccaagccattcgtcgtccccagctctaagccaccgagcccctcgtcatcccccgaaacactcgttatcgcccaccactccaagccacctcacccccatccgtagcagcaccttccttgccacaccaccaaagctgcctcaaccttgttgcttcggtttgtctgtatcgatctgctctacacccgctcggttcgaggcaccgctgtgatgagggtagaggtggccgcgtcagggagcttgtagggagtgaccgcgacgtgatgcgaggggaggaagagtgaccgtgccattggtgtcgctgtcgtctcccgctccatgctgtcgagctcatcataatccattgctcccacgccgccgagctcatcggcgcaccggccaggggaggagggccaccaaaagctaaggagatgaggaccgtttgccgtgggaggaggagaggagagacagtatcgtcgccgtgggaaccaagagtgagggagaggatgagggagagaggtgaaagaggggatttttttttctggattctagtgtgctcagtttaaaattttgcacttccacataaattgaaaaaatatatgagaactagaatagtaccaggtgctaaaaaaatcaatgccagccacttgcattgtgagaaaattaggttttagagttgtggccctaggcactctgagacccctcatatgagtgtcctaagatatagccagctatagacattttaaagagataaaagaagagagagaaaagcagcgggctacagatctatagtcagctacagcacggacttcaagacgtaatgtgtgtatgacaggtgagaccatgcattaatagtatagtaagcaactattgtatgaattggctattacattggctacaaatgatttggagttcgtagtgggctatactattaaacttgctctaatatagtcacacgcaaaactagtaagatttgatcgggttttcgtatagattttgtacaacacaatttattttgcgtagcccattataaattgtgcagtgttcggcttcagttcttggatgaaaaattactagctaggctttgtaaagggcctaattgtaattattaatttgatttcttttcatgtttgctgcatcaatgggatgaaaacggtcggaaacgatatcacttatatggaaatggttcttggtcggttaggatatttcatgtttatcaattttaactatttagcattgacttcaatatgaggcagacaaaaattggaaaaatcaaactttatgtacacctgaaaacgaaaacgtccgaattacacctctaaactatgatgttagtacaaattacctctagacataaaaccatctttcgccctcaactattaataccgggatgaagaactccctaattcaatccgaaatggttttgatcctatgtggtagtccattttttttaaaaaaagtaattctctccctctacatacatacatacatacatacatacatacatacatacataagtacatatatatatatatatatatatgagtacagaattactgttcactactgttcacaggttaatgttcactcgaaaactttctttaaatttttaggatctttgcagggtggctaatccaaaaacagccggcgcttgatttaacgtatagaagtgttcccttcgggtggaactgcctgcggagatg

SEQ ID NO: 78173 - DNA, 2901 bp, Oryza sativa
atataaacgtgtgtaagaatccccccacagaagggaattttctttttaaaacctggtggtggccctgtcggggttccgggataaaccgtttgtgtacccaaggaaaaggccaattttcccgtgtttggttaaggaaaaaaagcttccccaaaaaagtcggttttgtgaagcaccacttcctccgtcgggataatggggtcaagttcaatctctctccaacaaagtaagattgggttgcaatcggtgagtccagccagctcaacaacgcgcttggcgtagcggtctgtcaaagcgtgatcccgaagtcgtcctggtgcacctcgatccccaggtagaaggagaggccccagatcactcatctggaaggtggcctttatctcctccttgaacgctgcgacctccgcatccttggtgccggtgatcaccaagtcgtcgacgtagacacccaccagcaaggcttttccaccattgccccgtcggtagatggccgtctcgtacgggctttgctcgaagcccatccccttgagcgtggaatccaacttggcattccacaccctcggtgcctgccgcaagccatagagggccttgtgcaggcgtagcactttgccctccttgccggggatcacaaatcccggcggctggtgcacgtagaccttctccttcaagtcgccgttctgaaacgtcgacttgacgtccatgtgatggacgccccagccttcctaagcagccagcgcaagaaggagtcgcacggactccatccgtgccacgggagcgaaggcatcgtcgtagttgatcccctcctgctgcacgaaatcgcgtgccaccaagagcacaaagagtttgtgcttacaaagccttttccagctaacttgaccaacaatgctcctgctgctcaacgtagggagcatgaaaagcgatgcaatgattatcttgatataagctgtctcatgcttgctactatgtcccctgagcttcaaaggcaatatgaggcattggatgctcatacgatattcacgggactacgtaacatgtttgaggaccaagcaagagctgagaggtttaatacctcaaagtccttatttgcgtgcgggcttgcagaaggtaatccaatgagcccacatgtggtcaaaatgattggttacaccgagagtctggataagcttggctttccccttagccgagagttggctactgatttgattctccagtcgctccctccctgctttgagccgttcataatgaatttcaacatgaacaacctgaacaggaccttggcagaattgcatgggatgctaaagactgccgaggaaagcattaagaaaaactccaaccatatgatggttatgcataagcgcaagcccaacaacaagaaaagtggtcaaaagagaaaggtaaactctgatgagatcacgagtactagcaactctaagaccaaggttcaaaagatagggcccgctaaggatgcagagtgcttcttttgcaaggagacaggtcattgaaaaagaaaatgtaagaaatacctagagtagctcaagcagaagcagcaggatggaaagagttccacctcaggtattaatgttatagaaattaatcttgctacttcctctactaattcttgggtatttgataccaggtcagttgctcacatatgcaaatcgttgtaggggctgaaaaaaagtaggagcttagcaagaggcgaagtggacattcgcatgggcaatggagcaagagttgctgctgttgcggtcggcactatgccattatctttaccatcaggattagttttggagttaaataattgttattgcattccagctttgtgtaagaacgttatctctgcttcttgtttgcaagcagagggttatggttttatatctgtagacaatggttgtttagtctattataatgacattttctatttccatgcacccatgatgaatggcttatacattgtgaatcttgatggatgttcagtctataacattaatgcaaaaaggcaacgtcctaatgatttgaattccacttttatttggcattgtcgcttgggtcatataaatgagaaacgcatggagaaacttcgtagagatggacttctacactcgtttgattttgaatcatttgagacatgcgaatcttgtttacttggcaaaatgacaaaggcacctttcatgggtcaaagtgaaagggcaagtgaactattgggactagtacatactgatgtatgtggaccaatgagctcaactgccagaggtggttttgggtactttattacctttactgatgactttagtagatatggttatgtctacttaatgaggcataagtctgagtcctttgaaaagttcaagaaattttagaatgaggtacaaaatcatttgggcaagacaatcaagtatctatgatctgatcgtggtggagagtacttgagccttgaatttggcaatcatctaaaggagtgtggaattgttccacaactcactccgccaggaacgcctcagtggaatggggtgtctgaacggaggaatcgtacattgttggacatggtgtgatcaatgatgagccaaactgatctgccgctaagcttttggggttacgctctagagacagctgcgttcacactgaacagggttccatcaaaatcagtggataagacaccatatgagatatggataggaaagcgtcccagtttgtctttcctaaagatttggggttgtgaggtctatgtaacacgtttgcaatcggacaaactcacacctaaatcagataaatgcttctttctggggtatcctaaggaaacgaaaggatattatttttataatcgggaagagggcaaagtgtttgtcgccccacacggtgttttctggaaaagaaagtttatacggagtcaaacagggggatata

SEQ ID NO: 78174 - DNA, 1203 bp, Oryza sativa
  unsure (1)..(1203): unsure at all n locations
tgtttttttctagtcccctttgagccaggtccctaaaacagtgttatttagcgggcagatttgggggtgttgtttgattaagaaccttaccttcaaaaaagagatgccacctaagcctttttactacagaatgttttccaagatggaaaactgtaaatatatttggtccatgcatgacacttagaagattattcttgatatgtgccttcttcctttagagccatgggnaaccttcaagttacactcttggccaagagaaaagataggtctaagcatgaagatgaagagggggaggtgaaaagaggagnaagaagggtggtagnagaaggaaggatcagaagncaagggcacactatggggaagaggaagaagcggaatatagagatgacccagaagcagaagatgattatgcaaacncggcgaggagtancgatggtggcgattcagagaaagccccaggtcaccttcttgctgctgcaggtcttgaagattctgagaaagccccaggtcaccttcttgctgctgcaggtcttgaagattctgatgctgaagaagatgacatggttagtgtttttttttttctttttcataaataacctgtatcccttcatttctatttacaaattatttgcttgtctgctttatcattgttgccactgagttttaattcctttccaagctttgcattgaaagttagtttgcctgttagatctagccttcgcactcttatgttcatttgtattacttttgctatttatcttcactagaaataaaaattttagatgctctggtgcaaagttgccttattttgtcttttcctggctgtagggacaccctcaatctgccatagaacggaagagacgagcctggtcagaatctgaggatgatgagccagtgcagaggccagtgcaacctagcgcaggcgagaacgatctgagtgattgaattagacggtgaagattatggccgaatttgggatcacttcatatatttgtgacgaagaatggctcctgggatgcggaatcaactatagggcgtgctcatatgcacttgtggataattcgatgttgaaatggagctcagacagatggttgaaccagaagtgttaaaaaaatttatctgggagcagagcagtcactgatattcaacaattaatctcgcgtcattctagacatgccatgggttggtggagctaacataagg

SEQ ID NO: 78175 - DNA, 2663 bp, Oryza sativa
  unsure (1)..(2663): unsure at all n locations
tgattccnncctgagcgccgtcgtgtgatggattcctatatataattgccacgtaagcgccacatcaatgccacgtgggacagacctaatcaaattagccacgtaagcgccacatcagccaaaaccgccctcaaaaccgccgagggacctaatctatactggttttgatagttgaggatctatactggttttgatagttgagggagtcgctgtgtctggttttctagtggagggacgaaaatcggattcgttgacaagttaagggacctaaagtgaacttattcatagaaaatataactgaggaataagttcatccaaggtcccttaacttgtcagcgaatctgattttcgtccttgaaaaataataaaatccgtgggaaccacatgtcagtttcacacacagaaataataaaaaaagtgggacccatgtgggccccacatgccatcgtcgctgctcccttcttcccactatcctctctcacttcttccctacgatgtggacacggacggggacaatggcgccggcgtcgttgaggcactcgactgtgacttgggtcttgccgtcgggcctgagctaggcgcaggtgccgttcttgcggacctcggtgaggcgggcgccgagcttggtggcgaggacgtggctgaggnnnnnnnnnnnnnnnnnnnnnnnnnnnnnnnnnnnnnnnnnnnnnnnnnnnnnnnnnnnnnngatctcctcggggcgcttggtgaagtggccgtgcacgccctgggcaatgtcgggcgactgctgctcgatgttgacgagcaccttgcagcggtcggcgtcgaggccgatgtcgtcggagacgaagccgatgttgtggcaggtgtcgcggacgatcttctcgtagtcgacggtggccttggtggtgatctcgccgaacaccatgaccatgtttgtcttggtgcaggtctcgcacgccaccttgccctcggggtcctgggcaaggcacgcgtcgaggacggcgtcggacacttggtcgcacagcttgtcggggtgaccctcgttcacggactcggaggtgaagaggaacgtctccgccgccatttctatctgcccactgcatcggttgcaaccaagcaatcagaaaaaagactccatttctgcagatctactgccgccgacagctaagtactgacaaaattttgcaaattaaaattggatccaccaacgctatatctaatatgttctcctaatccaccgacagttaagtaccttttttttctcctaatccagaactccatacacgcacaatcaaagattaaacaaaaaaagaaaacaagaatatccgccaatcactttcccctcccacggcggcggcggcggggaagcaggtggggaagcgggagctcgcccgccgccgcccatggaggaggccgcgccttatctccgccggcgatagagagagatgggggcgagagatgaagacgacgggagatgggggagagagaggaggaagaagaggagggggtgaggttgacatgtggggcccacgtgggtctcacctttttattattatttatatgtgtgaaactgatgtgtgggtcccacagattttattatttttctagatcgaattgccacgtaagcgccatgttagtgccacgtcatatgaagaccgagtcaaaatagccatgtagtcgccacgtcagctaaaaccgccatctaaaccggcaagggaacttatctgcaccggttttgatagttgagggatctgttgtatatggttttggggttgaaggacgaaaattgaattcgctgacaagttaagggaccttagatgaacttattcctataactgaaatttgtagtagtacgcttggggcgaggccttacatgtcggcacggcacggcccggcctaaatgagccgtgcctaatcgtgcatgggccgggccgtgccgtgtggcccattttgagtggtaggcgaagttactaggttaccctcgccattttgacgcctctgtggtgcgtctcctcgtgcagtttttgcccttgatttgatcccccaattcattccatcccgcgaccgagctgggcgtcagcgccgtcgttcgtccctgctgcttccgccgtcgcatcccatcctcatcctccgccaccgccgcctgcgccgatccccatccatccatccacccagcgaccgaccgaccgagcagggtcgccgtcgttcgtacggctgcttcctcgccgcatccatccatccatccatcctggtgaggaaccacatcctctttcccatctctctctttacccacgcacttttttttctcgaatttgcgtcaaaccgcttctgttctagaaattttccctaacccttaacactaataacagtttgatggttcccaaaaaggtttggtttttctttttttttttttaaaaaaaagaggtttgggtttgggggttcaactgaagtgaacccccatgtcccatgttaagatccgccactccttcgtttgaactagtgaaagctacgccattctcttgataaaaaaaataaaattgggggtaaagaaaagaactttaatattgtggggtgccgattcaacccttttctttttgaccacacccggtgtgcaccccaaaaagggaagaaattaagttctttaaaaaagaaggggcttggctttccatgaaaattac

SEQ ID NO: 78176 - DNA, 5581 bp, Oryza sativa
  unsure (1)..(5581): unsure at all n locations
tgtttcagctctaaaacctgcaaaagtgtgttatatttttgtaaaacaccgtattatgggccgtgggcttttttccccccaatatttaattcccatgtgcctcagattccaaagaccaaaagaatttcttttaacaaacccctttctttggggtttcgggttggttggattgaattaaaattaacgttttgggaattgtaagatccacaatgcttctttactattaaatggtccaagttttttaattcctgcacatgaggttgaagggggttattttagatgtgccaataagcacccttaaatgttctgttggttggtgaaataccttatacatcatgtcttactctaanttacacaatcgggttatgtgaaaaaaagaaagttactgatgtgttctgacataaattttcattttttttgncagtgcattgtgtcaaaggcattgggcaatatccttttgaatntgtgtttcttggttcatattgaaggactgttgacatttttgaggaaaaatgagtggtgcacccaagaggtcgcatgaggagggtagtcactccacaccggcaaaacggccgttggatgacagcagcttgtactcaagcccttctgggaaaattattcaaccaggcagcagtgatttccatggttcgtttgaacatgatgggagatttgccaaagttcaacgtattgagccccgggatgataagaggccctctctggcacataggatgcctattggcccctccaactttgtggaccactcaatctcatctgatggcagattagaatcaaagcaaaataaagatccatgggacactaaggtagatgttcgggaggcaaaggctgacactcgagatgtctacagtgatcccagggttgaatttccgagcaataaagttgagactgatgtaaagacggacaatagagcagatgacaatgacataagagccgacagacggatacatgctgactacaaaggtgatgccaaactggacaaagatggtcatcctacagcaatttcaaacatagcctggaaagataacaaagaacataggggtaaaaggaatattgagcagccatctgataatgcagattggcgttttccccgccctggtttgcaaggaacagatgaatcttccaaaggtccagttcctgcagatgagcggtccaaggatgctcatgaatctactggtgagaataaaactgaacctaaaactgaagataagtttagagataaggacaggaaaaagaaggatgaaaagcatagggacttcggcacaagagacaatgatagaaatgatcgccgaattggtattcagcttggaggcaatagtgttgaacgaagagagaatcagagggaagatagggatgctgaaaagtgggatagggaaagaaaagattcccagaaggacaaggaaggcaatgatagagagaaggattctgcaaaggagtcatcagtagcaactgaaaaggagaatgcaatactggaaaaaactgcatctgatggagctgttaaaagtgccgagcatgagaataaaacagtagagcagaagacacttaaagatgatgcatggaaatcacatgatagggatcccaaggacaagaaaagagagaaggatatggatgcaggagaaaggcacgaccaaaggagtaaatataatgacaaggaatcagatgatacttgccctgaaggagatatagagaaggataaggaagcccttggaagtgtccaacgcaagagaatggcgcgatcaaggggtggtagtcaagcatcccaacgagaacctcgatttaggtctaggatgcgtgatggtgaagggtaagtttaacaatacatcttgctatgttttttcatcattgattcaaatgcataatgggtgcttcctgaccttgatttaacaggtaaaaacattatttatttgatatgtttctgtatttgttttcttgcagatctcaaggtcagtcaaatatcttgtactacagaagaataaaatggaatagggatagtgacatgtccttcaaaactgtcacggaaagctttccagcagacttataagtttgcattttcttctcagaatattttaatgctataaccaatccatttaaaattttgaaacccctttacatttctcacttttaggatgatattttttgttacactgcatgtgctagtgtgtgtgtctattttgtggacaaaatccagccagagaggataaatagggtaatcggggtgtatatttatgaggattccgttgcaactttcaaattgagcataatgataatttatctaaggtaggctggtaaggaagttgctgtttttgtattttgctatcttagtttcattccattgcaggtaaatctgaggcatcagccattgtctataaagctggtgagtgcatgcaagagcttctgaaatcatggaaagagtttgaagcaaccccagaagctaaaagtgctgaaagtgtgcaaaatggccccactcttgagatccgcatacccgcagagtttgttacgtccactaaccgtcaagtaagtgttgacttttacaggtggcatatgttaatcccttcatcaatctccaagtttgcattccagaatgttaatatattaacacacctaatactgaatgattgtgtaattcacttgcaagtgtgcatctgtagatttatatatttacaggagattattctattgtgatctctttgaaccagagatgtatattctatttatctttcctcttgaaaccatatatgccaattgctacatatttgctgctcatgtagttgacaaattgcttcataaattaatgaagctaattacttcctttgattttgtttgtttcttaaaatcactgttgtgtaggtaaaaggtgctcaactttggggaacggatatttatacaaatgattcagatcttgtcgctggtaagttcttgattattttccaagcgtgaaacgaacctctgaaagctgatttctaaacggtctttcttttagtgcttatgcatactggttactgctcccctacatcatcacctccaccatctgcaatccaagagctacgagcaactgttcgagttctaccgccacaagacagtaagccttcattctttgtcagtccaattattagacttaaaaaggtcagagcaatatggctaaattagtagtacttgtataacacttgatctaccttccaggctatacttcaactttaaggaacaatgtccgctcacgtgcttggggtgctggtattggttgtagctttcgcatagaacgctgctgcattgttaaggtattaagactgtataagataacatataaggctactgtgttctccttttgctttgagcaaaatttcagtgctttcttttgttttaatctgctgatgtaaaaaccttttattgaccactgctccatagattgtttgcttagtttgtattacatgctttgcagaaaggtggtggtactattgatcttgagcctcgcctaagccatacatcagctgtggagcctacacttgctccggttgcggttgagcgcacaatgacaacaagagcagcagcttctgtaattttctacctcctctttctgttatcaatgttttcatttcaaagacattttacttcactttgcaacatttagtttttgttatcatgagcaatctttgtctatattctgtactaaggtttttttcaatataatctatgcagaatgcgttacgtcaacaaagatttgttcgggaagtcacaatacagtacaatctctgcaacgagccatggtactttcttgacctaccttctgatgctactcatttgctcatgaaagttccatccagcacgtactgcagccttttctgttgcatatgagtgcttgtttgtttcagcgctcaactcctcagcttttagaagcctttgtctaggtctttgttgagctaaggttgctcctactaaccttgtacctgattactttacttcaggttgaaatacagcataagcattgtggcagacaagggattgaaaaagtcattatatacttctgcgaggctgaaaaaaggcgaagtcatatacttggaaacacattataataggtatgagctgttaccgttaactatttggccatcacctgaagttatatttttgacttctgtggagcacagttccttcatttccccccctcctgttactgcaagttttcacaggtatgagctgtgcttcagtggagaaaaggctcgtcttgttggatcaagctccaatgcggcagacgcagaaactgagaaacaccagaatagtagccaccatcactcgcaaaatggggacagggcctcttcagaacatgaactgcgggatttgttccgatggtcccgctgtaagaaggcgatgcctgagagctctatgcgctccatcggtatcccgctgccagctgatcaacttgaggtaacgtcctgctttctaacattaaaatggtggataattcgcatacagaaaccacaattctcacacggttttcttgttacctcgacgcaacgcaggtgctgcaggataatttggaatgggaggatgtgcagtggtcgcagactggtgtttgggttgctggaaaggaatatcctctcgcccgagtgcatttcctatcatcaaactagcccctgcaagtccttcaagttgtcgtagcagccggttcatgaactaatttctcgcaacaatttaaggcaggagcttctctttggtccatgtcgcggttttattgtacaatgtacaatgcatccatgccatgtctgtgtataaatcaagaatgctcagctgctgtaggctgtgttgtgtgtagtattttttcccccttttttcataaactatttgagttctagttgggctgcttctgccccatgtcactgagatgtagctgttgcttcacaatttagctaacctgatgattattgttgaatggttgatgtgctgtaacttaattcagtgctgtgttcatctggggtgtttcctgaccgggcaggttcagacgtaggctatttgactgaacttctggaaattacatgtgatcattcctacaagaaatttagccgaactctgtccaaaacaggaagttgttgcaccgatgttgcttgcttcaaaaattttctcctgcaattgtagctagagaatacatgtggtggaatcctacatagtagtagttcgtaagaataagggtgtgtttagtttcatgccaaaattaaaagtttgaagaaaaaagctggaagtttatgtgtgtaggaaagttttaatgtgatggaatagttgaaagtttgaagaaaaagttgggaactaaacaagggctaagatggccgaagggatattttctgacgaggcgatagacatccatgagtggtgtaaacaatagacgcacacatcatggctatggaactttgttgtgtgtgctgctgctacagcaacatttccaggtgcattcgtgtctcatgctcgggcagtggtagtcgtacttccattttccagtagccctgtttattctatgtactactaagcttcgacattcttctgcatctgtatctcctgagtcctgacacctctcatgccgatc

SEQ ID NO: 78177 - DNA, 9543 bp, Oryza sativa
  unsure (1)..(9543): unsure at all n locations
ggagttgcccgcattccgcaaagcttttgttccgtagcctaanaaaacctatgncttggcccgggaaggccccggttggggccagggattgccaaagggctacgttcaggccggccacggtccgaaagncggcggtcacgccggccggggaccgcgcgaaggccccgggtcgagggcaccggtcgcggcaaccggggaccgcgcgggggaccccgttcgagggcggccgacggcacgaaggncgccggtcgcggccggcgacggcctagccaacacgagagacaaaccgacgactgacgaggcaagattggtgcggacgaggagtgaaggaggaaagtgggtgggtcccacggttggctagtgacttttggctggccaaatttggctagtggggggagggttttggccagccaaatggcttagccatctggttggagaggctgttggatgaacttttttggttgaaatggctaaaattcaacttagagagtcacttggagagactgttggagatgctcttaggagttaaagctccaaatcaccacgacgacaggagaaagctaacgaaccatggctacagttctcttttgtcttccttgcacaaacgaactagtgcaattgtgcctccggtaggccatctgtgatagctgtacttcgttgttcgtgtactctccaagaccaagcaaatagactacatcattgtttattctttttcctctcgatttgtgttgttatcctgcatctatatctcctgacgactcccatgccgaagaaaatcggaggaagaggaagaagaaggcgggaaggtatgcatgatgcgtccttccggtgatcgatggtaggaggtaagtaaaaatgcatagcttttggttcttcaggtttaaaatgatgggagcttattagagacgaggcagagcatagaggagtaaagataagtgatgcatttaatttggcatgtgccgatatggctaggtgtattgctccctctgtcccattttaagtgtaccataagtttctgtgtccaacgtttaaccgtccattttattttaaaaaattacgatttttttaaaaattaagtcatacatatttgaaaaatttatgattttttttaaaattaagtcatacataaattactatttatattttattatctaataataataaaaatactaatcataaaaacgatttcaaataagacggaaggtcaaatgttgggcatccaaacccacagggagtactcttagtgcactccactagctggattaggtatggagatcagttagtactcttgacgttttggacagtgacatggtcttaaaaaaacaattttgaccactattttttataacaatatatataaaaatataaataaatatatgattttatcaaggtattttgtaagacaaatatttttatgttatttatagtcaaagtttttaaagtttgataatagactcattcaaaacgacaaaaacgacaagtattattaagccagcgggaaacgacaaaaacgataagtattattaagccagagggagtattcatccacctgtgagtagtctgcatgtcgatctgagcttctgtttaactgagtgaacttgtgggaactaacatggatttaggtgggttttaaactctgtggcacttccaaaatcgccatagaaggttaaaggtttatacagtacggaagaaaagtttactcagacaaattttcttcacacattcatgataatttcaaacaacgtctagatatgatccgaaattaaaggtggctggacaattgggaagtcatcaggaacctccaaatcttaatagtttcccgtagtctcagtagtatcattacatgagactagtctttcagagagcgaacaaaccatggctgtgtgaactttgtttcctcctcttgtctgtaaaaattaaaaaaacaaattaatgtctcaggtacactagtgtcttctgcatttgtatctccggtagctagccacacggacgattgcactcatacttccgtcatgaatcgcttcgcggagaaagaaaattgatcgaagcattgcttattctaccttgctcgtaggctttaatatatttgtgtatttttatctcctaacaccagtacaccacccatgccggtcgaaacagtcggtttcactaatgagctagacccaagaagaagaagaagaagaagaagaggaggagaaacagaaagaagaagatggaaggcatgcatgatcaaggttggaaatttcggaccaaaatttcggaaatttcggtcatttcggtgacccccgatacgatattaattcggccgaaaattttgaatttttcaattttttttcatgaatttggataatatttgttcaaattcaactaaattttgttcaaaattttgaaaatttcagaccgaaatttcggtgacccccgatagaaaaccctgaaccgatatagtgaaccctgtgcatgatacatcctcccagtgaaggagggataagaagtaaagtggaaatatgccatatgaatgtgaggtagtgcaattgtggctagagaattgaagtcatataatacatgtggtgaaatgctacatgtattatatgatggccgaaggggatattttctgacgaagcaataggcatcaatgagtggtgtaaacaaatagcttgcaactttttagacgcacgcacacatcatggctatgaactttgttgtgtgtgctgctgccaggaacatctcctggtgcattctcgtctcaggctcaggcaatggtagtcgtacttccttgttccattagactcccagagaaatccaacaaatcacagcactgtttattctatctactactgatgttcgacatgatcctgcatctctatctcctgacacctcccatgccgatcgagaccaagagcgtttttttttttttttttttttttttggaaacgagctacccaaagaacgaacaggacgacgatcgaagaagatgaggaataggcaagtgaattggctgtgtacgtacgtagatatcagctggttcaggtttaaaacgatgggagcaagagcaacagttaaaagatgagccagagaagacatgagtagcatgccctgaatcgagacaattatggtggtggacgcttcaggcgataaggagtccgaactgcttacctgtcaatgagccatctttaacaattggctctgtgagagccgaatgaagattggggagcggcatcgtcgaggtttcgacactgtcgtgacactggtggcttggacaatttggaaggaacagaacaactgaatcttcaatcaacaataaaggtcttggaccgaagtggcgaaagcaatggcagaggaggccatgctttggaagtcggctaatcacgagatccccgctgtttggcctttacgaggtcgtggtagccaaatttagcgcgagatattcctatagttttccatagtgtcctgtatcggtcctctgcttgttttccttttatcactgtaaataacttttatttctcttaatgaaaaaaatgcgctccttgcgtattcctaaaaaaggagtaaacacaagcctttggcatgtatacaatatagtggtatgtagtctggattaggtgtaaggctgtgttcgtatgtaagtgctgggtgttgtgcacggaaaatggagcgatccattagcgcgtgattaatcaagtattagctattttttttttcaaaaatagactaatttatttttttaagtaactttcgtatagaaactttcaaaaaacgtaccatttagtagtttgaaaaacatgcgcgcgggaaacgatagaggagtgctgttggtgcactttgtaaacatagagagaagaaataaagttgttatctactttgagagttcttcgatttgtgttttctcgggtgcggcggtccaactggcgggacaccgacggtcagaccgacggtatcacggcagtcagaccggcggcggtgacaggagctagcggcagatttcggcggtttgaccgatcgatctatatcggttagactgacgtgttccagacagtcagaccggcgcaactacttcggtcagaccgctatccatcgaatttgagggtaactttttattccgcaaaaagattaggtttttgggcataccaaccattcactcttctctggttggcttacttcttgtgtttcgatcctacagaaaataatctctctaggcaacataagctactctgcagttgatattttcctcttcgttacacatgtgatactcgttctccttttcttaattatctctaattactatatatctctcaatatgtgtgcagtagttgtgcttgcaacacaaacctcagtataccgatgctgctacgtgaacaatgaacccgttgattccataccaaatattcagctgtctacatgtctagattgttaattaattctcatccatgaattcgacgggtggcatatctcccaatgtctcccatgccgaaataaggatcgggacattgacgtgctagcaaggaagaatagaattagctagggaggaattaaaggaggccaagaaatggcaacgacctacatgaacatcgatctgatctgtaccctcactgtgtcatgcattctgatcgatcgcgagcgctgcttgtatattcggtagctaaatggtaaggaagatgcaaatatatgaacgtgtaaaagaagagatcttcttgaatactttaaattaattagaacccttgatcaataatgatctaacggacagagagagaaggtactagaaaaaaggtattaaaggagtgggccaggtacgaaaggtggaagggtaaaatagtaattgatttttattaaattatttttcggtaaatggcaaaagcggtggacctcgtttccatgatctccatggcggatggcgcgggaggaggtgttctgattagggccgcgtcaattgatttgagatctccggtgatcgatctggtcaatctatctgcaggattggattgttcgcttgatcgcttcatcactagttggtcagttggtgtcgtttttctttcgtatcctgtagctgtgatctcggctgcctgacagcctgaggcccttgtgcttctgaaacttctgattaatttgatgatccgaacctgagatgagattgactgccttgctgttagttcgatcattcaagatgttcgatcgattttgattgtctcatcaatgtgcatgatcgacctgctcgagtacccattaccctttgccttcatggtgaatggatttgtgcagtgtaaaaaattttgttcctaaattaccctttgaagattaacggtggataacaatttattaaggaggtacctcaggtaccttccaagcactgtaaaagacctcgtaaaagaaagaggaggagagcgaggtagtgcaaatgcaggtaggccgtaggcaggtgagaatggtttttacttaccctctgtatgcattctgtggtatagttcaggcttgacatggccaaagtaaaagtttgagtactggtgagtaaagaagagggagggaagatgtaaagaaatgcataagtgccaaaatgtactcaagtggcagcattgtcagtggtgataaaaaaggatcatgttttttttttccagcttcttgaagtgcagggcagcccagtgaagtactcttgactctctacagctatatatcttggatgtctgcggagtgtagacttaattattccttgagatgttagttcaattcgatcaattcaattgcattgcatatcaaactttggttaattaatttatgcctcagatgaaggaataatgatccacatactgctttccatgcagcatagtgtagaccaagaagcgtgaggttaagatgttccatgtcttgaagaaaaggggaaaaaaatcagacaatcaattgtactaaaataaagtttccggcagtatatatttgaaacttaccaggatacaacacagccatagtaagaacattacaaaataaacatgaagttaagttagccaaaggttttaacagtgtctggtgttgggattagcttcttaagtcacaaatcatatgccaattaattaaagaaaagcttcaataccctgtggaatgagaaggcaccatgcacaaccacaaaatttcaagaatttcatagagcggtgaagttagtcactgcaacgatgcttagtctccctggtccttcctacaggatgcaggtactagacaagcacgcagcactgatacagaagacaggaagaccgatgtgtgtgtagctgcccaaaggaagaacgctgcaagctgctcaagatttggtggcgaatcactgcatccgtgctactcccagctccattcttttttgtttgacgttggttagctcaaaatcgaactaaccgacgtcaaacatttgtgcaaggaggtaatacttagctacatgtcaagacggaacgtcttggaacttttttccagtcaggtactcggggataggggtgggcgtgcaccgggacggtccgacgtagactcgtctcatgcgacccacctaggttgtaaattaacggtgtcaaacgggggttttggtgggtacaatgagtcgatccataaaaaagaagatcatatcctgattacacatataacatgccaaacaaagtaaaagaatgtagtagtaaaatataacctattgatttcttgatcagaaatgtttgatttcaactgatgttaattaatagcaacgacttgagattatcttttctatcaccgacgcatcatcagtgctagcacatacaactatagtagcttcagaaattacagcaatgacaataacacttagttgaagttccgattcataggaccagatcgaatacctcaggagcacaagaaagctacgagtagattgaaattaagaaaaacaagtgctttctggatcaaaatcgataaaagaggaataactcagaagcatgaggaagcagcagatcgagtagatcgaaatttagaaaaacaagtgctttccaatagatcgagtagattgaattttttttttaaaaaaacaagtgctttctgttagaataaatgggttaggcccgatttatttctattaaaatctcaagggcccataataaatgttaaagataataataccaccttgagaattaaaagtggagtatctcaacttaaatagagagttattggaggctcccggttgaccgattgaggtggggatcggaaagccacgcgcgccgggacggggcggggcgggcgcaccgtcgatcagattctccacgcattctttccatcgctggttggtttctcttcctctgtgtgcctgtgctacctctgttctgttctccccgcaagtgattgggacgagcagggcctcgaaactacaccttcgcctgagatctgcacgcgtaggcgggtgatcaggtttttggtttgcctgagatctgcacgggtaggcgggtgatcaggtttttggagagtgcttccgcatgactgctccgctcgcttcttcgtctacgttcggttaaaactacaccttcgcctgtaatctgcaagggtaggcgggtgatcaggtttttggggagtgcttccgcatgactgctccgctcgtttcttcgtctacgttcggttaaaactacaccttcgcatgtaatctgcacgggtaggcgggtgatcaggtttttgggagtgcttccgcacgactgctccgctcgcttcttcgtctatgttcggttcgttctgcatcacgcgatgtctactggtggtggtgcttccggtgcggcaggagatggggcgccaggaacaggaggtggcgcgcacggtgcggcaggaggtggtgcgccaggaacaggaggtggcgcaccgatcgagaacaccaacggaggcaattctgcctcacaatccagcggagggacttttatagggtataaacatccttctgctacctttctctttgttaaatctgtcagtcgcaatgttattacgttgtctcaacgttaatgcttattttacccttaagcatgctcctggttatgtttagctttattactagatcatttcacactgtgcatgtcatgtttatagtcttaatattttggattaaaatatgccgatttatgaccatatttccaacactctcttgatcatatcaataaaagaggaactctaggttaattggctacctacaaagaagagcccaagtgttctcttccttgtcaaatgattgtgtcaaagtcgagggagagaactgataggacgtactccctccgtctcaaaaagactcaatttctgggtttccgtgtctaatgtttaaccatccgtcttatttgaaaaaattatgaaaaaatttaaaaatataagtcacacataaaatattaatcatgttttatcatctaacaacaacgaaaatactaatcataaaaaaaattcatataagacggatagtcaaacgttgaacataaaaagactgagtctttttgggacagagggagtagatgagacgctgttgcaccattgtggaggaaagcaacaggtggcgtcggcatggaggactagactaaacgggaggcactgccatcacgcaggcgcggatgcatggaggacaataggagggaggaggcgctgccatgccgatgttggtgacatgagaagggatgaggagacaccactgctgcgtgcttgtacgaggggatcgatggaggaagacctagcgaagacgtgaggtttgattaatttagtcaaacttgttaccctttggagccagaattttgggaccggccaatgaggctggtgggtcagtccggaccatgcccatcccaactcgagaaagccaaagggccatcacctttgcatgtctcggtgcctcccatgccaatctactaagcatacacattttggttggaattataagataggtcgggttagatcgaacctatttttaagggtgtttggtttagctatgaacgagttaacaaaaggaaatgactattcctcatgtgtcgtggtgatgatatatgtgtctatctatcaccctaatctgaaacgattgatagtaattaaccaacagcatagcaccactagcatgcagctaagggacaatgagatagagcatgaanacttgcatatactgtatanaggatcacannatgaggcaagaagacatacngttgggtatgtgaaaactataagaggtgtaagcgtgtaaattaaagatctgaaanagtcttatgttttccgaaaaagtgcagtagaaaaaagcttggattggtggacgtattacctggttattgactcaggccccgtcaaaagaagtcttgattgattgagaaagtttgggactgggaaagagtaaaaaaacccggtgcacatctacctttttatggagcatggacaaaattaacttgtaggcagtaattgagctagcttctcggttcattaaagctcgacttgttttgagtgtgtatttaacgagcttagncaattgggggcatttttggagattgggctttaagtcatttgctctttaaccgaaccttttccccctgtttatttctaacttcccctttttctatgaaaaca

SEQ ID NO: 78178 - DNA, 27088 bp, Oryza sativa
cacctgccatttttcttcttagcatgtgtttttcccctgtacgtcaacggcaacacattcaactcttcattacgaattctcccatattaactctcacctaatatactttgtcaatctaaatcccttcctgaattaaaatagtgcgtgcgattatctgacgaactactgaggctattaacttaagcgcaaacgcgggaaattcgatagttcccgcgaaattttgtgcgttttgcaaagactactgcactcttggggcagctggtgtgctactgatcacgaagcatcgaaaattcagagggagttgatgacgaattcccagtcgaagctgccattcaagaactcccacaccggcgacgccgacgagtcggctccggcgaggtcgaatcccaccacgtccagctccacctccgacgagaaggagggagaccacccctgcgacgtctcgctgggagcgtcgccgtcgcagctcctccgctcgacggcgagcgacgacgccggctcacgcgaggccatgttccaagcggcggcgaagctcgacgcgcccggagttgatgacggcaggtggcattagttccccgtcccggcacgcggcggcggcggcggcgtcgcctccgcaggtgtgctcgccgtagtaggcgatcacgaacgccgcggccgggtcgtcctgcgactacgactgctgcacccgccgcgtggcgaggcagccctggcccctgaacgcgcagcggtagtagagcctcgggtgcttgcagccattgatctccttctgcccgtacttcctccagatgaacccgtccgtcgtcgtgccgctcctcacctccctcaccgcctccgcgccacgcgccctgcgccaaaccaagaaatcacctgttactaccttgcatgatagagtacaaaaccgtaccgttaccacacgattatcgcggttatcatgcacggtaaccttttcgatttttaataccacgatatatcttacggttaccacacggttttttcgatttttgataccacgatatgtctcgcggtagccgcgccaaaaaacaataaggggaacctcaccttcttttggtcggcgtgacggggagagaaggggaggtcacggcggcggcggcggcggactccgccgccttccgcttcttgccggtagtagcaccagtggctcctccccggttcagcttggcgatgacgcggtcgcagcagcggaggatctccgcggcgagctcctgctgctcatcccctgcctgcgccggggacgccgcccggagcagctcgccgaggtacgccgccgactggtaccccatcgtcatcagctccagcaccaccgccgacgagctccccagcatcgccatgctcctcactctcgcacgacaactctcagcttgggaaaaccgcgacgccgtgcagtgaagtgaccccgcacatcgcgtcgcgtcccgtatttatagaaccccgcccccaccaacgcggggtgggaaggaagcccgcgcgaaccaacgccgggtcgcaacgggcccaaaggcccaaggccaaccaacgcgactgacaagggagcaaatcaggctcagcgaccgagcacccgctttgctgctgcgcgatcgacaccgagatctccgccccgccacttcactcggcttcggcagctcgatcacctggccgcaacgtgattccccttccgctactacagtacacgtaactactctgtcgatgtccccaattatggcgttgtcgcgacccatcgatggagcgaggagccacactgtacactagtgctactcggtcactgtactcggctactcgatcgatcgatcgctgatgatgatgataaaactatggcgagagtcacgacgacggccgcgcgtagaagttgccaaaaacgtgtcgcggccaagtttttaattatgtgtcctcgatcgtcgccacgttacatcatcacatggttcagagtcctgtgttccatgtggatctctcatctgatcaactgagggcctgcttagtccaaaacaaaatttttcacgttgtcaccttaaatatttagacacatacatacagtattaaatgtagataaaaaaatcaattacatagttcgtcagaaaattgcgagacaaatctttcaagcctaattgcgccatgatttgacaatatagtgctacagtaaatatttgctaatgacggattaattaggcttaataaattcgtctcttagttttctagcgaaatctgtaatttgttttgttattagactatgtttaatacttcaaatatgtgtccgtatatccgatgtgatatacaggagcaaaatttttttccaactaaacagcccagaactagcacggtggccacatatatgttttctcaatttattattaaaatatattaaaatgataacataattttaaattttgtactaactttactaaactaccactgtctcatactgtattgtatatacgtgatagttattaattatttttaatatcaaattttagttatttctaaattgtattcttatatatggactgcagacttgtcttccaatattcctcatttttttagttctgaattctcgttatttgtaatttgtatttctatatagtctctaggctcttttttcaatattttttttaaaattttgaattttcattatttctaattgtttttctatgtggactttaaacccatctttcaatattctttttttttatttttgaatttcagttacttctatattgactctagactcttcttccataaattttttaatttcaaattttaattatttataaattgtatttctatatagactctaaattctatctttaattttaatttttattccgaattttagttcattctaaattcttatatggactctatactcttcttctaatatctgttgttttctaattccgaatttctattatttcttaattatatttctatatgcactctatacttttcttctaatattttttattttttaatttcgaatttcagttatttctaaattgtatttctatatggactctaacttaattttaattttattattgtttaatttcgaattttcattagttctaaattgtatatcgtcatgaattctagtctcctcttctaatattgtttattttttaaattctgaattttagctatttctaaattgtattctatatggactctgtttttattttttaaatatgagaatttctaggccgggagagcgagcgtggaggcttctagtctcctcttccaatattccttactttttaaattgtatttttatatggaatttgtttttatttttctccgattaatataataatttttagaccgtaaaagccaacgtggatgcttatttttctattactttaataagttaatagatagattgttcgattggtttcaataagatacgggcgatcgattccccccgggtcgtcgttggcaggaacagatcaacgcctaaatcttttctactaatgatcaacgcctaaatctccttctttagtaaaaccaagattacgatcacacgtgcacacgtaccagatgtacagagcagagagctcatgatcgatcgatcacatgcatacgcgcgcagggaagggcgcatgcaggggattgggattgaccgaaaaacaaccgcaagtgtaccacacagattcgctccggtcaaggtcgctccaaaatgattcagattcgagctcactgtaccagatgctaacttttttttagagtagccaacttctcggtgatgaacttttcgaagtgtcgtgctaaaattttactcatcaaactgatcgaagtatcggagtatctgtagataacttagggcaagtactatggacattcaaacataaatcccaagatgacacaaaagactaaatagtgaggtggaggagagaagaaggatgagagagaaatagtcacctctcatgcaaggggcagcccctacacaaacttcaataaacatgtgagagtgttagagatattgggaattatgtgatagagatagcctattatacatatcacctcttaatttaattatgtatgtcatgtatgaaattggatatggtagtcacctctaccataaaacttgcccttaaggagacaccaagttcatggtaaggaaataaaaattcccacattaatcggataaaaggaaaaaaaaaggttcaaatagaaatacaatttaaaaataactgaaattaaaaataaaatttaaacttagaaaaaaaaagaaaaataagagttcaactagaaatacaatttaaaaataactaaaattcgaaattaaaaataagcaatattgaaacaagagtccaaataagaattaaatacgagaaattaaaattcagaataaaatataaaataaaattcaaaattagaaaagaaaagaagagttcaggtagaaatgcaatttcaaaataactgaaattcggaatggaaaataagcaatattgaaagaagaatccatctgagaatctaatacgagattaattaaaatatataataaaaaataaaataaaatacaaaattaggaaaataaaaaagagagttcaagtagaaatacaattttgaaacaactgaaattaaaatataaaatagaaaataaatactctctccgtcccataatatagcaatatcagatgggatatgaattcatagtataatgaatctggacaagagggtgtctaaatttattgtaatatgaaatgtctcatccgatactaggttgctatattatggaatggacggagtattaaaagaataatccatatagaacacaagggtaaaggttaattaaagttcgaaagaaaaagtaaaataaattctgtaattagaaaaataagaataagagttcaactatagatataatttataaataactaaaattcgtaataaaaaataaaaactattgaaagaataaaccatatagaacacatgaccgagattaattaaaattcagaataacaactaaaataaattatgaagagagaaaataattataagattttaagtaggagtacaatttataaataaaaatatcggaataaaaatatggaatttttttaaaaaagttcatataaagcacaacgataacaacaaagatgggagaagcaactggcctataaaggagtgagtgacggcagttgatgggacatctagaaactattaacgaaatctcaaatataatcccaatgacgattaaaagaagggacgacggatagactgttaagagcataatcacgacagttggcgggacttctaaaaagtaaaaaaaaaagctcaatgttaatcatgttcgattttaaaaaccttaatgataatcatggtttctagcgtacaatatggtgcatccttttaaattgttttaataatatatagttagatataatattaggcggagtaaataattggtttcttcctagaactaactgagatacgtgtgatcgattcccgcgggtcatctcaattctcagccactaatcaacgcctaagatggtgtttggattcagggacttaactttagtctctatatttagacactaatttagagtattaaatatagactacttacaaaactaattacataaataaaagctaatacgcgagataaattttttaagcctaattaatccataattagagaatgtttaatgtagcatcacataggctaatcatggattaattaggctcaatagattcgcctcgcgaattagtctaagattatggataggttttattaatagtctatatttaatatttataattagtgttcaaacatccgatgtgatagggacttaaaatttttaacaccatctaaatagggtctaaagcttttctagattgtgatcaacgcctaaatctccctcgtcagtaaaccaaatattacgatcacacgtgcacacgtacccgaggcccagagcagagtttaattatgatcgatcaatcacaacacaggtatatcacagattctctcaggtcaagatggctccaaaacgtttcagattcgagttcaatgtatcagatgctaactttttttttctagatcaacttttagctaactgcagacgagttttggccttttgggtcttctaccaaataaaagtcaccaaaaaagggaacccttcaatgcaacgaacataacctcctaactctgagcgtaaatcattcgatgtaccactgtgtagattctctccaatttaagaatcattcagcgttcgcaagtcttgcgccaagtacattgcatctcattgtctacaacaaaagtacactgcatttctatatatttgtcttttcagtcgttcatgcgattctgatctgaggtgataaaagtggatgttttccagctttatgtctaactacaccgtaacctcctaactctgcgcgtaaatcattcgatgtaccagtgtgtaaattgtccccaatttaagaatcatccagcgttgaccttccaaaaaagaaaaaaagaatcattcagcattcgcaaatcttgcgccaagtacattgcatctcattgtctacaataaaagtcgtacactgcatttctatttgtcttttcagtcgttcatgccattctgaggtgataaaagtggatattctttccagctttgtgtctaactacaccgtaatactttacgtgtcaacccggagtgattgggtctaatccttttttccattgcacaagttgacacatgccatgttcatatcatatttaacgtacgctgactctcattgggacgtgagaacaatgactaggaaggtctagggaaaaaatatatatataacggggatagtgatgctttctcaccaggactacggtctaacgggacatgtgcagcaactctcgagattaccggttgcagtcaaaatttaaattttaaaagttaatttgaagttgattttagtttcgatcttgtacttattttattttttaacattgggttttaagtcaataaaaacatacacataaaaagttttacctataattttctttttctaatattaatttgctacggcttataagctctaggcgaaacgctcgggccggcttaaacaggtttagcttatactcctagttagtgctaattaaactcgttttgtactagtaattaactaatatctcggatcagtaccgctttcagcatgtagctggtgagtgacatattctataagttggatctccttattgacattggaccaagattgaaccgaacttggacaaataatagtacgggtcgttgggcatatgtgcaacttgatctcagatttattagattcgatttaaccagtctccctaacgcgctctaacatgacgctgatgttctcttatctcatatcattggccctggtatctgttggttgctagtgctctgatctcgacttagaaacctctccaggctgttggatgtgcatccaacggctgagtgcttctttcttaacctctccaagataaaatgaaaacggttggaaacgatatcatctctagaaaatagttcttgattatttgattttttttatttataaatttaagtatttgatgacatctttaatacgacgtcaataatattataaaataagtcaaatttatatatggctaaaatagaaaacggcttaatataatccatccttacagaaatgatactcacttaattggtcaggaatttctagcaccattatgttttccagatctttcttccccccgtgttctcaagattcgtgctcgaagcatctgacggctaggccgactcaggctaatcgtgggagagatgacgcataggcatagacaagctgaataattaaagacccgtgcacggtctggtttttctacggcctggaccggcaagcgcatttgacccgccagttttttctctgtcaactccagcagattgcatggcgagggcccatcacattttagaatgttccatccacgcatgcgtagttagtttcacgcaacaatacaaaacaacgctcaaaatctctgcaatttatattataaaccgctatgaagtcgctgtagcttgaggtctctgacagaaatctgttctgcaacacacgtacgtgtgttttgaccaaaaccggtcggggaaattaaatctcccttgtgatgaatatatactagtttgtttttaaggtcgatgaatatatactagtataaaaaactgcgaacacgcgcactgacgttctactgaccaattagaatttctcttctgtaggagtagttttgacccagatcttcgcatttgtcaatataagcataatatatatgtattccctggaaaatggcttccatggacggtgcgacgagctcggagttacttactgagtgatgcttacgcgatggcacgcggcaactaagcgactactcgcttcgtcgacttcattatatttgtagcaattctcacacatatcagtcatgtaaaatgaccatgatacctagggtttatattttcgatgcacgaaatctcgaggttttgacacgggttgaaagtagattatgaatgtaattttgaataattttttagaatccaaattggaaacatgaaaattcggatgaaatttgatcaaaaattgacaaaaaaaaatgttagactgctaggggtcgagatctggcatcaattggaaaccctaggtacgtacccactaattaatactctttgttaattgtattttctaggtagacttcagttaattagatgcattagcctgatttgcaataatccctagaaatcgtacggtgatcgatcacaaattttgaacgacttagtgggatagagggaaccggaatattactgtcagcttgacactaatattttcctattccattatctaacaaaattagtgtcagtctgacttagctcaatgattttaacacgcgctttggccagtaaaaccatgaagcccttggtaattaccagccaagaaagtgacgctactcaaaagtaagactggtgttgtttcagctgtctgcttgtgccatatgtaccatgtcaaatgtagcgtctttgaattcgtccaattgtccagctgatgccgacttaacgatcgagccacggccatgcatgtacggaagaaacggcgagatgatggtcggcaggtcattgatttggcaattatcgtgtttcttaaaccaacttggtgagtttcttctgtgaccagccagacgcccagagtccccagaccaacgttgccagcgttcagtttctgttgatacgacatgccatgcaaatatggaattgcagtaacaatttataactgacccggtaattaactcgagattctctgaagagaactcggacgccatttcagtgaatggctagctgcacagttcatccgggacgacaccaatatggtcaccaaatatctctatcagaaagacagacagaaacatggaaatgaacctctgtttcgagacccgggaccatgaaatggccggtgctgcagtaactgaaggtcacatcgcgtctcggtaggcagcagcacacactggagcggcacacatttttgcaggaaaccgtgtgcatgaacctgtcgccgatctgtccgttggtccgatgtcataggttacggcgggggggacgcacgtgtagcacgattagctagccgagtttgtttgcacggtttcattcaacgggaccgcggttcaacaaattctctcctaatgaccagcttagctagacatgcaggagtagcaatcatcaggcttaggccgaaatgggccggcgagacctgactaatcgactgattatggtaaaggggaccaacaaatggagctgcatgatgtgtggagtgctatgtattgtttagaacttttgggatagtacaagattacgtacgtttcgtaccttgaagatgtcaaaatattatacttctgaagaaaaaaaaaaggagtcatcgtcaaatttcaacagtaaagcttgtagagtcggccaaggacagtgaaaccgacccctagagagggagtagtaaagtcttcctatatgaaaaaaaaaaggaaggaaagggtgtagtattgactgtactaacttgaatgaagcaaataataccatggctgggaagtctatttgtaacaagtcccggatgacttactggtggggacaatgtgtgattgatcgctgcttttaacacactgttggtcacataagggcattagcagtgcatccggcttgtttcgtgtgaccatgtgctcgacatagacaaaaaagtgaatgaagccacacataacaaattttaatctcccacagtacgccgggctccctctcccctccccaggtcattcccctaacctccccaagccgacatgtctcctcccctttcccaccaccactggcacaactccacttctcccgaccgtcggtgcagctctccctcctctccgtcgctccccctccctgtcggcgcctctcaatcgtggacgccgcttgagcccagctcgacggcttgcggcggatgctgcctccgacctctccctccgtcgtttcctcctcgtttccggcctctccctccaccgagctctctagatccggcccgtgactcaccgaatctggacacgataagcagcaatgggccggcggctcgatgacgatgctggcgacggctccatggtaggcctacggcggcctctcccttcttccctccggcaccggcgcgacgtccctctccgttgctgtaacgtcgcacctctcccaggctgggcccacttacatctggcagcttttccagatccggcccgtggcttctcccttcttccctccggcaccggcgcgacatccctctccgttgctgtaacgtcccacccctcccaagtcaggcccacttacatctggcagcttttcttggatatagattgccctcacagaccaacacaagtcttttctgcacactttatccttacttgtgcacctgaaaagaatttcctggtcggtcacccatcccaaaattccaagcacgcttaaccacagagttctttggagatcggcttccagaaaagaagttgcaaacttgttgttatgagtattctattaatctatcaagccttgggccaggatgtcacagttgcgaatcggagagactggccgacgagctcggcggcgcggagaggagaatgacgagcagggccggcgacgaggttccctctccggtgctgtagcagctctctccggcgtcgcacggggccacgaagcgcgaggccatgacccccacagagcggccgtgccgttcttccctgcgtcgcacgacagcttttctaacgaagaacgagtgcccaatgtgggctacgtgaaccttgttcggtcacgctccaagctgagttggcggagaatctcgggttagccgaacgccacgcacgcgcattgtgaatgccctaatgacaaatacaacatatggtgccctcccctttctcttctgttgggaaggaaaacaaagagagcgtaaatgtcacgccccgaacaagtcccgagcggaactagcccgtgacgctccaaattaacctgttaatcgataccagtcccaggaaacagtgctggtatcacaggaagacagaatatcacagcaacaaaggtctctttattatagagtaggagtacagtcatgttgggctgcggacagatcccgagctcacaactgcattacaaaagggaagcggaagccaagacttatgggaaataagtgtttaatgcaggcttcaaggaaaggctgttgttttttttttgcaattgattttatttgaactcttttctaaaacaactaggtgagtgcttctcaaacgacacggatgagacagtgcgactcatccggtcggagtatgtgcaatgtatcagtcttttgaattgatcaagattggcacccagccaacagctttcaaacggccacccgggcctggctgatcccatcagccgcagattttccaaacatcaatcccgaaccacatcagcaaatttcacaaagcagtagtcaaacaaaactacgctaggaatcacctcacatccgcccatgaccgtgggcacggctgttcgaacagtttaataacctctgcagagggggtacactttacccacacgacattactaacccggatcatccagcccgtgcagaacggccacgactagagaccttaaggctttcatgacaaggcatttcgagagccgacacaggttcaccatatgctgacgagaggggtcccagaccaacaacaggttaggtcccagaccatactgtgccaggaagcccaggggtcctccccgacaccaccccggcgaatccacttgtctctcagcatcaaggctcccctgtttagctaattactcagccagggatgtcccattccacccatgtggtcgtacttgtcttatgttcggatgaaattccaaggaaacggtccttaagtgcaaaagcgggaaaccgtacacccgatacgttccccggtccgcgattttggaaattcatttaggttcgcaagcaccgacccaggtgtcgggttttccaagtcttttgtaaaacccaagttttacccaagatgtttctcaaattttaagtttgaaggcgaccgtcgatactcgtgcagagtgcacgattaccgaggcgcaactaggtggttacaagggaacatggtataacaattacaatggaagggtcaaatgcaacaagttaggtaggtccgccaatctgccttgcagacgggacaagtagattaagtgcgatcctagcaatgcataatatttttcaagcaacataattaagttcaaatataggctcaagatgttcaaaggtggcttgccttgctcgatatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaaattttagaagttgaacggagtcaaacggacttacggttgggaagatattgaatttctaagattattggatttttggtctaaaggaaaaggatttatttaaatcctttttgaaaaagaaaagaaaagaaaagaagaagggaggggaattagactttcctcgggcggctagggcgcgacccgagagaaggggtggctcggccgagcttaatgggccggccgggccaagaaggcggcccaaggcgcgcgcgcgggcggggaggggagagagagagccggtgggccaggtccatcccgcgtgggcccaggtgggacccgcttgtcggcgactcggctcaccgtgagcgaggtgcacgcggggcgtgctagggtttggggagggaggcgcggcgcatgcgtgcggttcgcggaggacccggtgcggcggagcgaaccatggcgatacaggcgaaggcgagtacaccgggacgttgcacaggacgaggggagacgagccaacgactcatattcaccgagggtgctcgacggcggcggattgcggtggcggcaatcggcggcgggagaagggaaaaacggcgatgaggtcacgaggggccgattcccggcggtgagagcatccacacggctacgggaatccaccccttacgccggattaggaggaatcgcatcgagggaggccggcaacgagaggcgcttcctagctcgggcggggacgggggcgagcacacagcgagcgacggcagcagtcggggcggcgccggctagctacggggaggctatacatgctactaccgaaaactaaggggaagagatggattgaggagggagaacggggagatgcactaccgtgcggacggggcgcagcgacgatgggccgacggcacgggagcgatctctccggcctcgggccggggaagaggaaggagagggtgcgtccggagtccccttccgcgtcctaacgtgcaccgactccttcggcacacgtgacggtggcggtcggcgatcggcgatcggcgagacagaggggacgacaatggcgcgggcgaaaaacggggaagattgggaggggaaaaggaagggagggcgcctgggtttatagggcggcgatgttggtttggaaaccgacctaggacggtcaagggagggagctagcgctcgacggtcgcggccaaagcggcgacagggaggggaggatgacgccggcgggagggaaaagggaaaaagggggagagaaattgggcttgcctccttgccactttggggaaaaggaggagggagagggagcgatgcagcagaggggggcggggctcagcctccgtcccttggaagccagcgcgcggcggtggcggggccgggtcgatgacgacggcgatgacggcggaccggtttggagtggagcggcaacacgggcgacagacgcggggcaggcgcggcaggcgttgacggcggcggcgactggccggtcggccaccacggcgcgcgcgcacgcgcgggcggcgcggcgatttgggcggcatcggcgggaatggcagcgagagcgggagggagggctctgcgcggctcacggaaaagcggggagagagagggattcggcccatcgaacccgagggaggtaaaatagacttttgcggagggatttgatttgggaaggatttggattcgggattgaactcgacaatagattggggatttgaggtctgagatggcacggacactagacaacaagcaaagaaacagatttcgcaactagggtttttaagagatagttttcccgctaagcgccacgacggaacgggtgctacagtaaaattcctttcttttatgggaaataacaagataggctcctactgtggtaatatgttaaaaagggaaagatatatacaaagaaaaagaaagaaagagtcaggggttgaacatttagaccggcgatgagcgctcattcgcatgtgctaccactgtgcaagtgttgtttttgtattagttacatgaaagttatatatggattatattatagttgcatgcaagcttatgttataaggctgtattcggtgggaagggctagaaacccttcctacgggcacgttaaaccaagcagtagattaatgcgtgcttaattaagtattattttgtcggtgacatgggaccgggagtatcatgactagaggcttgggcagccgcgatcacccacgtggcctgaccccctcgggggggggggggtcgggcccgagggtgatgtggccacacctccctttgtctccccgaggggtcggactgctcccgtttcgaccccgagggccggggcgccccgaccccctgtgggtttgccgccacgtatatgggttaggtgagcacagcggggctcacctaaccgcatttattgcgggttggacgagcgcgtcacgccgcatgtaatgcagcgcagcgcgctcgcttatccggtccgtgaccgggcgcagcgtgtgaccggtcacagaccggtcagatcgcaggttaggtggtggcaggtggcctgttacacgcctcgccccgtcccgtcggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagggagaaaaaaaaggagagaggggagctcgtagaaaggacgaggggaaaaatagtagggagagggtctctagagttcaaaggctcttgctcttcagctctttgtaactccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaactggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaatggccgaacgagcaaaagcgcacaacctctctccgagcgctagcggtgacgacagcgagcagaacccgcgtcgtcgagcttgtactccgccgcccccctctcgccgaagtcttaggcgggaggaggcgctcgagggggtcgaaagatccgcgacttcgccgcccatgagtgatggagaaggacggcgagacggggagcgtcgtctcctcgtctacggtgatggcagcacgccccagggcgcgctccaggctgcgggcgcgctcctgcgtcacccgcccgtcgtccctgatcaagagactccaactcgacgttggctagatgacgtggccaacttggtcatgacggcgcagcagcgtttaggcgccggcgggcggtcctccgccaccaaggccactggcgctgctactgccggctccgtgtcgtcgaggcggagggcgcggcgagcggcggccgttgcccgccgttcgtccgccattccctcgtcaatgcctccgacccaagaagatgtgcgtgaggggccggatgcccgcctcaatatcgagcgccggcgcaatgatcgccgtgctgcccacgcatcggagggcgcttcctcgtccggagcgccacttcggtccgggcacggaggccagccccccgtgtccccggttggcggtgccggctgtcgagactttgtggcgagccttcagaacgtccgttggcccccaaggttccggcccaccatcaccgaaaaatacgacggaagcgtcaaccccgccgagtttctccagatctacacgactgggatcgaggccgccgggggtgacgacagggtcatggcgaatttcttccccatggccctgagaggacaggcgcggggttggctaatgaacttgccacccgcgtcggtccactcttgggaggatttgtgccagcagttcaccatgaacttccagggcacatatccgcgcccaggtgaagaagcggacttgcacgcggtacagcgaggggacgatgagtctcttcgctcgtatattcagcggttttgtcaagtccgcaacaccataccatgtatccctgcacacgcggtgatctacgcgttcagggggggcgtgcggcacaaccgcatgctcgagaagatcgcctccaaggagccccagaccactgcggagctttttcagctcgcagaccgtgtggctcgcaaggaggaggcatggacctggaactccaccggttccggtgtggcagcttcagccgcccccggatctgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaaggccccagcggctccctctggcaaccggcgaagtgaggccaagcagaaggtccccgccgaggacattgacgatggcaacgatgacctagggttccaggagcctggggccaccatcgccaccgtcgatggggagcatgcgctcacgtttctcgccggagcctcaaggccatgaagcgagagcttctggccgcggcccctacccatgaggcgatgcggcgtgcgtggtggtcggaggttgccctcaccttcgaccagaccgaccacccgccgtgcgttgcccggggaggacagatcgcgatggtggtttcccccaccgtttgcaacgtgaagttggggcgtgtccttatagacgggagagcagccctcaacatcctttcccccacagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggctcggcacctccgtccccgccgccccgaggcagcggatgatcacgtgcgacgaggtcccggtcaaggaggttgccctgggcgacggcccgtccaagaccacacgaatcggtggtctgctggacggcaaataggaagacgcgctcgtctccttcctgcgggcaaacgctgacgtcttcgcatggagaccggcggacatgcccggggtccccagggaggtgattgagcaccgtctcgccgtacggccgggcgcaaggccggtccgtcagaaagtgcggtggcaggcctcggaacgtcaagccttcatccgcgaggaggtggcgcgacttctggaggccggattcatccgagaggttatccatccggagtggttggcgaacccggtcgtcgttcccaaggcgaatggcaaggttcgaatgtgcatcgactacaccgaccttaacaaggcatgtcctaaggacccttaccccctaccacgcatagatcagattgtcgactccaccgcggggtgcgaccttttgtgttttctagatgcatactctggttatcatcagatttgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaagagaccttactctcggatctagcggaaactttcgaaagtctccgcaccgcccgcataaagctgaaccccgacaagtgcgtgttcggtgtgcctgcgggcaagcttctcgggttcttggtctctgcccgaggcattgaggccaaccccgagaaggtacgagctatagagcggatgcgcccccccagcaagcttagggatgtgcaatgtgtcactggctgtatggccgccctaagtcgattcatatcgaggctgggagagaaagcgctacccctatttaagctcctcaaacgctccgggccgtttatctggacggaggaggctgaacgggccctcactcagttgaaggcgtacctcagttctcccccagtcctggtcgccccggagccagatgagccgttgctactttacctggcggcaaccccgcaggtggtcagcgcggcgttggtcgtggagcgtgacgaggacgaccctcgctccgcgcatccccaccctgtgtcgactcgacccgggagagagcagggaggagaggcccccgagccgaacggtggcccaaggcccccgacggccggagctggccctccgcccgcttgtccgaaggtgccaggcgcccccgacccccgggatggccacggggccactgcgggaaggccgcgcctgtcgccttctgaccccgaggtcgtcagcacagaagccgagtgcgccccgcgcggcctctcggagcgtgacgaggacgaccctcgctccgcgcatccccaccctgtgtcgactcgacccgggagagagcagggaggagaggcccccgagccgaacggtggcccaaggcccccgacgaccggagctggccctccgcccgcttgtccgacggtgccaggcgcccccgacccccaggatggccccggggccactgcgggaaggccgcgcctgtcgccctccgaccccgaggtcgtcggcacagaagccgagtgcgccccgcgaggcctctcggacgaagagcgccctggagatgcggcccctagtgaagaagatcggccccgccgaaaggtgcagcggcccgtctacttcgttagcgaggccctccgggacgctaagacccgataccctcaggcccagaagatgctttacgctattctgatggcttcgaggaagttgcgccattattttcaggcgcatcgggtcacggtggttacgtcttaccccctcggccaaatcttgtataaccgagagggtactggacgggtggtgaaatgggcaatcgaactctctgagttcgatttgcgctttgaaccacgccacgcagtcaagagccaggccctcgccgactttgtggcagagtggaccccggccgctgagcccatctccgtccccgaggccagctcgggcccctcgcagctgcctcacaccgcctattgggtgatgcagttcgacggctccctgtctcttcagggcgccggtgcgggggtcacgttgacctcgccgagcggagatgtcctcaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccgtgtgcggcgtatggagcgccattttgacgggatagagcttcggcacgtgcccagacgggataacacggtcgccgacgaactctcaaggctcgcctcctcgcgagcccagaccccaccgggcgcctttgaagaaaggcttgcccagccgtcggcgcgacccgacctcctaggggagacggacgcgcctgaacggcccccgaggcccgtcggagtccaggcctcgggacccgaggggagcgatcccagctcccttagattgattgcttggatcgctgagatccaggcgtacctcgcagataagactctacccgaggaccgcgaagggagtgaacgcgtccagcgcatctccaagcgctacgtactggtggaagggaccctctatcggcgcgcggctaacggagtcctcctaaagtgcattcctcgggaacaaggcgtcgagcttcttgccgatatccatgaaggcgagtgcggagcccactctgcctcacgcaccttggttggcaaggcctttcgccagggtttctattggccgacggctctcaacgatgcggtcgacctggtccggcggtgcagggcgtgccagttccacgccaagcaaacccatcagccggcccaggccctacagacaatacctctttcatggccgtttgctgtccgggggctcgatatcctgggtccgtttagatgggccccgggcgggttcgagtatctgtatgtcgctatcgacaagttcactaagtggcccgaggcttatccggtcatcaagatcgataagcactccgcacttaaattcatcaagggcatcacagcccggtttggggtgcctaaccgtattattacggataacggcacccaattcactagtgaactcttcggtgactactgcgaagacatgggcatcaagctctgcttcgcctcccctgcccaccccagaagcaatggccaagtggagcgcgccaacgcggaaatcctcaagggcctcaaaaccaagaccttcaacatcctcaagaagcacggcgactcgtggatcgaggagttgccagcggtgctctaggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcatcttcgcagagatgacctcgactacttggaagagcgaaggcggcgtgcggccctccgagccgcgcgctaccagcagagcctgcggcgctaccatcagcgccacgtccgggcccgatcactctgcgttgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcaaacaccttcgtcgtttctacccctagtaggggtcgggtgtcaggtctcgggctcgggccaaccccgcaccccccctgggcgtgcagggttggccgggggctaccacatgcatatacttatcttttttctcttccgtatttcaataaaagcattttcgatttcctaaggactgtgtctgtgccattgtttcctttcaaagagtcttggcttgaattagcatgctcgtgctcgaccctgccctcggtgtcccgggccggcggaaatcgccaaacagggcccagaatcgagccgtgccccggggcgtggtgaactccgggggggaatcggcaaaggcccacaatcgggtcatccataaccctcggtcaccacgttcccggcctggccagtctcgacacgtggatctccccaggcactagccccgacccgcgccatttgaggctgggacctgggcacgagccctcgttcaaaccaagacatagaaggaccacggcacagaccatcctcgtctcatacacacaacaaacagagctgacacaaaaatttcctctttatttgattgcagattaaattagtttgtacaagaagggggcccgaatgcctcggaagaagaaaggaaaaactatttaagattggcgggggcctgggggctcacttcgaggctcccgggtcgccggcctcgtcgtcgctgtcgtccacaccaccgtcgccgccctccacgtcggagtcgagggcgaacgcgagccgaggggccgtaccctcgaagctgtggacgatgtgatcggcggcgtcccggacctgcgcgcgcgcgtcgtcctcggttccgggagggaactcgtccagcgccgcccacggggagaagtccgggtccctggcctggtagcttgccagtacaagctccactgccccccgggcgaggtctctcgaggatgacttgatcgtctcctcgagctcctcgaggagccgctggagagtcccggccatctctgagaggcgctgggcgaggaccccatggttggcggcatatttcgcgatccgcccgccccagaggcccgcctgccgcccagcgcggtctagacgggagacggcgtcccgaagcatgccgggccctacctcgcctgccaagcggagggcctcgacctccccggcggacgagtccagcgcgccctgcagctcggcgatggtgtgttcggcagctgcgaggcgggcggctagatcgccgtcgcccgtggccgccccgccgctacgcgccctcgcatccagctcccttgcccgtgcctcgagctcagcggcccgctgatccagtgcggccctctcggcgcgggcaccttccagattgcgacacgtttgtttctccagcgctgcctcacgaagggacaggctgtccgccagcctttgcgccgcggcctcggcctcctcgagagctcgctcccgctcggtgagcgcatcctcgcggaggcggagtgcggactcctcttcagcacaggcggcttcgtgcgccgccagtgtagcctcccggatggcaacggcggcctcgcggtccgccaggtccctctccttcacacaggcgcgctcttccagcgccgtggcacgggcctcaagggcttcttcgcgccaccgggacgccgcctcggtctccgccgcccgccgtttccgggcagcagcggcttcaaggaccccccgggcggcgtcgagcttctttcctagctccggcgcccagctcccgtattgaaggcggaggtcgtcctgcgcctcgttcatcactgcggtggcgatgagggaagcctcccgctcctcctccacctccctggcgatctccgccagctccttccgacgggcctcgagctccgaggtgtgccggcggtgtgccttgcggcccgcctccaccatggcctccaccgagcgtcgcccctcttcgacacgtgcccatgcagcgtcgagctccgcccgctctgcctgcaggacctccatctgggcacttaacccgtccaacactgtcgtgttcgcggcggccaaggcctgcagaagggcctctgcgctcagtggggcagcggaaggcatgggggagagccgcctcggtgaggatgccgcacggctcggcccgccgatcgacgtaccggactcagggacgacccccggacctggcttgtcctgagcgtcgcccgaggggtcgggcccgagcggtgcgcccgcggcctcgtcgtgggtggcctcggaagtcgtcgtcgcctcgggcggagtcgggtcgggggcttggcaggccgcctggcgtgcgcgcgccgcctccgcctcccgggcggactcctcggcccggcggagtctggcctcctcccgagcggcttcctcagcccggcgagcccggacggcctcctgggcagcctcctcggcttcccgaaggcgatccgcggcttctcgccggtcagtttcccgtctccgggcctccgcggtcgccgtatcctcggcctcagaccggccggacttggaatggcgggaggggcgcgacgggatctcgctgaagcagaagaaaaaccagaagacaaacaaaacgggtgagtgaaaacttgcattgggagaatgaatacagccacagtgggcgcaggacgaacctgcgaggaggtcggttgaacgaccaccttgggggggagataaggtttccccggtatgattcggtcccccccatcttgcagagccgtttcttcttccgctccccctcgggctgcggcgtcggcgcggccccctccgggcgcctgctgctgacacgcgccgccccgccccctcggggaggagatggggagggggtaccctcttgcttcctcttccctcgggcgtcggcagggcggctgccccccgggcccctgtcacggggcccagaagcacgaccccctcctggggtagattgttctcccctgcggctcccgcccgcgccatcgtggcctcgaggagcccgctcctccgacgccccgaccgccatcatgatggtcaggatgttggcacgatctggatcgctgcagagggggaggactccttgggggatgagggacgcctccacggagctgagattcagcacccgttggaccactatcttgaagtcctcaggggcctagtcccatctgaccccttggtgggtcctcatgtagtcttcggacccggtgtactcccaggcgccccgggcgcgccgctggagcggcgcaatccggcgacgaaggtagtcgccgtacagcatggcccccgtgagcccctgggatcgcagacccgccagacggtcaagaacggcgtcgtagccatctcccagatctagcggcgcccgccaactggaggcctgcgctgggggctggctccgaagttgaaggcgcgcttcgtcggcgaggggggtgtagaaccagtcactcttccagtcgtcccacttcttgcggaggacgcagggaatgtagcggctcagcgccggcccccgcggctggaagtagcagccaccaactaccgacggcggcgacactggctgtacggtgaagaaccaccgaaactgccgaagagatgggcgcaccccgataaacatctcgcacaggtgcgcgaagatggccaacgtcattatcgcgttgggggtaaggtgcgccatctggaggtcataaaactccagaacatccatgaagaaagaagagaatggcgggaccagccctgccattgcgaaagggaggaagaagacggaccgccccgggtagtgtggtaccgggcgtccctcgcctagctcgaccacctcccggccggtggcagatgccggcatgaatcggcgcggcagcccggcctgcctctcgctcacgatgcgggaagacggcagcacgctaccgtcgagtggtgcggagccccgtgccatgacgccggcggaggaggagcttgaaaacgagtgagtgcggcgagggtagggcacaggaaacaaggagttagggcgcaagcggcgaaggcaaggggaataatgacgagaggaaggaagcgaatctcttcctcggcgtctttatacccttgccaacgctatgcccggctcctcgcttcccgcgcccactatctcgccccctcgtttctcgcgcccacgtctccactaattccgctcgcccgtttgcggcgcacgaggcggatgtgcggctgtggcagttgagatgggacatatcgtgcgcgcgttaactacgctcgccgaccgaagcgccatcatcatatctccaggcaaaacgaaccggctcgtcccgattcgcgtgctactcgagtaatgtagcggtcttgaagagaccgctcattatagacagtcggttttccgttgctgatgtgcgcgatttgcgaccgctgggtttctgcccgcctgtagagaccggccccacctgtcaccaggcctaaggagtggcgtcacgcccgagcgcttccttcgaggggggcgatcgccctggcataacgccgggggctactgtcggtgacatgggaccgggagtatcatgactagaggcttgggcagccgcgatcacccacgtggcctgacccctcggggggggggggt

SEQ ID NO: 78179 - DNA, 14894 bp, Oryza sativa
ttcctttctctgatgatcgcgacgattgccacagtgaccctatcggtttgaccaccgcaaggaatttcgctgcgcggcacgcctgcagcaaaagatggtggatggccgaaacggggacgaaaggcgacacggacaggtgagatcaatgtgcgtgtgaacccacgcctcaatcacacgcccggatgcccggaatcccgtggtaattaagctcgattaattaataacaatactaacagtagactactactcgtagtacttggggtaagtactatgggcatccaagcacaaaccccaaaatgccacataggactaaatagtgaggtggaggagagaataaggaagagagagaaatagtcaactctcatgcaagaggcaacctctatacaaacttcaataaacatatgagagtgttagagatattggggattgtgtggtagagataacctattatacgtatcacctcttaatttaattatctatgtcatgcatgaaattggatgtggtagtcatctctactataaaacttgcccttattacgttctccctccgtaaaaaaaagacaaaccctgaattttcgtgtccaacgtttgactgtccgtcttatataaaattttttataattagtattttcattgttgttagatgataaaacataattaatattttatacgtgacttatctttttaatttttttataatttttttaaataagacggacgatcaacgaacgttggatacataaacctaatatttgttttttttttatggagggagtaacggctatcagcctatcagcaaaagaaactactggaaggcaatatatacacggcagatgcacggatctgattagccggccgggtagtacgtgatttgaccgtatttctggcctcttcggccccaccccgctctcgcgctagcagcctgccgcctgccggctgcgtggctggctgggctggctcgacggtgacatcacgacgcgggcgtcacgctgcgccgctgtgggcaacgtcacccgtgtgggcgtcgccccgagttccccacttgccgccgtgcttcgtcaggcagcgctatagctgccgatggcgaagtccgcggatcgtaccgcgcccaagtgagcagaggaggcgaggcttcccgggccacgtgaagttgacggatgagaaggcgatgtacgttcctccgcttccgattccgcgcgcgcgcgcgcgctcgtgcaaagcattgggcatactgggcggcccggtgcttgactgaaatcgacgtactgtacgtcttttttggtactgtacgtgcggtgcttggctggctgcaaggcgatgtgtgcggtgcggccttggccgggcgtcctttctctttacggtaaagacggggagacgttggctgtgtttagtttctaaaaaaaagttgaaagtttaaaaaaaagttaattttttttaaaaagtttaaagtttatgtgtgtagaaaaattttagatgtgatggaaagttgaaagtttagggtagttgggggtgaactaaacacggccgctattgctacaaccacctccatcagctcgaggatgtgaaaacacacctgaataattgcatatgagcgatgatggtaaatgcgtatgctactacatggtggatgcatggatgtcaaaaaacgggggcgttttttgttctatgtgtttttggaaggccgaaagggtagatatgaatgctctgcggaaaaatgtacgggaagcaatatgatccgtcgccgcggcggccagccggccggcaagtcatccatcggctcatcgtcagacagtgatgagtgatggactgcgaggacggatggcacatcgccgtcgaacaactctacatcctgcgccgtggcgtttcttccatttgtgcttgggctttgatcttgaacggcgcgggtcatacttcataccataccatgccgcaatggtcgccacgacaccgagaaaactgggccggcgcggagccgtcatatgtgtgcatgtgtggacgtcattcggactttctgagtttgtcctttggcttatcagtcagccatcaattgctacctccttacttatatatttttatatcaaacgtttgatcgtttgttttatttaaaaaatatttttttaaaaaaaatagtcacacataaatttttatttatgttttatttttatgttttattatcgaataacaataaaaatactaataataatttttttcaaataaaacgaacgatcaaatgctgaatataagtagtacaaaattagtatagttatttagcttacccgagccaagtcaaccaactgacccaaccaagccaattcattgttgtcaatgatagagcgtacacatccttagggtacccacaatggttatctataggctctctataagagatccatgtcagcatattttcctacttggaagagattaaatgaagagagagagagagagagtaaagctatctactaacctggagatagtctatagagaaaaaacgagacaatgtattagagagctatagatacccatatagacatactattgagatggtttactattaatttagtctattgttgagatgtacatgttttatagatagcaccttactttaccattgcgggtgctcttatttctgaaggcaatggaaacaagctagaaaccccaagggaaacaactaaataaattttaggataacttaactagttagatttcttatggtgcaatctaatctacttaaatttaagttttagacttaatacatatgctcatatttagaataattattctttcagcagtagacgacatacctgttgagagtaggacgtatcttgatttcgttagtctcaaaatatgcatgtccagttttcgaaggtactcatcgtgatagggtgaaagtgagagcacgcacatatataaacacctgatgtctgtagtgacttcgctatctcaaaatatatatgctggcctactttattgaggtgcatatagggattaggtgtgagcgtgtatgcattaataacagtggcagagtgcgcgcgtgtaaatgaggacttgtgtttttacggtattgaaaaaaaaacctcttgttagggttgtgtaactaaagaacagaaggtgattttctcaatgccaacctctatatatacagaggtgaactctagaaagggaagagactctctctctttttttttcccacgttggttggttcaaccattttcccttagcttaagggtacacgtacctacttgttatttatgcaacaacaattggcaccgtctgtgggaaagatgtcaagaaatgttaggtatagatcagcgaagctcaaaggttgttatgttggacgaatgccgaaatgttcgacgaagcttaaaatatgacaaaaaccgatcgatatgatcgacaaagccgaaaatttccgacaaagaccggtataagatcgatgaagaccacatatggcctcgaaaacctattctctaaggcttcctccaatggtgccatgtaagctatctcataacatgtccacgtcatcatgtatcctatgtggaggaaagagaaggcaaaaaatcaatccatctatctcctattcccacgcctatctcgctcagttaccgatgccgtatgagcctgcgcaagagacaacagtcgactcttccacgccaaaatcagatcccgtgctcccttcccccaaattgccccgccgcaccttccgaccacccccgtacgctgcaccccgttcaagcccaatcccgcgcgctgcaattcgctcccccaccccctggcgcgccaatttgctctcctccgcgcaaatcctccagccacccgcgcgccaatctttcccttgcaccctccctcttttcttctccagtgtgtgaaatctttctcgtcggcgtcgacgtatccgtttccacgagcccaacgacgaatccactcctcttgccaacgacgacgagctgtagagcaggatgagctgccggtccaaacgacaagtagctccgcggccgccgccgtcgtggtcgccgccgccgccgccgtcgggatctgcgactgcctctaggtgcttcgatgctgcctcgtctgccttctttcaggccagtactgcaatggctcctcctctaggaggccaaccacgtactgtaccgtacactcaaacctgatggggattgtagtggctctgccttgcttgcttcctggatgttggagtagaacaataagctgatgatgctctcaactcctttgaccttgcatcctcagattggtaagaaaccaatttgcttgtgtgttgtttgtgcaacaaacaagcaaattcctttttgttgagactatttaaattgtagaattaataatggttatcacacataggagacaggggtgtctgtctcgctcaaaacatgatttttggctcctgatatttcagtggtatggatatacatccacctggtggtttcctaagcatgttacaaactggccaacagccattagtcccacctcatgttttgttcccagcaacatggccacctatgccacctatggcaccagcaactaattcaggcactacgcatgctagatcaaggtcaaaagccaaacctgtcatcaacttagatgatggtgacaatgttaggactgctaagcgtcttacatgggcatcagatgaggacttgcggttggtgagtaaaattttagacaacttgcagggatttgtaccatcattctaaaactttactaatacataatgctaaatgtaggtgagtgcatggctgtaccactctaatgatccgatcaatggaaatggcaagaagaatgagagctaccggggagatgtagttgaattatacaacaacactacacctattaacccggaaaagggaagtaaagcatctcaaagatcaatggcaaaggattaagagatgggtgggatttttctgcgcctcctggaagaaggctgcattagtttatactagtggatattcagatgatcagttgagagactttgctaatcagttttatgtgaatgactatcctaacgaaggtccattcacagttttgcactattggaaggttcttcatgatgaacccaagtggcatgctgttttggaggagcttgaaaagccacacaagcggagcttggatgatggaagtgacacactatcacaaaaagatatcggagaaaaggagcgtccaatggggaggaatgaagctaagaaacaacgcaatggcaaaggcaaaggtaaaggcaaggatgatgatgacagtttacatgaagatatgaagaagtacatggatgttcaagctgcagctagcaaacgacatgaagagtttttagggactcagcaccgtatttcagatgcaaaagttgaagtagcaaggcttaggagagaggctgtcttgacggaatcatatcaaaaattgatgagcatggacactagtcaaatgactaatgagatgaaagctgagcacgtgatgggtctcaagatgttgagggagaaacttcttggcgatataatataaggtattttctgtcaatcaccatgcactttatttttagtcaatgttcaacaaatgaccatgtattgtaatatgtattcttagtcaatgtaccacaaataaccatgcattgtaatctgtattattagtcaatgtaccacaaataaccatgcattgtaatatgtattcttaatcaatgtaccacaaataaccatacattgtaatctgtattcttagttaatgcaccacaaataaccataaattataatttgtattcttagtcaatataccacaaattaatctgtaccatgtgactatatattgctctgttatattcagcctagcaaaacaatccagcactgtcctcctctgttccttctatccagtactattcttcctattctattctgcctcatttgttccttccatctagtccaacactgcctcatctgttccttccatccagtaaaacatgtcggatgagtttgacaattccatagacccagccgagatttacactacagatatgttcatggcagagcatagtgtccttaactcttttgccgggcggatcgacaaaaggattaaggccagattggaaggaggtacatctaggcgtacaagtggtccaaggaagtacatcaataggaaccatgaaggagcccatgatcaactatttgctgattattttgctgaagatcctctctactctgctgcaacatttcgtagaaggttccggatgagaaggcatgtgttcctacacattgtggatgaactaggcaagtggtcttcctattttacacatagagtagattgtactggacgccttgggcactcaccattgcagaagtgcactgcagcgatccgtatgcttgcatatgggactgctgctgacgctcttgatgagtacttgaaggttccccagagtactgctctagagtgcttagaaaattttgtggaaggtgtcgtcgaggtatttagtagtaggtacctgcgtcgccccacggctgaggatctcgagcgtttgctccaagttggagagtctcgtggattccctgggatgttgggaagcattgactgcatgcactggcgatggaaaaattgcccaaacgcatggaagggacaatatacccgaggtgaccaaaagtatccaactattatccttgaggctatagcttcatatgaccttcatatttggcatgcattctttggtattcctgggtccaacaatgacattaatgtgctcaatcagtcccctctgtttattgaagcaataaaaggtgaagctccccaaatccaatttgctgtcaatgggacataatacaacacgggatattatcttgctgatggaatttatccggaatgggcaacctttgtaaagtctataagatctcctcaactagagaagcacaagctgtttgcaagggaacaagaagggaaacagaaagatattgagtgtgcttttggggtgttgcaagctcgcttcaacatcgtgcatcgtccagcacgatcatggagccaaaaagttcttcgaaaaatcatgcaagcttgtgtaattctccacaacatgatagtggaagacgagggagaaatggcagaagatcctattgacttgaatgctgccccaggaacatcaattgttcttccaccagaagttcatgcagggagtaatgatcacccaagcttcagcgatgtgcggcgaagaaatgcttatatccgagccaaaccaatccatagtcagcttaaaaatgacttaattgagtatatttggcaacggtttcaaactaggcaaaataattagtcactgttatttcagtataatgtaagctctagtgtacaatttcattgtaattttatcttagactgactgtatttatcactttcacttactgtacatgtttttctctctaccggggcgaacagattcgatgtcttttacttgtttttgtggctgcggtccagcttttggtgatcttgttcaaggaatgggataagcacttatggttgctgtccagcttttggtgtttgtcgaactcttctatcacttctgtgacgtgatgcagtcttttttttcccttcagtttgctcttttccgcattgtactaaagtgccatgatatggctatgatgttatctggttgctgtagtggaccgtgagttggaagaattgcacttcattgttatatactctaagtcgatgttgtgctatttatctatattcacactatgctgagatgttcatttttaatcgacagatcttttgaatagcatcacatgaaggaccatagagatattgtgtagtttatcaccatgtcatttactacccatgctgccataaaagcaagaagagataaccttagagacagttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcgggcttcagctccactccacaggcaaaactcaactgaggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaaggggcgagctatacttcagatcaagcagttacccactcccgcttgtggcaagcgctgtaagtcttccagggtttcccgtgaaccggtccttaattgccatgggtgcgactcacaaaaccacgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacaagctagtcgatttattacccagggttgacaaaggatagataccaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccaaaacgacggattctacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatgaattttagaagttttgagccatttaaatgaatttctagaattaaactcgatttattgcgcaattatcatttatttttacaaaggaaatggacctcgctgacgtcatcaagggggaggggcggcgccggcaagcgggccccaccggtcagcggcacatgggcgccggtccaccggggaccgggaccaccgaggctgtccaccgccggtccacgggaaccgacggctcggatcggcacaaagccgatcggacggtcacgaggcggcgcggctggggcacgggcacggcatgagaccggctcggccgacccaaggcgcggcggcggcatgcggccaccggcggcagcagccggcgacgaggaacggcggtgggcggccggaggacagcggcgcgcatggggacggcgacgcaccccaagaggcggaggtcggcaagaaaggggaacgggaaaaaaaggaagggaggagaggtcctcaccgaaagcggcggccggcgcggaggaagatgatggcgacgacgattgcccgatggcggcttgcgaggacggagggcggacggggtcgcccttgaccttcagaaagagatgagggagttagggaggggaggaccgatgcggggtgaccggtaacgacggccgaccgcgacgatgtgagaaggatctaaccgatgaccgaggaaggaggagctccggcggattttcggcgaagaggggcggcggccgaggttctcctcgtccttgcgaagctgagggaggcaatggcgcgggtcggcgtcgaccgaagcggcggcgcgacgcggctggagtcggcagcaagcggcggagagaggttacacggtggggaggtggttccgatggcggttgaaggaaaccgagtggcgaccggcgtgcggcgcgggatggcgaagctggcggtggcggcggctcggcgcggcaacggctgtggcggcgggaaacggcgactggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaaccggcgccgattttcgcggggagagtgggggaaatggtggaggacgtggaggggatcgtgcccacgtcgttggatgcgagctcgggtgcgggagggcgccggattttgcggcgacgtgaacggcaatggcggttggggtcggccggcgagaggtaggaggaggagctgacgggtgggaccgccggttccacctgtcggcgaagggagagaaggagggacgcaaaacagacttttgcgagcgggccaagtgagaggggagccggcccgagagagggagaaggcgcgcgggccgcgggagaggaaggaagacttgggccgaaagaggcccaaagagaggagagaggattttaattgttttctttttattttaattgattaaatgaactttgtgactttaaaactatttctcgagctccgaaaattcgcggaaaattccggagagtattttagggcacaaagaatattgcaaaatattcccggccaatgatttttaagggaaaattttaattctcccattatttcacttgattaaattgatttaacttttatttaatttctagaaaatgtattattaattgatttttaaacccgaacgaaaatcggagcgttacaacaattcattagagaaactatctcttgttctatctcttagatgatgtgtacgatttatgagctagcagttgtcttcaaaggacctttgaaggaggcctaacatggggaagactagggagtagtcttgtctagtcagtgacaatccgataatatcaaatgcgtaacaacagcatgccgcatgcgtggctgtctacatccccgggccgccggccgcaccacagcgtttcatctgtgcggtgtttgggcttcgatcttgaatactagcggcataccatgcctcaatggaacgaatcacgctgcctatatgtcccatccaattaaaagttgctatattttaatatggagggagtagaatggaggaagtgtcaagtgtcaaccagcttttcaaactaatcggggtagtcgttttcgttgaggactagcacaaacaactagagtggaaaataacggcgcatgagacaagctattactgggccgttttcgagaaaggctgctgatacttgtgctcaaatcggcccatcaggaatagtgcgtttggccgatgatgattcgacagttcttaaaaataaggaagatgatgtgagactttttttttaaccaataaagatgatgtgagtgagacagttgccagttgccacggatgaagcttgggattgggagtttccgaatttggtatcaataccgagctcacatacgtacgtggcgagggaccacagtgttgatacatacgtgcagtcattgctagtgctaacacaactcgcgatccacgagtcaacacacccatacatgcacgaactcaaccacaatcccatacatgcacgaactcaaccacaatgattaaatttcctagctaattaagccagacagctactgtgacgaccggctgcctgctcgtcctggtacgtacgttcacgtccaaccggtcggcctgatgtcacagtccagtacagatgtcggcctgatggaacgtcctctcgtacaatgcaacacaattgcaaatgtacagtgttgcattgcacgagagttcgttccatgcactggtaattcttaaatttgtaccatatatgcgtacgatcaatcgatcgatcctctcatcgacgacgtcccagcagtctcccatgcactcgtgtcgcgcgtgtaccgcgggcacaccgtgtccgcgatccgcgccgcgacgatgcgctgcacgtcgccgtcgtcaccgatcaacacacggtgatccgctgctgctgccgccccgaacgttgactgatcgtactggccgaaacagtagtccatgtcggcaatctgcgccgccgccgcctcgtccgccacgctctcgtccgcggcgctcgccgagtgtcccgccgcgaacgccacgaacgccgcctctggggccgatgtcggccagatcaacggcggcggagcggctgcggcgcctcctccgctgatgaccgccgcgaggcacgtgacgatggcggcctcctcttcggcggcgctgccgccgccgccgacggcgtggggtaaaagaagacggctaaagaggccggcgccgttcatcgtcaggtccaacatttccgccggcggggaggaggacgactgtcgttgccggctcgtcgtcgtcggcgagctacctgcagtgttgggcgtgccgggaacagcttgcggctgctggcacgtgtgctcgttgaggtaggtgacaaggaacatgggcggctcgccggcgtcccgctgctgcacttgcttcttcgccgcgcaactccgctcgcggctgaacgtgcacttgaagtacaacctgcatgcgttaggtgacacgacgggatgagagtcctctatcataaatgttattatcaggatgtggattttcatctctcgaggaatattacctcgttgtctgcatgtcatctaaatagttatcaaatttttttaaaaaaaatagtaaatatattaatacgaaatatatcactccacaaacatataaaatcaaatttaccctatacatgttgcaacaaaaataacaagttagactaaaatagttattgcacattcgcaactatattttttttatctttggtacaacttataacagttgaatttaaacttgcatgtttgtgaagtgatatattttatcttaatctatgctgctatttttttatattttttatgaccatttaggtgacatgcactaaatgaggggttatcccttcaagggatgaaatcactttttcttattattttacacacatgtgtaatatcattgttacagaggacgtgaaccggcacgacgaagcataggtcaagttaaagaattaattcaagtgatttgttttggcaagtgtatggctaaaacatgccgcctaagtttttgtctagactttgaattatttgatcgaggagtacgtgtgtatgtacgtgtatgacgattgacgacgaaggttaaggttgaccatgttgacggcaaagtcaagtcactggactggacattgatatgctgcatgcatggatgcatttctgtaatattgaacttccagaaagcatgttctgatctgatgctagctatcaactgactcagtctgtagtccaatggactaaaacagctaggttaattactctgaaattgacttggacattgtgtgtgttgcagtgtatattggttaatgcttaccaaatctggaggttgacataacagttcttggtagtactttaggaatcatgtggtttaagttgtggttagttaaaattggtaaagtaccatgcatattctagcgaaacaagtagaaagtagaaactacactctacccaccttagataattgctgtcctgaatgttcttttgcccgtattttctccactggtagccatccttgtacggggaaggtgtaataatctccgtcctcgtaaccacctcttctctgccatttctgacaagaacctcttcactcctacagtagtattccatatatatcaatttgtcatcaacaaaagcaattatcgattcagaacatattgtaaacatcgataagaactcttctgtttacctaacgcgtttaaccctcgccggagtgtgcaagcaaatgctatcgtcagtcctcgtctccggcgccgtcctggtcactccttccggtcgtctgctgctgttgctgcaaggcttcagcatgtagagagacaccatgaacactcgcccgagctctctgctaacatcgacggcctccttctggccgcggctatcgagggggccttcgagcagcgcctggagcttggcgctgaggcggcggccgccggcgagctcccggtacagctgctctatggtatcttgaccaaatgccatcttaatttgagctgaaacttgaggcaccctagctagagcttttgacaaagtgagaaactgagaatcctttcaatttgcaacgcaaaggagttgagcttgagtagctgcagtaggcagctttgaagctagctgctactccagtatttatagacaggccgacagtctgcatgcagtggtcatcagccttgcaattgtcagttttcttcagggatgctccaccagtttcagcatatataatttgggtctgactagctcaaaccctgttcattaattaatgttgatcattgatgtcaacggctgggcgattgatttattctggtcttctgaccgatggatcaatcgatagattatcttagatgggttgactggttaggct

SEQ ID NO: 78180 - DNA, 16571 bp, Oryza sativa
ccaactccacttgatattcgccgtttgcgaaatttagtggtcgtctgatcagccggtcaattcttcgattctcctatgtgcaagggaagagaatactacccgcccgtagcttcaaatgtactaggctgcttgttatatgattatatccttctggatcagtcctgctgtcctggtctattatgcagaatcgcagatcgactcggagcattccaacttcttccaggtgactaatctgaacttttcacaagtctctcctgatccagaaaaccagaaacaaaagataccacaatagcattacattgcctaattgcagtctcagtttcacaccgcacaatcggtgtgaaccatctggtaattgcctcgccacggacagatggaatcgtggaaaacttgctgtaaattactagattattagtactattagttaatgattacacgagtaggccagccatttgaacacctgtaatgcagagtgtccgagtagtgaggcgatcacctaatccgagttccagttcaaagttttcgtctgattttctttttgacagttaggttttgctgcctgctgaacccaaaggaccagggtttgaaccttggacaagtttggtcgatctgtgcgtgtttatcttacatcttatcatcaaagtactaccactattttgtttgtggctgtggtcttctgttctggttcagtatctattactgctaatttacatatgtgaaacctttcatgaaaacgtggtggcagctcactggcctgcaagcacgtcaaactaccacagttgcgtactactgttgaaattctgatctccggtttttgtcgtcgtcgtattctctgacaaaaaaacaagcagcagcgttttgttttgttttctgtcagagaataagtgcagccataaatatacgtgcacagctttttgaccatccgtcttatttaaaaaatttataaaaaatatttaaaaaattagtcacacataaagtactattcaagttttatcatctaataacaataaaaatattaatcataatctttttttaaataagacaaacggttaaacgttggacatgaatagtgctaaaactacacttatttttggaacggagggagtacaggctacaggctaggggacgtctcagcatggggagttgggaatttggggttgttttctgcagatgcaaacagtcgtcaggccttttccttcggagagaatcgtcacagaaaattggtctaatttttgtgtgccattgaaaattgtttttttcctatattccattgttctaaatttgtgcactctctcatgtcactcccgtgtgttgatcgttatataatcagaatgataaatacgtcttttttatttgagagttaacggtcaacacacggtcaacagatgtgagtgtcatgagagggtgcacaaatttgaaacaatggcatataagaaaaaagtcaattttgagtggcatataaggaatcagactaattttcaatagtatataagaaattctctcttttcgattccttggttgatacaaggccacgaccgcgaaacaatcagacacaatagaatgcaaaatggatgtaagaaaaaaaatgaacttgtggtagtggttctcctataccaagtagaaacataaatgagagcaacaagacgtgtactgtatgatagaacgagagaaagtgaccctattggaatgttactggaggtctggagcacggacgaaaacgatcgtggcaatcaaagttaccttacgggaattttccaaggcataagccacagaggtagtagtaaatactactcccccgtagaaggaatgattcaacgggggtggcgagccatgaaatcagttagcgagcactcccccttctctttagttttaactatctatattagttaatatacttaacattaatgatagtaattagacaagattctgacgatttttttgggagatttttttactaatagattaaaaaaaatttaagttagatttgaaaactttcgatttaagttttaaattttaaagtcaaatttaaaaaactttcaactcagatttgaaaactttcaacccagatttaaaaactttcaactcagatttgaaaactttcaacccgagatttgaaaactttcaacttagaatcgaaactttcaactcgagaatcgagattcgaaaactttcaagtccagatttgaaaaatttgaaaactttcaatttgagattcgaaaactttcaaatcaagattcgaaaactttcaaatcgagattcgaaaactttcaaatcaagatttgaaaaaaaataaaaaattttaaatctgaacttaaaagtttttaaatcgtcaagttcaaatttgaaaattttcaactcaaaatttaaaaactttcaaactcaaaatatgataaaagattaaaaaaataaacagaaaaaagtgtgaaaaaaaacgaaaaaattggaaaaaaaaggaaaaaaaaagtcagaggacgcgcgcgccggggctgggccctctgggccgaaacgcgcgcgcattatcttttctgtgattcaacgggcaatactgacaagaaggtagtcatgtgcaggtgctgtcagtctatcagcatcgacatctatgcctgattacgagaacaacgtgctgctaatcccgggccttggtataagattctgaaaagtccatcttgatttagctttgttcgaatagtaatatttctcaaaatactctaaaaacgagctactactatgtacgagcggcacccttcgaatctcaaaaataatactatacagtacgacattacggctcatcctactcgggtttcgacgtattagcgtcatcacgccgtaacatcgatcttttgaaattgggcatagaccatcaaccaccgtcgtctgaccacgaattccacgaaacatgtgaagcacacgctctcgcttgatcatactgcaaaaacgtgaaacgatgtatatggcgtcgcggccagggcactcgcgtaagcccgagagcgatatggatcgatggtggcgagctgatagctccactgagcgcgccggagaagaactctctcgtctcgtcccgaccgccggccgccctgctcaccgaccggtcgtcacgcaacgcagcagccaccggcggcgaatccgtttccgggcttctttggtttagtgccctactaaagtattaaagtattggtagtgcgaaaacttaggtatgttttggcactatcaatattttggtagggtagcattttagatgaatggatttgtattgataccaattggagaccaaattttatattatagttaagaaagttctagaattatgccggcagacagcgacggcgaaagcgatccggagaaaccgctggcaaaagatactgttatcactgtaaccgtcaacgacgatgacgacgcattccccctcctccctcccggctcctgctgcccgcaggctcgcctcgcgacctcagagcaagtttaatagctaactactgtctctaaatcatctataacaaatcaaatagtccacttataaaataggtaactataaaaatatactacaccattaatacccggtctcacttgtcatacacacataacgttttggagtccgtgttgcagctgactataaatttgtagcccgctttcttctctcttcttttagaaaatgaaaatgggttatatctccggcttctctcataagacacacaatcataaatttaatagtaataaaaatgtaagataaaagtaaatcaagatgagaaataaggaggtgggataattctctcccttaatttttttcttgatatgtggttatagctgacttatagtgctattgtactgctctcgcgccgccgcttctgctccatccttccagcgaaatcccatgcgaaaaccgaagacggcaaagcgtctagctagcttgtcgcggggcagcaggtgggggaggggaagtaggagagcgtgtgaaaccaagcaccgcacgggcaggagcgcgacgacgcttgatagccaggtagctcgtgaaccaagcccaagtagggatggcaatgggtcaggtcgggtacgggtagagcaaaaccatgcccgatccaatgcctaacattgcccacccgaaccctacccactagagttagcgggcaaaattccgtgcttgtacccatgcccgacgggtacccaatagatctcgcatgaataataacttgaaagatatgtaatttaacaaagagaaataaaatcaataatttaccaaattatcggttattgacaataatttgaattacatcacaacttagtatcagttagcatcacaaatgaaccaaaagaaatggtataagaattaagaaatgagtcaaaattagctaatacatatgtatcgggtcgggcatgtgttacctacgggtaaaaaatgaaacccgccagttgcccatgacgtcttcgggtctcgggcggacgtgcccatgggtaaaaagtcacacccacgtccatgtccatcgggtcgggtatccacagatacccgaactcatggataaaattgccatccctaagcccaagattccagcgttaaggccaaaattaaacggtgggggcgcctccatccacactccagagagagtgctaactaattgcatatgcgcactgcaaacaaaagatatggtcttgagccacgcctaaaacgacagatccgtgtgtagtgatgagtgtgtgaactgtgtgtaacatgcaatgaagaaaagaggaggggaaggaattgtttttttgaccttaaactaatctggcatgaaattgacgtagtaccgttttgcttgagcatgaaagaggacatgcagtgtgtactagccctactggcttttgtcttaaaaaatgcgaaacaaatttcttgttacatagattttgtagtaggggctcatacgacgaacttagcatgtatttagtttagaaacaaagtgagatgggttggactcatccctatttttaggatggaatgatcctatctatctatttggcataagggatgggatgatctacttttgaaggaatgtccacaagttagtgagagaaaaaagtaggttcgattggtccgctagttttttaagggccactaacccgtatcctaggggatatattccttgtcggggaccatcatatcccacatgtgcctaaacaaaacactgaaaaatgggttcaacccaatctaatccatcccaaccctttaaccaaacaaattcttaggctgcatttgtttgagcatttcaggtgaaacagttcgtgacttataaatttagaaaataaatttgtttttggttttttctaaacaacttctatatgatttatttccacaaaatataatattaaaagttcagggagcattgctaatgaaaaacaagaaaataccatttcaagttggcgaaaagaacttagccttggtgatattttgtagaatcactaacagaaacagaggacattaccattcaaaaagttttgtgcttttttgcgaggattaagtaattttttttagatgaaaaatccatttagagaccttgaaatgccgttccatatctttcatcccttggcataaaatttttattctacctagccatataagttaaaaccaacaacaaaacaatgttaggatccctttgatttgtaggggaaacattggagtttgggaggatttcaatcctatagggaaaaaatcctatgaaaacatttgaaacaaaagattaaatcttattttattctttaaagttcctatggaatagataatcatataaaaattttggagaaaacttagcaagaatatatctctcatccgtttcctatgttttttttccgtggtcgaattaaatgagcttttttgtgtttgtagtccattgttttatatctgcattttcctggcataatcatgtgtttttttattccttcggattttttcatacaattaaaaagggcctttactagtatagcaagtttactgtgacgaaattggagacaatatgaattctttccatgtgaaagaataaacttttacgaagtattttaatttcaaagaagaaactcaatttcttctttttgccaagatgagctccctccaaaatcgatctaccggcatgaaccatccaaaccctccagtaggattacgcaccaaacagggagcctaccccaaccacatcctagagcagccactgtacagccgtcctggctcactgttcaaccgcctcgagattcgtgcactcttcccgtgaggcgacggacgatgattgcccaatcatggcccctccctccctcgggcagctccatcaatgctcgcgtgcgtggtcctcccccggagcttattactcccgaccgaccggcgggcccggcccggcgatgtgaggcgctggaccgatccgggccgtccgatgcaccaacggacggccgagatgctgaccagtccgatcccccgcttcgtccctttcccgtttgactccacccaccttacggcccggcccaccttggaaaactggacacacacacacgcaccccctctctctcgcggatttttttttctcgtctttgaccgggctgtcagcgtcggcggtgggccccactgccaccacaatgccatatctatgaccacgcttgcttgcttgcgcttggaatttgtggatattctcccttgcttggccattctctttgactaattttaagatcaagagagccttctagttctaacaaatcttgcacatttttgcatcccacaccctctaaaaatacttttattttctctggtcgtgtttgtacttgttcctcagggactttgttctgaaatttcttctccatgagctcagggagaagaagtgaagaactcgtgctggcgtgctgcataagtttctacgggaaatcttccactattcaacatgacttgtactaaccaaatttaactctggatttgcttctgctaactctttaatatagttcagttgcaatgtatttaggttaacttctctatggctgtgtttagttcagcgcaaagtttggattttgattaaaatttaagatgatgtgactgaaaagttgtgtgtgtatgacatgttgatgtgatagaaaaggactgaagtttggatccaaactttgaatctaaacacagcctatgtttggactcccaggaagccaatccataagggcaagctgcagaattgtcatctgctagtcgtctgaatctctttcagtctcagttgttcttttcatctaagcagtctacctctacggttagttgtcataatttagcaatgcagtatgtactactagtgcagaactaaccactagacagcttgtcaagctcaataattgtccctgaagctcactcttaatcaaactgcagcgtcaaatgtcggactggcgatctcgcatcgatgattcaaagactcagaacattgaacataggaatcaccgatctttgaataaactctttcatgttcttgccatgtagcaccagtattttccctatattttagtatggcaatggccaggtcattctggagctatttctagatgaaagagctgtgtgctccaaggaaaatttcttgttcaattcaacaatgagcaaaaagccaacacagtgacttcaaaacaagagatgccacatccttttcgcagatggcgaattaatctcttgcgttccatcgtcaatacttcaaactttcttactctcttcttcgattagaacaagaattaaaaacactgaaccgcagacggcaaggcaaataaactatgatccttcattgatgttttcgtttcgtccgggatcttcagacggcaggatagcgaataagcaagcagtggcaacttgtcaaacattcgaagccatcgcggtcgcattttattcgatctttctccctctgaaaagcaaaacaagaatggtagcgagagagaaaaacaactggagaacgatatgcccttttatcatgttagaattttgcacacgcagttcgtcatccttcttttcctgtcaagttgtattggtgaacaacctcgaccacgcatgcatcaaatcaatatgagcatcagaccataatcactcgaattgccttccagtttcccaattacacttttgcttatagtgatgatcaaagctgtagaacccaggctacatggttaaagttgatttcttcccaatggacgcttccacaaaactcttcgtgcttaactttgaacagaataattttgtgggcgagaaagggttacacaataaacatttttaaaagaaaaaccataaccagtggctataattaaccgtacaagcaatgtgttacccctatcaacacacagttgcgtcatcttgacacacgcactattcagaagaaaaaggaaaacctgaaacctgtttctgaaaatactggagcactgcagctgaatgttcatgagcaaaccacctttgtcggcttgtgaaggcaaaaaaaaaaaaaacaccatttgattttcaccgctttagaaaatcaccctgtgatgggtggtaccattaccaacacactctcatgtgcatcctgccccaccctcccattaccctacctttgcaaacgcatcgttagagcaagtttattagtatagccaactgtcgacttcaaattaactatagttaattttagagccaattcatataataagttacctataaacatatactatataattaatatattggctcgaaagctagcttatactagcctgctattgtacctgctcctaaaagtagttaattactgctaattacatggattagttgggtaaaagcggggttagcggggggcggaatataaaaatgccgcctgcctcggagcccctccaccggctttgaccagtgccgcgccctctcctctctgtcgcctcgccaccaccatagctaatcctcctcctccgtttattttacttttctcccctcttcgcctctcctcgctgctgttatatccgctttcctctcctcctcctcctatcccccctctcctcctgctcctcggcctcctcccctagatgccagccgcggcctgaccctcaccgctggggagcccccctcccattcttcgcttcccccgcggttgcgctcccggagcggcgttccagcggccacaggtgcggtctctttgcttcccctctgctgctgttgttgtgtgcggtttgcttggttataggtggattttttggggttatttcatgggtggttactgatgtttttttttccgttgctgcctggatctttctcatttggattatcatctgctgctttcccaaagcgcgctgctgtttttttttgtttttttaaatatttttgtttgtgtttgcgctcttgcatttataaattttcgccgaatggcaggctaggactttggatataaggtcgggggtttgaaaaccctcgaatttcataatttcccccaccaccgtttcagaagttcgtttggattctgtgaatgctcacaatgctgtatattagtaagaggtgagataatgccgtgaaggttttgggaattctgctttcacggccatggaagctgcaaccgcgggttcatttatgatcgcggagcggtgaaaatttccagtaaatgttttgggggtggtgcagtgcttggttgttggggtcaatgacttagctgcaatagattgcttatttaagttggacttttgacccggaattgttaatttggtttggtttggtgagaattcgactactagattccgtctctggatatggaagtagttgcagacgcgcgcaatttctgtgaagttgcattggaaaccaaactaaatggagtggtgtgtttgaacgtccattgttgcgtctgcggaccaatgcatcacaccacctggctcctataagccttcgtctcagcttgtctcttgatagatcagtgaactgattgtgggaatgaggcagttttagtagtttagctgtctcttcttctccagtaatggtttggaagttcagaatacattgagaggtgttgtacttaaggagagatatcatagttatttttttttttttttttttttttgctgatgcaaggttcgacgccttttgcaccttctgttgtactgcatttagctttagcagatgcaatacatgacaactttttattgttgccgacgactaactgctatattgtgatggggcagctacttttgtgctatgtgctaactcaggatcctatttgaaattctgtagcagctttccctcattgtacacatgatgggttgcttcactgtcctgagatccaagaagaagaagcctcttgctctcaccaagaaatcggttgatgcaagggaaagcacgtcctcaagactcccagagccagaagcgcatgtgccatcgttacaatctgctcctcctagttttaggaacaaggctaaaatccaccaatcggaaaagaaagcttcttacagcagagcgcgcgtgctgtctgctccttccagcctaattgtggttgatcaggatggtcttccatatgccgaattcgatgatcaagatgactccaggggcaagggaggttctataaagggcccccgtttctctaatccactgccccttcctctcccatccccagaaggaaaatcattgaggaactttggcagcttcaaagccatcaatgcaagtggaccactcgatgcttcaagccctctgccacttcctccaaagaagtgtgatgggcttaagaatttctcctatgagaactttcatcagctggcaatggttttctggtgaccagtgtgttccgaaagtttgacatcaacatcatacaaggcgtcctttaggatgattttaccgacccaaagaccattgaagcaatagtatctcggttgctctcctccactcaggtactgttctccgtaatattgaattatgtgtttcatcttctttgttttcccctggaaggaagttgtattggatgtaaagcggtagctttgccattttgctttgttggtcagcttgtcaaacagatggttggcatgttatggcttacttttatttctctcttgctagtgagtagtgacttggcaaaatgcttgtacactgtaaggattatactcttttagggctttaaccattttgcagcatttcttctattaagaagctgaccttaggctagaggcacggactggttttgtaggcatgtgatctatgctcttaatgttacagctatgctgtctccagcagaaataactctttctatttttgtgaatgcaaaccaggaccacaccattggtggggttaggtaacatgctctggactttgaaggcagaccatgtgtttgatcttctttcttcactttactcctagatgctttctccactccttcctaatcatatccagtgactagcgagattttcttttgacgtttgtttgatactttgatatatgatatctcatgctttccactttatgtggtttattggcatggttctgatcttccctcacttgtattcagtattgaaggaatctaaaaaatcactgtagtgttattgtgtagttctgggaattcagtggttcactagactttgtattgtgtgtgtgtgtctaaatctgataccccctttggtgttacctaatgttgcagcaccgtttattggaccatcctgatctattatttacaatttaactggttatggtactgatgcaacacacattttattaatatgcagagtttgaaagagtttaaaacacaagtgaataccttggcatcacttcagcatcccaacttatgtaaactaatcggctttcacgcaagagaagaatctaatgaaaggatgttggtctatgagcgactccatcatggcagcttagataaactactctttggaagatcggatggtcgtttcatggactggtcagcacgtttgaaggttgctcttggtgctgctagaggcctggctttcctacatgatgaagggccttttcaggttactgcttctaaactttttctttttgacattaccaataagtgaatatttattttacctagttatatagtacattggttgatggtttttgaccttgtggtttaaactcttattcatatgttattttttttacaggccatgtacaatgacttctcaacctcaaacatccaaattgacaaagatttcactgcaaagctatcaggatatggatgtgttggattcaataccgaggaggaaatatcaaatgcatctgtggtaagttatgttttgaaaatattttagaagatatagttatcagagcccaactcatttgcctgatctctttctgtaaattcaagtagtgtgttttggcatggttaatactctgttcgtttgtatggattctgtgttgcacgccattgatattatttagtcccaaacatcctaatattttgatgtgtttttactttacttgtttgcattatatccatagtggtcaatgccattgtttaccgtggatgctattctttgttaggctgctgcaaacctctcagtggaaaccttggagaaaggtgtactgactcccaagagcaacgtatggtgctttggagttgtcctgctggagctaataacaggaaggaagaaccttgatgtccgttcctcaaaagaagaacgcaatattgtcaagtggagtaggcctttcctcaccgatgatagtcgcctatcgttaatcatggactcccgtataaaaggacgcttccctaccaaggctgctcggattgtagcagatatcatattgagatgccttaataaagatccatcagagaggcctaccatgagggccgttgtggagtccctagcaagcgtccaggacataaaggttccatgtcgatatcctttgcaagagccatctgctgccccaagaaaggtgatgttaaaatctacaagtctcaatggcatcattcatcaccatcctgtcgtaaccttctcaccgtcacctccttcgcgaaaccaacatttgctctcgccaaggtcatccacgtctgcactgcttcctccaaggaccagctgtgctctggatgaccctagagtaagctctatcaagaaatcgccttcccctattttacggagatctggtgttgagggtttttgattgtccatatttttttttctcttctcttcacttcgatttgtttgttgtttttgctagcctagtggttttagtgtaatctcatatattgcaagacaaatggccttatgaactcccttcagtagtactaagaagggaagggtgaactgtagatagaaccaggttgtagatacttttcgttttctaattggatggaagcagcgtgttgagtgcgccttgtaaactccattatgcaataataaacgtgtgtcactcagttcttttttggggagtcaaacatttcagctatttcggttgggtgccaactgccaaagtgccaagtggtgttgttgcttgtcggcacatagattgtccaatgttctaatccacgtgatgagatcatgtcgctgaagttgcaaggatccattgatgtaatatttgctgctgcctgtggcagttagagatgttgaatgactttgaatccctgcctgtggaaagttcatcccatcgttgcagttgttgactgcgacccagcctgcttttgcttctttgaccaaagtttgtcgatcgccggtcaaacttatctcaagcttaattagagtacgtaacaaacgttttataaacatgtgttttcaattggaacgtcagtgacgtctagttatgatgatgtaatggttggtggcatgaaactctactgcaacagtgcaacagcaaaagaaaattttgttgcatcatcattttgtactcagttcacatctgcaatctgctttttttgtgtatgagtttatagtactgaaatttctttcggcgactggaataggacaatgatcttcagacaagggtagtactactctgaagcattgatgacagctccaggtatcgttatgtttcttgaatcgtcagaagaattggtgcaccggacacggtttacttcagtttcttggtcgtcagtcctcgccatggtgcccggtggcggtgggtaagctgctctctttgaccggatcgcgagctaatcagctaactgtaactatctgaatctgatgttaccgtgagcgcgcggtggcctaatccaatgtaccggcagtgaatcatatgactcgattattcaaccgaaatctcgcacagtttgttttgtccttggacactgtcactttttccctctctttttgctcgccatggctgtaaaggtatctatctgggcatgccaaggtccccgtccttagattgccatgattggatcggatggatccagcctaacctgatcggatattatcgatcaggaagatcagatcaggtaatacggatgattaagattttctaacttctctatgataaagttacaaatgttaagttagagaatttgcttccgatcatgaagaaagctacagaaactaaacactggtcacaagcaactatgcgacgcggattgtcacgttgcgtcgttgatcgatcaaaaattaaaatttcggtcgtcacggcaatttaacatgtctgctgttgactcacaaatcacacggctagttacatggcgtcaggtagtggaggtagtagtcaggtagtcgagaagctgcatcctcggcggcggcgccggcgggcacggcgcggccggctcctcgccccggcggcgccctccgccccacgcgccgccgatgccgagccagcagagcagccgcttcaacgcctccagcagccaggacctccgcgccggcgcacgtcccgctcccggtttctcctcctccttggcacgtcggacggcagcgccccgcggggctttctgcttgtcctgcggcgcgacgacggcgagacggacgggctcggctcggagtagctccggcgcaggacggcccggtcgagctgggcctcgatggccagccgctcgtactcgtcgagcagcgtgctggggcggaacgcgccgccgccgccaccgttcaggtcgaggctgaggctgagccgccccagcctggtggcgccggcgtcttcttcctcgactatctccatggcaatgccgccgccgtctagctgtcgcgccggctccattgacattgatcagtagtgttaggcagtggtgctataacgccattgttgccgttcgaaaagttgcgagttgtgggagtttgacgtggatagtgaggcaagcatcgccgcgtcgacgagctttatgagtttcgtttattgcactcaaaacattgttcaggtctggacctgtctcttttgttgaactttcatagtatatgttgtataaatcaatctctgcagtataaattgaagttcacacgctatttcgcacactgcttgtttggcaacgcagggaaaagaattgggagtttagaattgatggtgagattaaaataggattgggagtttacacgagggaattgatggtgagattaaaatgagaatttgatttttaatcccagtatcttgtttggtagaggtagtggaaattgatagagagtttagttggagattagttcattaatgaaaatgaatggctgagatttgtttaggcaaagtaaaggaggaattccgtcccaattaccaccactacccaggtattgaaaaggagggagttcctccctcaattctctatccctatcccacaaaaattctcatgtatcccaactaaacaaaacaattaatagatgggactctaccaagaccatgacgatgacattgggctacattactagtccatgagaaagcccatgtaaagtaatgcatcctttcggaccaaattatgaagtccgggcctaacaagtgttacccaaagaaatttccccaaacacaaagaaatacggccccatcgtttcacatatgtgtgaataagccaaacggtatatttacaaataaaaaataatttgtgaataaaactttttatacatgttcatgttcttaatgatctaaaagcaaagtctgaaaaataaacctcaatgaaaaaaccccaaaaccaactccaaattaagagttgaaaattcaaaatttgtttgataagtaaaagcataaacgaaaagatgaggccaaataatcccaatccaaataacgccgccatcatctaaactttggggcctcatcttttcccttatgcttatgcttatacttatcagctaaaatttaaattttcaactttaaatttagaactgatttaatggttttttcatcgaagtttatttttcagccttacttttagatcactaagaacacatatacaaaattttattcataaattatttttcgtttgcaaatacgtcctttcatttattccggggcttttctctcccaatttccccgccgcccgaatcggccgatcggcaaggagttgagcgattctctacgcccccaacgattttctctcccccaaatcgatggcttctcgcaagtcgctacgacgatcggcgctgctccaactcccttgcggctgcttcgcggagacgagggttgtgctcgatgagaagacggagcacctccagctccctcccacgaggttggtccggatcacgtttttcgcagtctcgattggattcggcttgtctctgtcactagggtttaaggg

SEQ ID NO: 78181 - DNA, 1749 bp, Oryza sativa
  unsure (1)..(1749): unsure at all n locations
ataagaagcactaactatataaagatatgatgatctcttatacaaacgagctaaataagcaacctgcgacttattaagactacgagtttaaatcactacgagcaaacctcattacgagccatctgagccatgaatttctagctttttttccacctctataagttgtcgcgtcaacctagtgctctacaagatctaccggttgcctcttgtggctcacttagagccatcacatcagaatacttgcacatccagtgtctcccgccggaagctgaaaggtgatcgaggaggatctcaagtcttgatatattcaagcttggctagctaaagaaaaagcccccaaaaagtacaaaacaagtaaagaaaatatacacaaatatatgcaaatatctattcaaaagttagccattgaggaagtgggacaagtcgttgcttgcggatgaggagtggagtatgtggtatccttgtaccaagtgaggacacgtacgccatacgccgaaccagaggggggcgacggcatcggcaacgtgatgctcgccgtgactagtactacgaattcaccaccgacgagctctgctttctggcattgtgatcagtgtccatcagacgaccatgtctctgtttacctctggtttttggtttcatggccagggcactttgctctcatagatgggatgatttcggttgaattagtacttgcatgaaaagaagaacatgtagggctcattcggattgcaggctttttacggaaatttcatgggaatactgttcacttggatatttttcatatcctatcattcggatggtaaaaagtggttgtgggaaaactatagggaaaaaatcctttgctgccgattccacaggaaaaatggaggaaaattccatccactccaagctcttgttctctccctatcctgtaaaccgaatgctcttagcttctacattcctgtgtttttcaatcctctattttctacgtgatttcctttcatattcctacggttttcctatcctgcatttttcctgcattttttcctaccctgtaatccgaataggcccgtagtgtatggtcttttactttgtcatagattatgaatgaatagtgacttcttagtttttatacgctagtgatgcgttttatctctgtaacctcataatcgattctcaatgttatccttgtggtttagttgagccaggtgctcaggtcacaacacactcctctttctttaaaggaatgttttcaattgttacaatcctttgtcccaagttatatcgtcgagtcattttagagtgctccatcttatcgctctagggagaaggtaagagtcagcatacaattattttactccctctagccatcgattattttactcccttaattttatactgtataagtggttttattttttttttcagtcaaactttatcaagtttgataaaatttgtgaaaagttcagcaacataaaaaaaatactaaattagtttcattaactctagtcttgaatatattgataatatgctggttttatgttgaaaataggaaaaaaaatttttatcctttgggtcggatttaaggaattttgattagaaaaaataatcaaancgncttgtaatatgtagtgngngttccattcaggtggtcatggtggnnnnnnnnnnnnnnngnngggttgggtaagggaanccaaggcgaaaagacaccnanncannnannancggacgggngcggtagaganangggtatggttagaggtt

SEQ ID NO: 78182 - DNA, 14059 bp, Oryza sativa
  unsure (1)..(14059): unsure at all n locations
gccgtgtgatggataacaacttttaatataaaacggagggagtattaactattccatccaatcatatttatgttagtatttatataaacttttcaagcagtaaccattaaatatctaagtctggaggaagggctggtccaattacacatgttcgagtcgtttgttaatttgtaaatttcaccagtcgaatgtagtgataatgacactacataggagggagtatataagagtttttttaactgatatcctggctatctagatttaaaatatttttgtgaaataaaacgattttactatttactattgataatgttgccttaaataatccttggtaatgaaagtatatatgcatccgttataaaatataataacggaggcatatatactttcatagctaaatgttattatattttagtactttttttagtgaagttttttagaactgtacttacaaatcgacctgccattctgattcatgtataactttcatatctcaccatgttattgtggagttgtggagaaggggaacaacacaacttttcggatagagatggaataaagttttgcaaacaaagacatcggttgaaatggattcaacttgttctacctacgatttattttgagaacgatttattggatctttatttgtccattgtgcggcaggttacaaactttctactagtacaattatgtttttttacattgtttagtacaatcatgttgaataaataaaccgatgaatgtccttttaaaacagttattgttattagtactacctggcatattttatagtctagcagacgacaacagttagtactgaagcaaagttatcaatggatgaaacgatgtttatttaagtacaggtgattaacaaatcttttgaaaatgaaggaaatatcaggagaacaaacaaagctggaggaacagggcataaaacaaagtgcgccgcttatccttatacttatcaactaaaatttaaattttcaaccttaaatttaaaagtgattttaggttttttaatcgaaatttatttttgagtctttacttttggatcgctaaaacacatatataaaagttatattcacagattactttttatctgcaaatataccgaaacaatggggctgaaagtggaaaaaacagcgcacagcacgtgaaatggcacttttgcagcttgaaccttctaaacatcattaatttggtacacgcattaatttgacttatgactccttttcttttcaagcacttcaattcattttgataattgtacgacaaaagtgcccgaatttttaagattccctacaactggtccatcggttcccgtcaaaaaattttaagattcatcagcccacagactagtggagtactactgtaagccaacattaaaacttaggaagtactgctgcattaaaaaaaacaatcatatcaacgaatctggattagtgtttatccgagtttataattaggatttattatttgagaaaattccctatatacccctaaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccataaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaatctttttttattttaatgaaataatgttttattttcaaaaattcatcacaaatatttagtaatttattccttattggttttcacaactcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaggggcgtagaagggattgggtgaaattacatgggcatatagggaattggcccttattattttaggaccgaggatcggatatactactatttatttatttatttattgtttctgataaagccgaacttaaaacttctggtacgagcatgaagtctgtttaaaagatatatttaggttgcgacttagtacctccatttcaaaatttaaatcttattttacaatataggtatttctatcaccatctacactacttattatatcatttacttttcattcaaatttcttctcatactacccccaatcatctttttacttaaccctctcaggctctcacatttattgatgaggcatcaaagtcttttcttctcaactttaatatctaatactaaataacatagaaatgcttatattttaaaacagagaaaatataagtcgtgagtcagatgtagcttaaaaaacagttctgaataagcttatgcttgataggttgatcaactacaattggtaacatgtaaaacataaatgaagcaacaaaacataatttacataaaaaaacttgtatatctgtgtttgttagtggtttaatagcctatgtaaaaaatagtctacgattaaaaaccatgaaaccaacttaaatttcaaaatttaaaatttggttgtgactatatgctacaaagaagatgatgagaacgttctatttttttttattttgaagacaaggttatagtgataaaactaacttaagaaaactctaaatcaacactgaaaattggctctaaaattgaaaattggctttgtcttactcttataaccgttttttctctcgtatggaacaatctactacttttatatcctaaaatagtaatatataatcggattaaatgtaacttaataagacgaattgatttgtctaatttcaatttgggactctttctaggttgatttttttacggagaaaatattttaccacgaagtaaaatatttgtatatgattatcaatattataatagtactacttcattaagtaggcaacgcggtgatggagcgccgcgtcgcaaactcgcatggcgtacgtgtggcggccggcagcgagccaaccgctctcactcacctgcacctgcacggcacgcggctgtatggacgacgtgtcgcatcacgtgatgttggcggcagcggcaacaggcagcaggaggaggaggcagcaaaaggtaagaccatatttagatgggattttaagtccctatcatatcggatgtttagaaactaattataaatattaaacgtagaatattaataaaactcatatataatcttggactaattcgcaagacgaatctattgagcctaattaatctatgattagtctatgtgatgctacagtaaacattctctaaatatagattaattaggtttaaaaagtttgtctcgtgaattagtttttatttatgtaattagttttgcaagtagtctatatttaatactctaaattagtgtctaaatatagagactaaagttaagtccctggatccaaacaccacctaaggccctgttttctccaactaaacaaggcgttaggacctgtttagttctgaaaaaaaattagatgtcacatcggatgttggaaggggtttttggacacgaataaagaaactaatttcataacttgtatggaaaccgtgagacgaatttttcgagcctaattaatccgtcattagcacatgtgggttactttagtatttatagctaattatggactaattaggcttaaaagattcgtctcgagatttcccctctaactgtgcaaatagttttttttaaaaaaaattctatttttaatgctctatgtatgtgtgcaaagattcaatgtgatgtttttggaaaaaaaatttggagaactaaacaaggctttagttcccacgaaaaaaaattcgccctatcacatcgaatgtttagacacatgtatggagtattaaatatagaaaaaaaactacttcctccgtttcacaatgtaagactttttagcattgctcacattcatatagatgttaatgaatctagacattagtttcacaagtaagactttctagcattgcccatattttgtgggcaatgctagaaagtcttacattgtgaaacagagggagtaattatatagattgcgtataaattacgagacaaatcttttaagcctaattactacatgatttgataatgtggtacaacagcaaaaatttgctaatgatgaattaattaggcttaataaattcgtctcgtagtttacaggtgaaacatataatttgttttgttattaatctttgtttattattttaaatgtgtgtatgtatatccaatgtaaaacgcacagacttttcagcctgaagctaaacaggcctaagcatccgtcgtgcagccgccgtggcagcgactcggcgggcggcaatcagggcttgtttggttggtgccctgagcactaagcctgacaaatttgcatgcctgagaggcacataaccagttcatgaattttgcctgtccagacagcctgtgaccttacttgtttggttggccaccatggcctgagaaaaaagactacgattatgcttcacacaattacagctaaacatgtttatggcaaagaaacaaatcttaccataaaattgcatcgtccctccaaccaaaataaatctaaaccatggaaaaatcaagcgaatgcatcaagaagagaatcagaggagaacatgagaaaagagatccccaaatccaatgtatctgacatcaagaagaaaaagaaagctgaatacgagaaaagagattcccaaatccaaccgcatcaaccttccattatttctcacatctgcatgctaagcctaagcaagaccataggaattcctcacatctacatgttaagcaagattaggacacaagatccagcaggcggcggcagctgcttcgtgtggacggccggatccaacgatgcagcagagaagacggcatctgatctgacgaggcttcgtgcggttgcggtggcgccagcatcacacgttgtcgtcgacggtggctgtgctggcttcactcattgtcgtcgtcggcggcggcggcgacggcctcgtgtgatgtcgacgacagcggctgcataggcttcacttgtcatcgttggcggcgacaacgacctcgtgtggtgtcggcagcggcggctacgctggcatcggcggcgactcgtgtggtgtcgatgcgacactggtcagcagcagcatcccgcggcctgtctaaagaggattaggaatgtaactatagagtgctgctacgcctggagctcaggcgaccgtttttggtcgcctgactcaggctaatcccacgccagagggattcaggccaggcgagggagaatacgcgtcaggctagtaaccaaacaaccacatgctatgctcaggcttgtatcaggtcaggcaaattttcctcagggtagcaaccaaacaggccctcaatcgatcactttgttttctcgccggagcaacagtggcagtgatggtgtctgtacatagacaactatggcgtccacgtgcagctaattagcctgtagtaggagtaggagtatatactttggcagtttggcacatgctaggtgcagatccttcagccacatttcgccgcataatgcgaccaaaagctgacttgacaaaagctgcctgctttaccctagtgtttcgtgtgtgcttctccactatttgtactcccttcgtcctcctataatattctttaaaaaaagttcaaattacaaacaaagaattatccctctcaatttaaatccaaacattattttacactctaaatattttaaattggtcaattatccatatatttaatctaaagtggttttgattgaccgtgatgtagacgtggtagtccagtcaagaaaaaaaaagttgtcccacacattagtggttatacctcggcgcaccatgtcctagctgacgtcgacctgccgctgcaactgtccacgggtgagctggacttactgtttacccccgtgcttttctgtccacgcatgttgtttttcttttatgaggtgagtccacgcatgttgttgctagtggtgcccaccaccttcgcatcccagactccgctcgcttagtggtaattgggcgccaatgccggagttcaaagtccttgttggtggtactggtactagcaccactccccctgttcatgatcggcccgcctagtcggcaccacatcaaacgtcaacaacggtggtggtgacttcaccatggctgccacaaccgtcatcacgggaacaggtgatggagccagctagctaacgtgacgcttcttcttatttgttcttcttcttggccttgtcttgcactagagaatcatgtcaaatcaaagccaaaaatcactaggaagtaggagcttgaggtggcctttgtcgtctccaaatcgagatccacttttagtgccttcctagatttgcctcagcctccaaattgagctccatctctagcgccctccccaatctgcctctaggctccacagtcggctgcttcctccaaatcaatctccggctccaccttctccttcttgacggccgcaccgtactcatcatgatgcatctcgatgaccctcctccctgacaaagccgggtgccaggaccaatctcggatagccacgacatcaacgacaaggagtaatgccatcaccattaagatcctcatacatgagttcctcccatctggtcaggtagccgatcgagcaaaaatacttaaaaactattactggctactaaaattaatctttgctactcagtttcgaagtgttattggtaatacaacactacgtctatgttaacctaatgaaaaagcgctagtgtacaaaacaacgacaggatgaactaagaatatcctcacaaatgctactagaagcctagaacccctattcaaaactaaatcattcatccctattttctaagttgcaatcgacacggttgtacccttgttaatcgtaatcgaagggatatgcccacgaagatgccaatgtcctggtggaagaacaaatggactaagggacacttgacgtggccattgtggatcctgctaaaggattttgttactctacaattagtaggacatacttttttttttgtccatgaagaaaaggtagcaattattcttactactttacggaagtgtacgcagagcatgtacaataatgatgattcataatccattctatagtttgggcttattttgctgaggatgagagagaaaggagcaactcgagcatgagttaggagcaaacatagttatctgaaatgttgtattaactccgtttttaaatatatgatgactattttcttaaactgtaatcaacatatttgttcaattagtcaggtatatgtaaagtgaaaatagtatcgtcagatctctctaaaaataatttaagctttatttgcttatttgcataaatatttttataaaatacaaatagtcaaacaaatttaaaaaatcaactgcatatatatttaaaaaataggtagtaccatccttttatacagtacataacttttataaatactaagaatatttaaatggtctctgaatgacatggacatcaaccaatcaagtgccttatatatatatgattaattaaacgtgccaaatcaacttttagtgaaagtgccaagggaattcaggccaagttagctcccacctacatttcacaactcacaaaagagcatgtaaaaccaatcatgctttctaggattactgcagatgctctgtagccccaacggagagcgcgcgggtgtccttcataagtatataggtttttaaatcactaactcacatcccttcatttttcgcactcgcacttttcaaaccgctaatcggtgcggtctttataaaaattttctatataaaagttgctttaaaaaatatattaatccattttccaaaaaataattagtaaatacttaattaattgtaagaaaatggtcgctctgttttgcgtgcgcgggatgtgagttcccaacctcacctcccgaacacagcctaatacgtacatagaaaagatatctataaattatttcttttatatataataagttgcactgcttataattagcatataaatgaaatgctccacgtgtcatgttgatcatatggttccaaaccaagcttgttaggttggaactagcaacctcgatagtatgtccttatcgtggatggaatcatatataaatagttgagggaggcacacacatggtattctgcttggaaactactctaaaatattattatgcttaggagttaggcgtacataatttaatttaaggtgtatttgagagggggggggggaaatggaatattgagaaatacataaaacgggatgagttattagcacataatgaattgagtattaattattttaaacttgaaaaataagttaatatgattttataaagcaaccttttttaagaaaacttttgtaagaaaacaaaccgtataactattcggaaaacatgaatgtggaaaacgagagccttttctcccctttgttcttgtccctaatttgtgagaatatggctaagtagtattcataaatgttgctagggttacaacacattaattgattgtagagcattgctcagcacaataaggtatgtcctccacgagattatgcaatttcgttgaattataacatagaggtggactggaccaattgcaagatggtgtcgtttaatttaatttgtctctttcagtaggtttcaactatttttaccactatgccgtgactttttggttgaactagatgtgttcatgggtcaaacctgatctttcgatgaccgagatcataccttcaagtgttctaactaataaacccaaaagaccaactcaaaattttctcgtaaattaatgaggctctggttggaactcgagggaatgtcgctacggaaagagaattatttgctatcaaaactttaacaaaaatgtttggtaaaagctatacatttgtcgataaattttctcttaaaaatttgataaatataatatgtaactatcatacaatttgtatgtaactttcaaaatcccatgataagatgttaatttcgcgaactagaggtgcacgctatgattttttcccaacttgcatgaatcttgaggtaaattaaacggtttaaaattatgtgaaaattacatacaagttacattgaagttatttatgtaagttacaatgtaattacactataattaaattgtatttacatttgacaattttttggaagaaaaattatcaacaaatatataccaaaatcaaaatgttttccatattttgaaaaaaaaagcttctaggctatcatcagcctatcatgttgaattcatgatcagtttgaagagagaggagaggagagagaatgaagatagaactgttttgaatggagaaataagagggggaaaaacaaaaggggagtgaagagaaagatgaaagggatagactacgctctctgagaaggacatggaaaggaaaaaataaattactataaaacattagaacggtatatactactatctccgtcccatattacttgtctttttgagtttttgattgtcaatgtttgatcattcgtcttattcaaaaaattttagaattattattaattttgtttgtcaattgctttattatcaaaagtactttacatatgacttatctttttttatatttgcactaagttttcaaataaaacgaatggccaaacgttgcaaataaaaagtcaaaaaagtcacctattatgggacggagggagtacattttagtgagttgaacaaattgtactatttgataggcatataatgtgaatcaaattaaagaattaagattctatttgatctgatgctgaaacaagccttaccaacaatgttttctttttaaaaaaaaatgcgaagaagtgcccaacccattccattgcaaacgaaagttatgtgcattggtttgtattaattaatcaacctcaaataaaacaacacaccacacaccctaccagtatttttgaacagatcaaacatactgacttatctaatttttgacttactaacatgataagatatatcttttacaaggtggcaatgcacagaggcaataacggttgttggtgaaaggtggtggcatagagtgaaagacctagttaatctagtattgaggttggtaggggctggctggcgaagaaggaaaattggtgtgagggtggacacgtgctggcattgtttggtggttgttaagcttgtgggcgtttagggcacaactacaaggtgacatacgagttctaggagaaagcccgatctatagtattctaggatagcagtggcaatgcctttggatgctgcaactatcttcaaggtggtgtcgaggtgcccttcttcctatccgatagaaatttttagatgaaatgatatccagatatccttggacgggcaataataatgtcttcatcgtcgcaactttcttggtgttgtcggtttggaggatacgttttttgagtgcgatgtaggccggcgatgattggtcttgaatagaggttggttcctaaatttgtgctatgctatctccttcctagcggtgtggtctttttccccctttctttcaggactatataggtcttgtttggatttagggactaaattttagtccttgtcacatcggatatttgaacactaattagaagtattaaacgtagactaatgacaaacccattccataaccctagactaattcgtgagacaaatctataattaatctatgattagcctatgtgatgattcagtaaatatgtgctaattatggattaattaggcttaaaaaaattgtcttgtttattagctctcatttatataattagttttgttattagtctatgtttaatacttttaattagtgtctaaacatataataatttataatttagtccttgaatctaaacacgacttataggtagtctaatattttttcatgctacgaagtaccttgatatggaactttgtacagtgcgttttattccaaagagaaagatgactataaagtagtaaaatcaaacatgtgcttgaaacttgctttttcacaagttcatccattatcccgaactagaatctgctcgagcgaaagcaatctatcctcctagagtcaaacatgtcataatccctgtcctcctcagttcgtatccaagaatgcgatgccaatctccaggacaaaggggaaggcgaggacggatgatcccgagatgccaccaccgttgtcgccgtgtttacgtatattattacttcgtcgggaaaaaaaaatagtaagaccccgacagaataattaactatctgtcacttttataagtggtgttaaattatttatcaccagaccatatgctatagatcctatatgtaatagacagcgagtgaaaaataattaattaccatcttttaaaagtgacgagaagtttaatgtcctagccccgacgcaacacaatcacataaaaaaaatttccagggggtctgggtgtaaaaagaaaaggtggaattatgtgggagacgcaggggcgtggatgcaaaaaggtgggtgcgtgtcctcgaatccagcgccgcgctcgcagcttcccttctccccgtcgcagcgggggtgatgactcagcacccccatccccacccccccaaatctcctctctctcctctcctctcctctcctcgcgtataaagccggcggccgcttctccgtcaagctccccccctccatgacgcctcgctcctccgccgccgcctccgcctccgcctccgccgccgccgcggcacagcgtcggaaaccctagcctgcgcgggggcggccggaggacagggaggttgtttgtttgtttgtgtgtatcatacggatacggcggcatggccagcggcgccgagtcgtgcggcagccgcgggggggagtcgccaccaccgccgcggacgcggggggcgtcggcggggggcaggcggcggaaggcggaagcctaccgcgaggttctccgccggatccgcgggggcggcggcgcgctcgacgacgacgagctctgggcccacttctacagcctccccgccaggttgattttattttacctagtataataccctcttcttcttctctctcgccgcctctgctgctgctttgggatttcgacgcctcgggtttcgtgcgcgatgaagggaggagcactagctgctactgcgcgtgtgctgtggattctttgggggggtccagcggatcgcactgcaggtcaggagctgtgatccatggccgctacagctaaacatcatgtgtgggtgtgtgtgtggcttgcctatgccctcttccctttgctgctgttgctgttgctggtggtggtggtgaaaagattgcatcggcggtcgtgccgtaggtcgccgtggtccacgcatgctgccactcgcggatcagggattcagaggtcggggagatacgcccgctggcatttctctatctatcgatctctctctctcctcttcggttccagctcttcttgttgtttgtttgatggccatcaggccaagctaccaccaccagcacctccagcaggagcagtagcaggctagcagctagctcggtcgtgtagcaatcactagtacaagcagtacaacacctcgtagtacaagttgctgcctttttgcaaccacgtgaggaggaccatactgttttctttctttttttttctctctctctctctggataagaagagtagaagactgagctatgcttgtcggcatacatgtctgatattaattccatctctctcaagaaaatgaaaagatgtttgatattgactgtttatcaaaacaaggcttctttttatttttttcccccgtgaatagttatccttgtccagtatatgtttgttctttcgtaacaagtatattttgagctagcttgccttttatcatgccagaaatgtgctgctttctgcattcctcgtaacgattggcactgctttctggcgtgatattacacctttctcgtctctacttcctttggtcattttgtctctgtgttccatgtgttaaattctgggcttgtcttgccacagtacatagcattagtcattagagtagagccttaaaccaagaaactaagcaaagcttgttagataaagtgctgcagcattgcatacacatgcctttccgaagcccttagcttgaataagcgacatgctgagaacttgctacttgctagcattagcttgaataagccatgcatgttattatgatctaattgcagacatgcttggcttcatgcattgaacaggtatgctttggatgtgaatgtcgagcgggttgatgatgttctactgcacaagaggttgcttgaccaggcccgtgaaccaatgaatgggctggtcttcgatgttcgtcgttcgcaggtgattaatgcataacatgacctgtctacctcttttctgaaaccgactaggcatcgcttgatgaccgtcgcatgctcgtatattggctagtgtctaggataagacctcaacattttcataaccaagtgctgttagacaccacagtaccatgtgacgtgttgtgtaatacgatgtaccttttgtgccatccttacaataatcagttaatcactatcctgtagaagtgtaaatcacatatccttgattttgaaactgcatttgttaactgctggttatttttattttatgtacancagctgnnntnngnttttntaaagcttgtctcactgtttcaatt

SEQ ID NO: 78183 - DNA, 5671 bp, Oryza sativa
  unsure (1)..(5671): unsure at all n locations
cgataaaaactatattgggagacaagataatagaggctagatagtatagagtaccacgagaacgatggatacccgttcaaggtatagattaggaccaggataattttccaacgcgagttgtaagatgaccccgagaatatttcattataaaacaaccggcgccatatacaagatgacacatatatgtcataaagtaatacgataaataagatggaagaagccccccggttaaccctgaatggtaagaggatttgaacccattttattcccttgtggtaaataaatattacacaccccgtcccctaaatggtaaattccccccggaaaaacggttaacaagcccccatgcccttctcnaggaaagatgttaattatgtgtccaaatttcgctttttgaaaaataatttcaatatccttttgtcaagcttctgagaaagtacccaaaacaaacatatcttgtatgattccttaaaaactgttgcatctcgatgtccttattggaattcttcgcatttaagtagctttttggtcgtactgatcctagggtcagtattttctgatatgtgatatcattgcaggtgtttccatgaaattatatttgcatgtgacgataagcctaagcttcttagccaggtaaagtaataattcttattttgagatggaaaatatcttttctttagtagtagcatatcaatttgtgctattggtatgtgaattacattttttatgtgacaatttgttatggccaataaggttgagcctcaaattgctgaaaattctgcccacgtaatgccattaatgcatgcagttgatgttgttgtgaacttcaggttcttagcaatgaaataggtacttgcatttgtaggctacagccaacgtgtagtctgttgatgttacctaggtccaggatatacagtttcgttcagtctaatatgcagaatgacatgcaggcaccactaacatgcattgggtcctatatcatgttgcacatttctgatgtactgatgtgtttggacgttaaatatgctgctagagcgaggtgagcatgattttctatggacaacaggattagtatgattgtgaagatccttgaaaaagtagagttcagtcagatacaatcatacataagttgacagggagattggattattatgagtacattatagaaggtcaactatagaaagttgtaacagagtggtcccttttgcgttcatctgttagttgtggtggactggtgcttttatgttgtgtgctgccatctttagtgttggtaacaatgtcttctcaatactgatctatttgtccacgtgctagtcaaagtatgctaagcacttcatagaaattaaagtacctggttatccataggttctgctctgtaaggacacttaattggcaaacacatgtacactctgcatgagagttcagtattttcatgagtgaaggtaatattaggtgggttgaaagttcacttgtacattctaaagataaacccaaataagaaattaagttttattgcacctgaacttatttccagcttaatttgaagacttgcatgtttttatctgcttttccccaacaatgcgttcacatcattttaaacccaaatagccaaatctgtggttcagctgctcacattttgcagaattcacaaagcatatccagttatatgtggagttgtgtgtgtatcatgatatcacattgcagactttatggttttataaagttgtgttttttttttggtttgttttgcctcagttccgcagtgtgaatctgttcatctgtatctgaaagcataacagtaacagtttattgttctgcaaataataattatgaaactttatcagcttcaagcaacacaagggaagaataaaaaagggctgttatgttcaaaagttatattcttgataaacttggttctgttcgctagcttcgcatgattctcagtactgatgtcattatgcccaagttatttacttaattactttgttttggggacaatttacaaaagatctgattgtttttcatccagctaaccgctctacttggggaacttggccttaacatccaagaagcacatgcattttcgacgagtgatggctattctcttgacatctttgttgtcgatggctggagtcatgaggtaacttaatatttatcaattgtagttcctgtaatgaaaaaaggaaccatctctattcttgcttgccaggtgtatatatttcttattcatcttgaatgtcaggccatttaaactggtattgtaatgctcaactacaatttctaccaatgtaaataaatatttagtcaagtaatattgtatattctcagggtaagattgtgaattaaattcagatagtgcgttacacttactttttttctaacctaaaagctgtacaataaatatcagatacttacaaaagcctagagcatacaaaaattgttaaattttaaaacaagaaaatgttcagaagttttataaacctttatggaaagccataaaatttctgaaaactgtacatatatatttgaacagttgcaaatacaaaaattaatattattttcttcgatatttaaaatttttgagattctagttaaatatctgcgtgttacaatgatcttgcaatgaatatgtcgtaaatccattttgatttgattttttaaactaatttgcacaaccactgtatagtttattttagtaataggaacttgtattatacttttagctctatgttcaaagttgctagtagtctattcattatactggatgtttttggaaccacattaaattgtcacgttatgctatatacagtatactgttagcattttctaaaattagctgaaatgttacttgtatctatcttaatataatggtaatgctatttgaatattagcttgtaaagaaggcatgcaaatttgagtgttgctaccaattgagcaactgtagttcaagctaacctaaaaatttcttccattccattgttctaatgctcttgttacccttttgaaaaatatgccaccaccaggtatctatgttgtagttattgtttgacagcatgctaatggcacgaaggaagcaaaataaagttggcatactcagttgcatgtaatgctttgggccctctagtgtactatagcaaatcaagtttgtcatatttgtcataattgtttatagagaaaattgcaatattaggactgcaaacatggtggcttcgttgttttgacactccgtgtggatgacaaatgggcccatctgtgtctatgaaatgtgggtccagtgtcattatagcaaaggttaatgtttgcagtgtcataattgcaaatcccccataagaaatgactcatactgtagcaaagatgcaactattgcagccacttaaatactaacaaaaatatatgagcctatgtttgcaaattatgttacatttttcatacttgtttcttaaaatgaccaggtcgatgttctacgagatgcattaaggagaggagttgaaaagataaaggtaacaagatcaaagaatgcttttcctctaatttggtctgagctgttttgcctacagagcaccaccagtgattaagatcttgttctcagttgttacttttgttcagcaattatattggttcaacaaataacaccctagactcttcggtaaactgaattagcatggacccatataattggcgtacaccagtgtaactgttataataattagtatactttagggggtgaaaattaaatggttctgagttcaggatgaaaattggactttggaatgtaggtcgatggctgtagatttttttttactttaaataaccatgaggaccaatctgcaaacgaacaataaaataagccctggtcatgttatgtgcactttagtatttaaagtccatttctgtgtggatttgcgtcttctaagttctttttaaatattaatgcagtacaaagcatggccattggttcagtccatgcctactaggacaggtcacgagctaatggaggattctcctccagctgattttgtccagattccagctgatgcaactgatgtttgggaagttgatccaaggcttctaaaatttgaacgaaaattagcatctggatcatttggtgatctgtacgttctataatcttaattaacaactccacttttcatgtaactaaattatagctgtgttaatcaccagataccatgggacatactgtagtcaagatgtagcaatcaaagtactcaagcctgagcgggtcagcgttgatatgctgcgtgagtttgcacaggaagtatatataatgaagtgagtgatgagctttgcttatgctgaatcttgtctgttagtttattttaagccgcattttaatttcaaaaagttttccaagaaaaacttttctgtagggtatgaagattaaactttgacctttaatttattgtagaacatattcttagcagctataaaactaatattatgttaaagtactttcaaatatgaatctagtacgtatgattttagtacactgaatgtactggtaatttgactaattgcttgtcgaaatcaacaaagtttgatcttaatgaaattaaaatatgccttatagatgtcatggagggagtaataaactttggtcatgaaatacatctgtaagacattcattttactgatgataaaaactgcactctcgagaataataaatatgttaaagtagttccatggttatattcttaggaaatgaataattcttttcatagttcattacgcacattttaggtttactaaccggggacaatattattgttaggtacttagccaaaacttctcaaatttagaggattattactggaatagtcttaagacacaatgaaaatttagaggattattactggaatagtcttaagacacaatgaatacactcgatttttgttttttcaaattgataagacttgccacctttctacttgatgtatttctttacttaatcctattttcgcagaaaggttcgtcacaagaatgttgtgcaatttattggtgcatgcaccagaccacctattttgtgtatagttacaggtatacaggtctaatgtgtaatagtacttgtgcagaataggccttaaagtggaaacttttctgtttaaattgttcaatatttctaccgtgaatcatgattgatgtaagttatttagttctattctatttcattcccagagttcatgcgtggaggaagtattttcgactttctttacaattttagaggaacttttcagctccctgatgtgttaagaattgcctctgatgtatccaaggggatgaactacctgcatcaaattaacattgtccacagggacttaaagactgctaatcttcttatggatgaccaggtactttgactgcccatcttgttttcttgtcctgttttgcaacatatgtgccaactacagtccccacatcttgatataattgatcacttgaatcttaggcttgtagcataagctattatttctgataccctgatcctgttgagatacttttaaataagatcgaagatggtcaaactcagtatctgttgtttcttatatgtttgcaaagaggccacttgcccatttgtcttttttttgtttttccttcttcctgccccttgctgttgactagtgccacaactgagccactatactgctaacacagg

SEQ ID NO: 78184 - DNA, 2351 bp, Oryza sativa
  unsure (1)..(2351): unsure at all n locations
caaacccccattctctctcaaaaaaggaagcggggggaaaaaaagagcccccccctttagttcaaccaaaaaaggttgcccccggttaagtctcaagataaacccatgtttaaaatataaagtattactccttggcccgaagctttccagcgtgtaaactatccccttaacccctaaattccggaatgacccagttcatcggccttataggagttttgatattttaaacctattgtttattccacaatgccaagaatgttttctttatccttgtaaaggcttcaggagtccagggtttgtgcataaggaaaaggcctacttaagggatatttggtttataccatgcatggtggacttattttcgattccaccttagcaagaaaaatagtgattgcaccattccaaaagcatacatncccncagattttagatcaaancgtggtatagcagtcactnccagnccacaagaagagcaagacataattacggtaccatgtacaattgtaaattgacccgatatatactaccaacacccttaaaagacatcggggcatataatttttattaacatcatatgctgctaagttggtcagaaatcttgtcctgtgaaaggaaaatagtacaacttaccgcatagcttggtctactagtcttcgtggaatcctcagatcttccaacatgctggaagtcaggaagagaacacataagagaataaaatcaatgaatttgatgtcagattgagtatggctggtatcagcagatatcgtcattctaaaaaaatgtatataaggacacaaatcacctacagaagccattgcaagtccatagaaaatgtcatatttataacatagcatattatcgaacctatataagaaaaggaagacacatgtatttgctgcaaacaaggtttaccatggctcattttacaacactaacacagaagttccaatggtcattaactatacatatgatttggacattaaatatagaacaagaaggttttcaaaatagatggaaaacaaaatgctaggatcaatgattcagaaaaggcagagacacggtgttttccaagacccaaacatgtcatgtcattggcataaaggaggaagtacttggagacaaagcaagacaagaagagcatatagggcatgaactagattgtttagcgtacctcagcacgagggagatccatttcagtctcgagcattggcctgtgaggtatctcatcagtgaaggaagtcaaaaagcaagtaaagctagatcaattgtgcttgggactagctactaaatcagcaaatcaacaaatattgcaagaaagggcactaacctgtgatgccaatgcctgtaggtagcatagagggatagcgcaaccaagataacaattaggttccaagtaacgatagtggagtaactgatccgtgttggggccttcttcgtcttgctttgaattagcaattgcttcggctttatcctcgccatctgctattctactcgtgcaggacaacagcgctctctaggaagatcccacaatctaggaatgaaaaaacaattgttcagtagaagcagccagcagcaagaccttgaaaaaacttaactaaaatttgcaacattaggtcagctaaaaaggctgccgttttggcgtcgtcggcaagcaatctgaagtagtaggatataccacaatctatctgaaaagcaatctacccaaagaatcggtagcttctctaacctttttcgcggtggcaatttatccaacgaccagttgcagcagcctcaaacctcaaagtgagggacggtaccgagaccttagcagctaacccttacaatccatcacgctagctaaaagagagggaggtgaggacccctnctnctncttctttatcagtttncccaattcttctagcctnctctatatgtgctgcgctagagcaacagcgaaacccatccacgaagatagtgtgctncaactgctcccccatcctattagnntnccctcngngttcacgccctaagcaccgactgnctcctaactnnnatattntttnttgagaggcnnnnnnnnnnnnnncnncnnnnnnnnnnnggtaggggtttnnncccccgcgggagtgagagggggggccccctaagatnngagagacctcgctcccatcttttttctccgaaattttttattttctgacccctgggagggtgtaaacccccccatattagtggaaggtctctttctctagagatagccaaatattggtatattactattggggggtgggttggcgccacccctcgtctttatattnccttcggcccattctttatttttcnttggtgtcttattgggctgccttttatta

SEQ ID NO: 78185 - DNA, 1235 bp, Oryza sativa
  unsure (1)..(1235): unsure at all n locations
taaactgtttctttttaatactcaaaaaatatactccgaatgggcgagggggggcacaccaacccaataaaaaggtgcttagtgaaaaaagagtgttctccacacaaattcccggtggcagttgtaagttgtatattattccaacaagaaggggggggggaatttccacattttcccaccccaataaaggtgcggcactttccggtcttaaagggaaaatatttttggtggggggattaagcgggcccaaaaatgccaccccctaaatgacttctttgtgttgggacccccttgtgtcaaaccttttatacgaatcgagagcctgcttgtatttgcgttacttaatgataaggaagatccaattatatgaccgtttaaaagaagagttcttcttgaatcctttatataaataagaccctttgaacaattattgttctagcggacagagaaaagagggtacttagnaaaaagttatttaaagtaggtggccaggttcnaaaaggtgaaagggtaaaaatagtaattatttttatttaaattatttttcggtaaatgccaaaaagcggggaacctcgttttccatgatctccatgcggaatggcgcggaagaagttgttcttataagggccggcgtcaattaatttgagatctccggtgatcgatttgtcaatctatctgcaggattgaattgttcgcttgatcgcttcatcactagttggtcagtgggtgtcgtttttctttcgtatcctgtagctgtgatctcggctgcctgacagcctgaggcccttgtgcttctgaaacttctgattaatttgatgatccgaacctgagatgagattgactgccttgctgttagttcgatcattcaagatgttcgatcgattttgattgtctcatcaatgtgcatgatcgacctgctcgagtacccattaccctttgccttcatggtgaatggatttgtgcagtgtaaaaaattttgttcctaaattaccctttgaagattaacggtggataacaatttattaaggaggtacctcaggtaccttccaagcactgtaaaagacctcgtaaaagaatattttcatgtttttgttttatgtgaaaaatatttgttgttttttttctataatcaagaacaaagctgaagaagtttaaattagaaaagtctaatacaacttatgatatgaaacgaaatatagtagtgtccagtcgggtctaatattgcttcatgctcc

SEQ ID NO: 78186 - DNA, 2405 bp, Oryza sativa
  unsure (1)..(2405): unsure at all n locations
tggacggatgaggggggacggggagagaagaagaggacgagaaagggaggtatgtgtataaccagagaaaatgaccggaaaagtactaaataaaggggaaggagatcaccgaaggttataggantaaaaagattgngagaaaaaaaagagagtgtatattttgatacggaaaaagagatatanaaaattataaatggcgggcaacaagcaaggaaaaaaaaaagaggggtcgggaggaaggggggtcatatttttattttgataaaaaaaaaagagagggaatttagggcccaaaaaaaaattgtttttgggagaaggtgacattggacaaaggtggtaaaaaaaaaatttcgagaagagaaaaggggagaactttcccgagatttgaggggaccactataaaaaaggggggcaatgaaagagatacaaaacaattagaggggagaggtggaggagaaacacaatttggggccgaaggtaagtatggatttcaaggagaaaaaagaagggaaaaattttaaaaaccctttaaaactaaaggggttttttattttttttcctcgaagggcaaattaaatttgatacgcaagctcgtctaaatcaaattttttaagtaattatcaattcatattccatcatttaattcattgttaaatatatttttatgtaggcatataattttatatatttcacaaaagtttttgaataagacgaacggtcaaacatgtgctaaaaagtcancggtgtcaaacatttcgaaacggagggagtagcaaatatgtttgcgctacaaacacgctgctacatgtaaagcatcatctcatctcagactacagtttatcatacatcgcatattcaaaaccaaaaccagtttatcacactgtacttaataaatcatagttggcttcttgacctcaaagaacaaatattgtgagcattaagcatttagagttgctaatcggtgagcatgatgagcctgcttcaaattactcgcattgaagttcatgtgatcttgctttcggtgagcataaaagcacttcacaaataaaatgtagtgtttttttgccttggaagtattgtagaatacagttgtcttcagatttcaattcatcaacctctaaaaagatttcatttgttgctttgattacattctttgcatgactaatgacacaggaatagcctaccaagcaatatctttacaagaaactggattcaagaaccttgcatgcaaccataaaggtttatatattctgctgcaaactctaaggtatcattcatttatgcaagatacaagcaaccaacttcatctatttggatccaaaacaagtgcctagactatcaaccatattaatagtatcatgatgctgcgatcactagctgtctaactcattactgcaatgtgtgatgtgttatcaataaaatagaaagatccattatgatcaaagtattcaaagaaataaagctgatgccaagaacacaagaaaagaaagaaattttgcaaaggaaaggaatagggaacacagaagaatctgtccacaaaaagaggtacactagagggagaagtgcacacccttttgctgaaaacttcttgtgtaaaatcttgaagaaagtttaatagctcatgctcccttcataaatcaataggggtctatttgactgagtaagaattaaggagcttacgaaattgagaaagtaggagagtttggaactaaaaatgcattttagtaactgttttggaaaagaagagagtggatgctttgtatgggtggactatgcaagttaccatcaataggagcatgataggaaaaggacctttaaatttgcatgcaagccttatatatttatcaacaatccatcttaaaattatatggattacatatctagatacttatactctaattgtatctttcatgaaataatcagagggactgaatatgacatgtttgtgtggaattgcaccactgcggatagccagagagtccaacacaaacaaataatgccccaaaaatgatcatagacaagtcaacatccatgtagcattatcatgtaaaagtataaaacaagattaagcaaagattccagtgctcaccacaagctaacaaatctatccacaacatcagcagaagcatctttgtaaatttctatagtaattgagcctttggcagtatcaataacctggaggaagaaaattacaatagcattatgttcagtgaatgcttaagattgttgcattaaatattttatgtctactcagtaaggtcatatgcacaaattcccataaaaaaaggttatatgcatcagatttaatttcctatatttacaggcaatagcatacaatctacttctcttactaaaaaaatgcttgactgctaataattagcatccaaacatcataagttcatacg

SEQ ID NO: 78187 - DNA, 11355 bp, Oryza sativa
ggagctggagctgtgccaaacaggcccttcgtgcgaaaactttatatatataagttattgtaaaaattagataaaccatttttaagtttaaaataattagaactcaattgattatatgccaatgactttttgttttatgtgtcgtacttgatctacgccaacttcaaattcaaacgcttttagaggtacagatctagccaaattcaaagaaaaataactagttggaggcttggagttccagtcatcgtcatgataaaatagtagtattgtgtttgttcttttttaatgatgtttagggcactgaaacaatctccactgtatatatttaatcattatttttccaaaaaatatagtcatcaaaatgatttagagtactaatatatgatactatattttcatgaaaaatttgcttatgccattttcacattgaatcctaatgtttccttttatttgttagtatgttatgttttagaggtttgaaactttgaatggtataaaatgtcatcaatttgcaaacggggggaggattaaaaccataatattcatgaagtattcttcacaaatatgcgaggtggtggctagcctagggaagaatagcccatccggatcatcgtaggaatggacaatatcagaaattcagaagtgaagagagcaaagtactgcttatagcatgtgcatctgcacaagagagatctaaataaagtagcttgtgtgcatcaggagcttaggatttcctgagctattgaactactaggagagtaatcccttgttagggtgcgttcgtttctggcggttgggaactcattccttccgcacggaaaacagagcgatccattatcgtgtgcttaattaagttttagctatttttttaaaaaatagatcaatatgattttttaagcaacttttgtatagaaacttttttaaaaaaaacacaccgtttaggggtttgaaaagcgtgcacgcggaaatcgagagggaaaagttggtaacactatcttgcgaacacacgcgacattgatataaatctctctctgcccttaaaaattactgtctgtggcattttttttaaaaaaagcccatgaaacatcttagagaaatatgaaatgcatggaaaaaagtaccggttgaaacattttgctattgtgcataaaacattgaatttcaacatgtgaaacatataaatttcttttatcaaaatataatcatttgtaaaattttagttgcaacgaatacaatggtgtagtatgattgtagatgagataaataatataggaggaaaaattgtttaaaactttaaagcagagacttgagagatagagtcatgtacatacaaagcggacgtacggttcttttttattggagttttataggatgaatatcattgtcagcccatttattttttctcgcatatttttttagacaatgacatgtgaggtcatagatacatgttactgggtgaaatcccgcgcgttgttgccaaagtttcgtaagatagctagacgacatagcttaaataaattgaaatggtttatgataatttaaaaagtatatggaatgatgattcaaatgtaaaagcaaggtgatatagctttataagagaagaaaaggaaggagataatttggtccatagattaatcatctaagaacttaaaaaacaattgatgtgatatgtttaatgagagaataaagaaataatattaactaaatgaggatgaaatacgtcaagagaagagccctatgcgcgggggcgttgtcctaggcacttgagagctgggttgggttgggctgggccatgcctttgcactctattattactccgtctttcccaaatcgatcatcatgtaatagaatccaaaatttctcaaattatcgtcatataattgcatggacacagatttcatcagaatacaattaatacattatgggagaatgtgtgcatgatagggtgtaattggcatgggttttaatcgatgcatgcattgtgggagaatgtgtgcatgatgtcttgattgatgtgatttaaattgtatttggttttagtttctaaacttatatgatgatcaatgtgggaaggagcgagtacatgcctaaaatacgagagcgaaattgatataatggtggacttgcagagacaaataatgatctaacaggcaaggtaatcttgatggtgtggcctcatagaatttgagctttataacaatgaatgactattagtgagtcacaattttatagtaaggagggattaataacatcatgaaaatatgaattagctgattttttttaatcgcaaacaaggaattgtggtttgcaactcctatataatttttccaccctaccgatcctaaatggatcacaatcacatactcctataccgcaacccgttttgagccaccggcccaccccaccccccctacgcacaaaacaccgggacgcgaagcggaaaacgagcgagcgagcggggctctccagtctccaccccgactcttcgtgtccgctgcgaaaaaaaggttagaacaccaccccccctcctctccctgatccccctcgcctcccccctttccccccctctctttgctcctctccacgcagcaatccgcccctcgattcgaccagatcggcgcgagtaagtccccgctacatcccgatctggatccgcccccgacctccgcgtgatttccctctccgtggcggtgttttggtcgggtacgtagatcgacgcgtggtggggcgggggggttgtattgtttgggtaaattctggtgcgcgacggcgggggggaattcgggttggtttctgaccgaattttgacgcctgtttgttcgatccatttgttgtgcagtgtcgatctatcgtgtgatgtgatttttttccccctggtcggtgtgtgtcttagttcgagttattcggatgtcgatgggagatgctcatgttttacttgttttgtctgtgctgaccgatagattcgttaatcgttgtgattgatgtcggatatgtttgccaccattgttgatgtggtttaggcgcagtagttgtcgtttgattcctaacagatcattttacgtatttgggagcaatgcgaatttatcaagaatttgataaccgcgttagtatgtaatcaacggcttgtatgctggtatgcagtagtattttatgaacttgtgaaattatagttgcatgtgttggtatagtggagtagatacgtgagaatttactactttgtcttacattagcttacggcatttattttgactatggaggttaggaccatggacccatataacctttgtttatctttctggtttacaagagaaaggtcaagtttgtatggatattagtgggtccataggtttgtaattttaggataatttactctgaatgtgttgatagcgaagttgcttatgtggtgagcttaatgcttttgacttttgttaaaaacaagtcccactgcgttgctttatatctacttatatccgattccatgttatgtaaggatggatcgaaacatgtttaaaactgtagaactaataatatatatttcattctcttaagtatgctaatgcaatttaagcaggagcttatcatggcgtcgaagcggatcctcaaggaactaaaggacctgcagaaagatcctccaacatcatgcagtgcaggtatgacccagatttatcagccgaactatagctgttagacacagtgtaaacttgagcgttgatatgataattgtactctgtgggtggtagtcctcatgttcttgtcggatggaattgtacgaactgtttgtatcctttagtagtgaaatcatccaatggtgtggttatccgtaaattaattttgatgaatatattttgggtggtgagttgtttgtcagattgtattccatgttgttcaattggtccacattgaaagtggactatcggtgtcctacatgtaaacaatttcacccagtattcttgctacaagaaaatgcataattctgtcagttgttgtcatgatgatgcccttgtgttttcatctagacagctgtgatgtttataattttgaagaaacgcttctaagacagagcatcctaatgtatttacattttatattgaaaatcttgatgaaatatggacaattattaaccagtgcaattgatcatctattctcatgtaaacaatgaattgttttggtcagtttggtcttgcgtacctttttgccctttgcttgtacaagctctggtgttgatgaactatagatttttataaatttaggtcctgctggtgaggatatgttccattggcaggcaaccattatgggccctccagatagtccctatgctggtggtgttttcttggtgaatattcatttccccccggactaccccttcaaacctccaaaggttagcagcgagccttattctggggcaaaattttccaatatttgccacttctattgaagatgaatcatgtggctattgttccctctccctatctcatggatggattgctactacttttaatggatctttatttcacaatcatttactgtcttcactcagtatcataattcataaatgatctacaatattagtgaatctttagctcaatagattggttcactaagtctactgtctacctagtggtggattccttctgctatgcattaagttagctcctttttttcaggtgtcttttaagacaaaggtcttccatccaaacatcaatagcaatggaagcatatgcctcgacattcttaaggaacagtggagccctgctttgacaatatctaaggtgctttgatgaaacttcactaaacttcactacctataggaaagcacattgaattccgcatgcacgcttcccaaaatactaaatggtgtattttttgcaaaaattttctataggaaagttgctttaaaaaatcatattaatccatttttgaaatttaaaatagttaatactcaattaatcatacgctaatgacttatctcgttttgcgtatcttcccaatctcctcaatccccttctcctcaaactcgccctaaatgaatgcatattttccttctttatgaactttggcgaattgcattgattcatctcatacacaatctagataacaagagagtgcgctgtctgttcaaagtgactgcatatgtggcgctaacatttgggtttgtttgttttaggtcttgctttcgatctgctcgctgctcactgaccccaacccggacgaccctcttgtccctgagattgcccacatgtacaagacggaccgtccaaagtatgagacgacagcccgcagctggacccagaagtatgccatgggatgaaaccccaagtcctgaattcgaatccactgcttaaatgcagacaaatttgtcccaagaaactgtttatgggccattattttctccgattccttgccagtcgtgttgtgtcagatccatctaggatcgtgtctcgtagccccgacatcaacatatgatcatcgtccgtcgataatgagataacatatgcttgcccgtgataattatgatatggtggtggtgatgttatttctgtcatgcgcacacaatatggcgcctagtgcctttttcttacctggggttcctcgtattccaatggtggagtggaggttgagtagctcatgcgaggaagctgcctgcacggaggagcttgttgatgtaacgttagggcatttacaatgctcctaggtggcgttcagcctcaaaggaagcaatgccattttcagtgccatgtcatctatgtgtgtagccaagcgaggaccgagtgaccaaagttggtcacccgttcttggctgaaaagcctgtcaaatgcagaggagaggagaggagagagagagagcgtgttgggaataaaaatcacaggagagagagagccgccgccgcccgacgccggcgccgctccaagtcgtccgctcgtcggcgccgagatccgcccggccgcctctccgccgggtgccacgccgtggtggaaggctgcctctccgtcccgccgctcgaccgccccctgcctctccgcccggcgtcgtggcccctcgtgccgccggcgaagtcgccgcgggatctgcctcaccgcccgggctgccccgccggccgccgccactgctcgaccaccccgcccgccgccaccgctcacgacgcggaggccggatccgagcgtcggcgcgccggccgcctctccgcctggccggctgtgctccgccgccagccaccgccgctcgaccccgccatcgccgctcagagagctcactagtaccacttgttgagagacagagtagttgtcacaccctgaaaattcaaaatatataaattgttgtttaattggaatttctagaatttattttaaaagtcttgaagagaagatctaagtttaattaataaattccaatataaaatggggccagataaaatttcattaaatactttgcttaattctataattcctagatttttctgggatttatttgagctaagaaagtatttttaataaatggaattgcatttaagaaataatttaaattgaaaaaggttttaaaaagtcttcttttggctttgggccgaaagtcggcccaaaacctttctctctctcctcggcccagccggcccagtccgcagccgcgcgcgcgcgcgttcggtcgctgacaggtgggtcccacctgtcgggatcgtcgtcctcctccggccgaaaccctagtttcgtcgccgccgccgccgctttccaatccggccgctcctttccttctccggccgaatcaaaagaggggaaatgatcctcgggatctcctctaccttttctcctttggaaacttcggctaaatcggtttggaatgagtttgattcgagttcgaatcggatcggctttcctctctccaagcctgagctttcctttgccgttgccacagccgtgggcctttgccgccgcctccgagcccctttaaaaggctccccggtgtctcctctacccgtcgccaccttcgcgttcgcctctcgtcgtcggaagagccctagcgctgtgtgccctagcttcgccgtcgccgccgtcgctccagccgtgcgccgccgtcgctccagccgtcgccgtcgctcgggaagaccgccgtcgtggtcgccaagtcgccgccgtcctcgtccgcctcttcgctgccgtcggagatcgccggagcttcatcgccgtcgacaacccgaaggtttccgccgtttcctcctcgtcgccgtcgtcgttcgttgttcctccgccgtcgctttggtcgccggtgagttcgccgtgccgtccgctacccgttggtgccttccattcgcgccgccgtgccgtcgttcgccggcgagcatgcaagcccgagccgccgagccgccgccgccagtggtgacgtcatcgctgacgtcatcggggccgttcgctgtgagccggtcgtggaccgatcgatcttggccgtccgatttggatgggttgatctcggccgtccgttcgcgtgaaccgtcgcccgtgcacccggtccaccgaaaccctagcccgctgacgcaataatcctccttttccttttcaaaaataattcattattgcgtcataattcaatttaaaccgatttaagtgttttaatccgatttaatcttcaaaaattcataactaattcatcttagctccgatttagttggttcaagtctctaaatttttctaaaattgagatctacacattaaaaatatccacatgtactgttcatgcttgtttatgtgctgttttggtgattttgcttctttttgtttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgtttgttatagcccttttgttcttgtttaccttattccttgataccttgggttattataatttgactagttgagctttatttatattggttcaactagatattagaaataattgcttagccctgcttagaaacattagcacacttatgggataactaatgactcactattatttcatgatggcttattgatagttcacgatggtcaatcgtgattagttaattaattaatgtgccaactaaaacctgataatggtgggttatgagcacatgattttgatggtcgtgctcatgacaattaaggaccggttcacgagtttcggttgtgaaacattaatcgtgccaaccacaagccagcatgggcaacggctttatcttttgtatagcatagttcattgcggggcaccagactgagaagtggcggagataagcccacgggggtcgctggggagtccatgccttgtttataagggggtgattatgatccaggaaggtgtgctgcagtggattatgttgtatgagggatactgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccataataaatgatgctataactggtaataatgtgattagctcctggtttggaatggtatattcctggtttggagatagaactgtgcagccggggtggttgttcagaatggttgggcctatacaacagggtatgttgtatagcgttggattaatattgtttaatacttaactgttttactaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatcttattttccgctgcttagatttttattgtttgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttacccatagaagccttctaaaaatattggaaaagtagaactgttctcctccctttctcttttaattaaaccaaactaatggcacatgcacttcataaatctcttttaatggttctcattcaaaatttattccagtgttattagtactgtacatctattactgtactaatggcttatttatcagcaaaagttttacaatgttgttttatttaatcttgttgcaataaaataaatttagcatgacgattttataacttgattttatttcttttggaacctgttattcaaaagtacaaaacttgtgaccttgttttcaactatttcaactcatcttgcaagcttggtttactttatttacttactttttatcttgattttctaactttattcaaattaatccaaaaacttgtgctgttaattggatagatgtcttaactccctcctttcacttgtctttagatgccgcgctacaagcctgagtacttgtttggtgttgagggttttgtccaggagttgcgtacgatgtcctttgtcattggatttgggaatgcccctttttatacccagattcctcattatcgtcatgaagagaagtgccgagtcaaagtcaccttgaacagcaatagtgaagaggtcccctcagtgatgttcgaagctggaggaagaaattacatccatgcatgtcaggaggtggcaaggatcgccataggagagctccgtgatcgctacagtgatcagttggccgacactgagtatcgctaccatcctcgtcaacctcagggaagtgaccgtggcagctaccttgagactgaaggaattgagaatgatgctaccacaaggcatttggttgagatgctgtgggctatggatgaaagtcgtgcggagactgtgttagcggctcaagatcgtgaagaccggaatcgtggtaagatttgcaagttagaagacaaggtggatcgtttggagaaggaattagctgcgttgaagggagaagcaccgccgcagaaggccagggttcgtctcaccgcaaggaagagagctctatttgtccctcgctatcaattggcgccaaaggttcgtgtggtggaaaaagaagttgccccaaccctagcagatcctccggtcatcatcataagtgatgatgaagaagaaggatccaagcgcacccgttccaagattgagtgggtagcaactcaagatgatgaagacgagccgaatgagccttcaatcgacctccgatgctcggaagaactagagtgacttgttaagtcgtagtcttagatcgttgtgttagtttgcttgttttaagtttgcttgtgtgtgtctcgcgtgtgatttacatcagtggtgggatgtaagtgcatgcgtttgtttgcttttgagtgttaggaagttggagagtttagtggtgtgagagtcttcagtttgtaataataaaactcagttaagatcaataaaagttaaagtaattctctgtcctaagtagtttcccctggtttctcttcttgtgccctgtccatgccagatggtgaatactcgcagcaacgggaatggtcccaacaatcccaataataacaatggagagaaccccactcttgctcaagttcttgctcaacagactcagcttatgaacatgatgatgcaacaacttcagaatcagcagaaccaaggaaataaccatgtacctcctcagaataagttagcagaatttcttcgtgtgaggccgcctgttttctctagtaccactaatcctgttgaagctggtgattggctgcatgccatagagaagaagttggatttacttcagtgcactgatcaggagaaggtttcatttgcatcgcatcagttgcatggccctgcctttgaatggtgggatcacttccgcctgaataggattactgctgaacctatcacttggcttgaattcgccgctgctttccgaaagacgcatataccatcaggagtagtgtctctcaagaagaaggagttcaggtcgcttactcagggatctcgctctgttacggagtatctgcacgagttcaatcgtcttgctcg

SEQ ID NO: 78188 - DNA, 4115 bp, Oryza sativa
gtggcgcggtggctgccccctaccaagctagagggaggaggccaccctcgcttggggtcgagctgccccgaccccctccacatatcagcccacgtgtacagggttaggtgggcgcgcctaatgcccacctaactgcatttaaagcagtctatgcaaccgcgccaggccgcatttaatgcggcgtgctgcgcatctgaccggttgaatgaccgatgggatggcgactgtgtacccctgccctgtcagtgtgtcaggcggcgagcggcgtgctccatcccgtcccatcataatgatgaggggcttcacagcctcttaccccggtcagagctggtccaaccactctgaactgacccgggttcccgttttctggtgtgaacgagaacccgaaagtcctcatccattaaatggcgaatgacaagggcgctctgcattgatttgatgggccccgcgcagcaaccgcggatagcttctgggctaaggcacaagacatgtaattaatatagagaatattttcccttctccctaggtagcactcgcagcacatgtggtatccccttagagtataaaaggaggaccatgcctagcgaggaagggggatcggactgaggatccctgagccaaagcttgtctaaccctagcttgcataccagggattcagggactttctaagcacagaagaatcatacacacaggagtagggtattacgcttcatagcggcccgaacctatataaacctcttttgtctcatcgtcttggaggggcctccgagatcaagatcacacacagtttcgctcaccaaatcctcgaatctcacccgctgcccctggccgaactctcaaaggagggcctcacagcctcccgctagagagggtcacccctcaacaaagacgagtggtcaaacaatgcaaacaaaaactcaaaatcccttatattataggatggagggagtacgacagaaaggagtgattttgtttagtgccgtagaacaaaaatatttgaaaaaaatacataatcacaaatatcttgaattgcaaaagggcgtagctagaaattgtgatatgaatgatactttttaaaagaacttttcacatttattttatgaaagtttggtttgcgaggatcttatctatttatagctatattaattgagcacttcgagtgagctcttacatgaacttaaaaatatataccatttgataagtgaatatgtaaattacacattcagatttcgtgttaaatgaaacatattccatggattctttatatttagttgatttatctccgatgtttttctttggttcgacgccatttgccaacagtaatgtgagcggaattcgatcgacaaaagatctaccgttgattttagatttttttttctattttgaggaaggcaaggactacgtacaacttaatatcagttgataaaaacaatagttatggacagggcactatgaccaaccctagagggagatttgtcttttaagatggtttttcttattagtttctttgtaagaattggctttaacttctctgaaataaaatccagaatgaattccatcatcttaaaatagaaaaaaaatagttatgggcactatgaccaaccatagagggagatttgtctttaagatggtttttcttattagtttctttgtaagaattggctttaacttctctgaaataaaatccataatgaattccatcgtcttaaataaaaaaataccgtcttaatttgagagataccaagaggtgccaaattttacagtagaaaatgcagtacctccttgtacctccccaaggaccgtaaaatccctctcttaaaaatatctagttgttacaaaaattggaattaatagatatggagttgtttcatcgctttattaatttaatatgaatttgaaattgtcgacgtttgatgtcgcgattccggtatttgcatagtatggggatcgttagtactaggatatatgcgagattgtagtaaaagagatgagggcgaggatttttatacaggttcgggctcctgaattgtcaggtaatagccctacatcctgttggccgaagccggtcgttgctcttattcaccataatcacaccagtacaatatttagggtagcctatctaacggttgtcgacatggcggtctgaaggtctgactcgtagtcgacgacagggtagtcttcctcctcgaatccgtgcccgatgagatcagagacaacgctatgtctctcctgacagtatccggagacaccgtaggggattagccatgcctatctctgaagtcgatatccggcttcttgtcttggcgcatgttggcttgtatgtggatcttgtgtcttgatctattgtttcgtgtcccctctcctcctagggggccttgtatttatacccatatgtccccttgtccaagtaggactagggaaaccaatatggatacaatccgagtagtccttgtcgtttccatgtaaaactctattcatccttccttatgcagaactccttctatatctgaaagttgtttccgtataggacatggtatgtggtgggtcctgccgagatttagtcaactattattaggtatgtggtatccataaccttgacagaaaccaataattatcaagttgtaactgaaacaaactcttctttttaaactaatatgctaaaattaacaaacaaatttagaaataaaatgtagatggactcacaatttagctattttaaatataattataaaattcaaagttaacaattagccagttgtaactgacacggtttcttttaatttaatatgctataattctaaaaacattcaacaacaattttagtgtatgatcaaaatttaaaatatatataaaaaatagcaatagccaatgtaacacatgggtgtgacatcccgacctaggggttaataggattaatagaatactcatatcaacaggttacaacttcttttccggaagccgatctccaaagaacaagttgcaacttcttttccggaagctgatctccaaagaactccagggttaagcatgcttggcctggagcaatttgggatgggtgaccgaccgagaaattcttatcaacaagttgcaacttcttttccggaagccgatctgcaaagaattcttcccgggtacgcacgagttcacagagggacagtctatgacctatgaaaactatcagatgtaagcgggcccggcctgggaagaggcgagacgttacaatgggttaatgactaagtggtatattaattcacgccatgggacagtctatgacctatgaaagctattagatgtaagcgggcccggcctggggagagacgggacgttacaatgggctatcagatgtaagcgggcccggcctggggagagacgggacgttacaatgggttaatgactaagtggtatatcaattcatgccatgttttattagcatggctgtgaacaaatgatattttgctcaagtaaaaaggagtgtgagtagtactaattagttttaagccatgggacaggctatgacctatgaaagctatcaaatgtaagcgggcccggcctggggagaggcgggatgttacaatgggttaatgactaagtggtatattaattcacgccatgttttattagcatggctgtgaacaaatgatattttgctcaagtaaaaaggagtgtgagtagtactaattagttttaaaatttcttgatacagtgttacttcctcatattcataatatagtgatttttaggattcaaattttgtatcacaatataagtattcatataatgattcctatagttcccattattccaactataggggattgcccctattcagttttgcgctgaggtaggtgacggagctcgtggctcctcaccgggagaccgcgcaggcccccctttgccagttcggccgggggcttagggtgaaatctcaagctctcgctctctctgtatgtggaaatatcgtctgccagccagaaaacacgagacaccggcgatctatacaggttcgggccgctcagaagcgtaataccctactcctgtgttttggtggatctgtgtatgaatgagctacaagtgtgagctgtcttctcccccgttctaagctcctaatctgggaa

SEQ ID NO: 78189 - DNA, 11366 bp, Oryza sativa
atagatgataagtatccaaatgcactttctatgcttggaagtcttgaactccaaggtgatgaaacctggcttactgcaaaggagcatttccgtgaagctaaagatgcttctgagggaaaagacacatactctatgcttcaattggtatgtgagcttacttaactctagtacatttatctacttatcactttactggtttgattaacaaccttttgttcgaaaaaggcagatggtttgtgtaccaaattgggaacaaacttgttatagactttgttcttatttttcttttgaaaactaaagcccaaatggggacttaaattacacaggaagatatggataagaattgttatggttaaagtgaagaagtaaactcctcgttatgaattagttgcctgtaattactgataactttgtttggcgtgtaatgtctggacaagtgctaccagctggcaggagatgatgcattgagctttatatattttgaatcactagcatatcaccaaatttaccattgagttagggcatgctagcataatcttagtttgatgttttcccacaataggtttacatctgctggtttgatgcaatcattttatgtaactaatcaattgttttttctctattttaaaaacgatttttccatgttgttacaggggaactggaattactttgctgctaatcgccctgagaaaaaggccccaaaatttgaggccactcatagggagaaagccaaggaactgtattcaaatgtatgttgctttatgctcaacaccaatttcagaggatcaggattatattttgtgtaggttggctgattaaatatacccgatcacctgctcagattaatcttgcctttaacggtttgattaatttgtttacttggtcaaaggagcaaatttaactattagtagctttttaggaatttagcaaaaagttcagttttagcttttcttttttcctttttgggtaaagtctaatgtttagtttaacttctattttcttgctatgctaaatcatcgactcctgaaaccatggtttcctagaagttgcaactactctccccaattgaaaacaatgaaataatagaattggtgtagtcaatttatgatgatgtccaaagacatcatctacaatatgtttctgggattcaagaaaatggtgagtgaatttgtcataaaagtacttccgtaatactacccttataaatatattcttttaaatatatgatattaaaaactagagggtaaggtggtatctcattgaatttgggaaatcataaaagtcacttccatttgaaatgcaattatgtagtctatagaaaatcaaggaaatgaatagcttgatttggagctattgtagtacttcaataaaatatatggcacaatgtgataatatgtgcactcattgtttggatgcactttggtttgatttgttgtacacatgagcaagtattgcttacaaccaaatcttgtttggtagcagaagcatttggtggggatagtgtggccgcattaagtgcttgttttgctcacttttgagatctcaatgtctgatgcaggtactaaagcagcaccatggtaatatgtttgctgcaaatggtattgggatcttatatgctgagaaagcccaatgggatattgccaaggagttatttacacaggtcaggggagactactattcatcattctatatgattactgtgaattatgagaaatttacattagcaatttgaaatgaattaggtacatgaagctgcttcaggaagtatatttgtccagatgcctgatgtttggataaatttggctcatatatattttgctcaaggtttttttcagcaagctgtgaaaatggtactactctctccacatagacagacatgcatgggcagataaatatttaagacaggaaagaagttgataaaagttactgattctttcttgcagtaccaaaactgcctgcggaagttcttctacaacacagatgcaactatacttctatatcttgcccggacacactatgaagctgaacaatggcaagactgcaggaaaacattgctgagagctattcatttggctccatcaaattatttattgcgattcaatgtaggtgtttcgatgcagaaattctcagcttcaactctacagaagacaaaacgaacagttgatgaagtcagtactgctgctttcctatagttggtctctgtttatttgatttttgaaataaataactaaactggcaaaaactcatcaaattgacctttatgttattttaggtaaaatgaattggggaatcttcagccatagttacttatatatctgaattgattgtgtttagagatgagattatgaattagagttgtaatatagaaagaaatgagtacttgtcattctgattgatatttgaaaaatgtatcatcttatatatttactttgaaaaccttatctgtttaatcttttttctctatttccaggttcgtgcgacggtctctgagcttcagaatgctattagagtattcagtctattgtctgttgcatctacataccattcccatggttttgatgagagaaaaatagaaactcatattgagtactgcaaacatttgcttgatgctgctaaggttcatcgtgatgcagctgagcaggctgagcagcagaataagcaaaaaatggaagttgctcgacaaattgctttggctgatgaagctcgccgcaaggctgaagaacagaggaaggcccaggtataggtcttgctgtatttacttcattgtcaatatgctgatgataagattacaagtttatgcctaatgggatggtgttaacagttagaaagaaggaagcaagaggacgagctaaagcaagtaatgcaacaggagcaacactttgagcgtgtcaaggtattttatatgttattcatattttagagatattttcttgtttcccaaggatcaacaggatttttgctttacttagagcctcatctatcactgattaccatgacatatggtctcatcaaccctggcctcttctcgtagtttcgttattgtgtataatattttttttaaaaaaaattgcacaagtatataaaagatatctatctcaaatgtaaaaaaaatattttttcccatgaaagacagatttctctatgctgtttgaaaagataaaactgtttgttcgtttgccccatttttggtgagaattggctactttcttgccatgttctatcgaatgagtttgaaggaacctttaggctgtgttcgttacttgtagttgggagcaaatctctcccgcgcagaaaatggagcgatccattagagtgtgattaattaagtattagctaattcttttttggaaaatggatcaatatgattttttaagcaactttcgtatagaaaatttttgcaaaaaacacaccgtttagcagtttgaaaagcgtgcgtgcgaaaaacgggaggtgtgagttgggaactaacacaaacgaactcagttaggctcttttgaaacctgataatcttcaggaaatcaggtactagtctggcaagagattgatgcacattctacatagaatgggtattaggtttaacaaacttacaagtcagctgaagataagccttcagatacttgccagttgccaaccttaagtttgtagtttagaaaaatgtcaacgtctcttttatatgggcctcaggcaaacctatgataaaacggctttagttttttctgagtcactttgagccaagtccctaaacagtgttattagctggcagattttgtggtgttgtttgattagtaactttacctctaaaagagattgcaacctaagcattttactacaggattgtttctcagattggaatactgtaaatatatttggtctatgcatgacaacttagaagattattctgatattgaccatctttcattaggagcaatggaaaacctcaagtaacactcctggcaagagaaaagataggtctaagcatgaagatgaagaggggggaggtgaaaagaggaggaagaagggtggtaggagaaggaaggatcagaagacaaaggcacactatggggaagaggaagaagacgaatatagagatgaaccagaagcagaagatgattatgcaaacacggcgaggagtaacgatggtggcgattcagagaaagccccaggtcaccttcttgctgctgcaggtcttgaagattctgatgctgaagaagatgacatggttagtgtttttttttttctttttcataaataacctgtatcccttcatttctatttacaaattatttgcttgtctgctttatcattgttgccactgagttttaattcctttccaagctttgcattgaaagttagtttgcctgttagatctagccttcgcactcttatgttcatttgtattacttttgctatttatcttcactagaaataaaaattttagatgctctggtgcaaagttgccttattttgtcttttcctggctgtagggacaccctcaatctgccatagaacggaagagacgagcctggtcagaatctgaggatgatgagccagtgcagaggccagtgcaacctagcgcaggcgagaacgatctgagtgattgaattagacggtgaagattatggccgaatttgggatcacttcatatatttgtgacgaagaatggctcctgggatgcggaatcaactatagggcgtgctcatatgcacttgtggataattcgatgttgaaatggagctcagacagatggttgaaccagaagtgttaaaaaaatttatctgggagcagagcagtcactgatattcaacaattaatctcgcgtcattctagacatgccatgggttggtggagctaacataaggcaatttgtaatttatgtctagtttacgcttaatcagccagacttttgtcctgtgagcttctaacgctgtaccaattttagctcacttacatctcaggatagctgatctcctactttgttctttgctgctaggcaagcgtgccaagaaaagatttccaaaagtagctgatctcctactttgcacctaatttttcagacacttcggtttggcaggcaactgtacgtgctcattggcattcgctaatatcgccctgctctcgtccaaacaaagtaatggatatatagatctaaagtaacggattttttcatgcgatttgttttcaagttgcaccttttgggccaaaagatttcttgatgactgcatatatgttgcattcatgtatttatttgagaacctctgttggtgaagtaaggaaggaagaaagaagaatgtccttcgatgcttcagttgcatacatgtctcgttattaaaaacttacgtaataagaggaaatacgaatggattcggacagcagaagagtgaatgcgagaagaaagacgaagaatacgaatagtcttgacttgacactactttcatttcgtttcatatcataagttgtatttgacttttctaatttaaacttcttcagctttgatcaagattatagaaaaaaaacaacaaatatttttcacataaaacaaaaacatcaaaatatattcaatattagatttaataaattaatttgttcttataaatgttactaattttttctacaaacttaatcaaactttaaaaaagtttaacttaaaaaatcaaagtggcctacaatataaattagaggatttaataaaattaattttgtgctataaatggtattatctttctataaaattggaaaattttttaagaagtttgatttaaaaaatcgaagtgacttataatatgaaatatgaatcggagggagtacaaaacaatatttattcttcctataaaaaaggtttttttggtcaacaatgagtgcgttgcatagctaagccacgcccttcttttgccagaaatcaacatccgactcctttgatcgaacataacaaacttactattcggatggctatgccgtggaagcgagaaataatgtggtttcactaactagtaatctacaaaccagacggatttttagcaccaattcctttcaaattcttacatcgctagccaagcccaagattgcattcaacagattcgcacaaaaattgcaagaaagcaaattcgttaatttccatttcacccacatcaactgcgaatcaagtccttgggatggacttcgatgggtgtatgtgtagtcgtgccgtcagacagccagagaagaatagtcgggagggatggagaatgaggatgtgatgcttgtcgttgtctaggacctggagaatacgtgaattacacagaagagcacttttggctatgtacaaatattctactataattccataccaagcttgttaggttggaactagcaacctctctgatagtatatatgtccttatcgcggatggaatcataaatagtttacgaaagtacacgtaacattctgcttggaagctactccactaaaacattatacttatgagttagccgtacatgatttaattcgtttgagtatggatacactaccacatagcatctttagagattataggtactgtacatgggcggagctagaacaaaatgtagagggatgccacttgcttaatttactctacatcaagtccttgtctaaatttgtatccaagggggtgcacacataatgaaaatgggtgaggtacagctctaactttttttaccgggttcctgggcaccccatgagatactctacctccgcccctggtacctataatcgtttaaaaaaatgattgcattgatactcgaatcaactgtaacccggctcaaagcgtcagctcgatgcttcgagcaccccctgattcccagccccatatgcaatttccccatccatattacaaatcaataagaacacaagagcatatgcacatatcaacaacaaagacatcacagatcaagaagacaagaacaagctaatcgcattgcagatcagaacaattcacataatagatcaagatcttccgccatgaccaaacattacatgttcaatatatcagactcatcgttacagtggatctgtcaccgccgtcatcgattctcttgctgctcgtctcctttgagccgccgccatcaccatcatctccttctagcgaccgcaccagctctcgagcgcaaacaaggtgatccacggtggtgaggtccaaggcgtctggatgcgatgagccccgaactcaaggaggccggatccagcggcccccgacctccggacggttggatccagtgggaagagagagctcggaggtgacgaggaggagaggcaccaccaaggaggggaggaggaggtaaaggagggggaggtctgcggacggaacatccttcgtcccaaaataaattcacttttaatttatttcacttttgaatagtttcttgaaactataatcagtgtattcatgaatgattagagatgagggtacacatgtttatacactgcttccctgatagagttacaataactaatgttgattggtttcagagcattgctcgatcggtacaataaggtacaaacaaactctatatcagcaacaaatgtcctcaccgagattttgcagttttatcgaattaacatagaggtggactggactaactgcaagatggtgtcatttaatttgtctctttcactaggtttcaactattttgaccactataccgtgactttttttcaactagtagatgtgttcatgggttagacctgatatttcgatgatcaagatcatacattcaatctacgtgttcttactgataaaacccagaagaccaactaagaattttctcgtaaattaatgaggatatggttggaactagaggggattttcatgtcactatggaaagcaaactatttttttcaaattttgaaaaaaatatttttcatatattttaaattctatagcaagtttattccttcatcgacctatcaggttagattcatgatcagtttgaagagagaagtgagtgttggcaacgtttttggtcgcgccgccacgatgaaaacacctaatgctctacagtgatataaagtcatcaaccaccttgatctagacaaaaacaagacggattctgtaagtcaaaaccggctaacagagccaatttagatgaaatagggataaacactcttgcagaatttcgggacaaacctataaagaggattcgcactcttgcggcaaggacggacgactttcagcgcaaaccgatgaagatggacaaaaactagactagaactaggcaaaaagtagatgcgatattgaagattcgattggctaattgtgttaaaagtagattgtgtgcatgattgaaccgaccataaccttttattgccatagctcttataaagaaattggtttgcctcctgtagggtcttctccatgtcttacacggggtagagaccaattagaagtcgaaaaacctcagcccaagcaagtaaacccaagacgcaaaaaatcaacttggaggcagagttagccgatttgatcagccacatgcctcagtcagaccagccccacaccgctgatcagaccgacccataggcggcggttaagccgaccctgtgaaggaaacctagtccctttcaaattcagcaatgttttcctattatgtttctaggtgctaaatttaggtgttaacaaagaggagagagtgaatattaaaagtggttcgaagggagaaagaagaggggagggaaaaaagggaaaaaagaaagaggacaataaaataatacgctctttgagaagaaaatacaagggaaaaaacctaaagagtggaaatacactctttgtctttttaagtcaaacttcttaagtttatagaaaaatatattaaaatttataacaccaaattaatttattgcatctaacattgaacatatttggatagtttatttgtcttgtgttgaaaatattactatatttttctatgagtttagtcaaactaaaaaaattgagaaaagtcgaaacaacttgaaacggagatagtagttattttaccaagtttcatttgtaccaccacatatctaatgttttcttcacttataatgttaggtattgttaccgatctttgcaccttggaccaccttctattcatctctctaactatcttttcgctttctccacctctggttcatgaagattgtcgtcatcattgtcagcgtgcctcattgcttaagcttgagctatgtctctgctcacataatagctatatagcctctgcttccttcagagctttgagctcaagctctaatggaaaaccaggtttgtctctagcagaatttgtatttcttttctcaatttctctttatgttggttcctctttcttttgtctgaaattgtacctcacggcacacctgtgatcaaagatgtatttcaaagatgatagttttctttacgcaaaagatagaaaatctaccttatatccattggattaattaattgtgagtcacattgtagcatagccaaatggcaagaaaaacaacagagaactatctaaaggacagaatttcttatattccactaaaatttcatgtagatttaacacttggtgtactatttcatgtagcagttaatctataagagatgacccctaaactaaattaaatataagatatcagtaaattttgtagcaatctagaagagatggcccccctaaactaaaatttccattctccctcgggccaccgggtaccaaggcatattcttgcagttgcatgccggcatacttcaaaaaataacaagtaatcatattttttctaacctgatgtgatcttcgcgaggctacgagtacgacctccaaacaagcatatcccctcttgatttacttaactaatcagtagtacgtaattaaccatctcctctcctagctttagcaatgcttgatctcgtataagattctctattattattagtagtactctagctattatactaatcgccaatgatactacatgttgatataattaattgtcctttttgtcatctacccctcacatttgttccttctgatcttcttgccggacgccgggtgatcaatgttgctagctagggaccgggttgtaaaattagttagcacaattaattaataatattgcgttgtagggtcatatacaaatttttaattagtatttgttttggtgctcaatactactaatattatactaatgtacataatcttatccactgatcatccacagctagcacaagctttgagtggtacaatcgaggagtaatataatgattaagcaagttaattaattaatggtcgatgtagcggtcaaggaggtcttagattattcgcgataaaattaccttaattatacaggctgtgttctgacttctgatcatacacaaggcaggtctgtactgtactgcaaaggcaataaataaagttgtctctactactgtcaaataaacttttttaaattttttattacctggagggaaaaaacacctcaaatacagatttttctagaaaaaaaagtgtaactcgcatcaattatattggtttatatgaaagaatttacctgtagtcattagtattatttatagatgatgtatcttatgctaaagttttctaaaagggaattagtaaatattttttggaaaaaaaaactttcaaatacgactattttatagttatggtgtaattatattgtaactacattataattttaataaaaaaactaaaagttacttaaaatttatattgaagttatatgtgttttcaatatttaaatataagttataaaagttatagtatatagttacactatatttaaaggtatatttaaaagtttttgaaaaaaacttgtggcagtttttcttaagatagtctcatttagagattctcttgtagttggctggtgcaaaaatgcaaattctctatattagtatcacttggcactggacgagcccattatcaaatatatgctgaatatatttgactataataaatcccttggacttgcctgcccgtattcttttttcctaggcgggtagtttaaacaactactttcctttatttagaaagggtaaaacataattcatatttttagttttcctaaataagtggtttttatttgtaggcttcaataccatcaaaattttaaatgggggagggtaaattaaattttttgacccaaacccccaataggcccttttaatactcaatggggtggatgtatggcattttggaactttggcttccgggaaaacaggagttaattttcttttttaaccttggtaaccaaaaaaaaatgtggtaactttttttgtgaaaaaatgaggttttttaaatgaatttattccttttgtgtttccgggggggggtataaattaagggggggagaaagatttgcgccggcaccacacaggg

SEQ ID NO: 78190 - DNA, 1025 bp, Oryza sativa
  unsure (1)..(1025): unsure at all n locations
tggtccnnnntttagttcacatcttcaaatcattattttgtaacaaacaacataagaaatgccgaaaattattctcaattgacctaaaaaaatatctactagaactgctagcacacgtttgacaaacctcaatcagaagaaagaagacaacannnnnnnnnnnnnnnnnnnnnnnnnnnncnnncgnnnnnnnntnnnnttttttttttttttttttttntttttttntttttttttttttttttttttgtttttttttttttttttttttttttnttntttnntttttttttttttttttttttttttttttttnttttttttttttttnntgttnntttttntttttttttttttttttttttttttttttttttttttttcgtttttattttttttttttttttttttgtttttttttttttttttttgttttgttttggttgtgtttttttttttttgttgggggttggggtgggggtgtgtgttttttgtggngggggggggtttgnggtggngggggttgtgtttggggtgngngtggngntggttttggggtttgttttgttttttttgtttttgttgtttnttgttttttggtgtgggggcggntgggtgggnggcggcgnggggtgccgtgggcggggggtggnggctgcgcgcggnccgggtgttttttgtgttttgtgcgcgtggctggcgcgtttgggntgttttggttttgtttttttttcggggtgggtgtggggtgttgtttnctgtcggcttttttggcggnncggcgcgncgtgggntgttgnnctggttgtctgtcggcgcgccggtcgggcggcgtgggcggtcngcgcggcncggtcggctggccgtctgcccgcgccgcgcggtgcgcttgtcgnntttggttttgtttgtnnttgtggggcncggggtcggggtngcgcgtttttttgttttgctttnntttttggcnctgcggtggtgtgggcggnncgccggcgcncgggntgctggttgggggcgcgcgc

SEQ ID NO: 78191 - DNA, 18175 bp, Oryza sativa
  unsure (1)..(18175): unsure at all n locations
gtcttgtcaaaataagccctaaaggtgaaactctcgggtttaattgtcaaatatttcnaccgtgatccatgatgaatgtaagtanttgagtncatatcnattccaatccaganagttcatgcgtgaggnaagtatnttcgactttctttacaaattttagaggnacttntcaggctnccgtaatgtgtaaagattgcctnctatgtatnccaaggggatgacttacgtgcatcaaattancattgtccccaggactttaagcactgctatctttcttatgaatgacaagtactttgactgccaatctggttntcttgtcgtgtttgcaacatatgtgcaantcaggtccccacatcttgaatataatggatcacttgaatcttaggcttgtagcataagctattatttctgataccctgatcctgttgagatacttttaaataagatcgaagatggtcaaactcagtatctgttgtttcttatatgtttgcaaagaggccacttgcccatttgtcttttttttgtttttccttcttcctgccccttgctgttgactagtgccacaactgagccactatactgctaacacagggacgtacatactggacttagggcaacgcctgtaagtaaagattgagtcaagctgcataattgattagtgattatcttgaatctgtaatgtctaatgtgacacttcttgttgggcatgaattagcatgcatctatgctttaataaagaagaggtatttaattcccctcataatttgcaggttgtcaaggttgcagactttggagtagccagagttaaagaccagtcaggagttatgactgcagaaacaggaacctatagatggatggctcctgaggttaccttttgtcattttctttgaagaatctttgtgaattttcatttcattgcttgtagtttatcacaaatcggtgagctatatactgaacgcgaggactgcagaatcccttctgcaatctgcttgctcacactaccgagaggtttttgaacgttttggttcaagtggcaaagtcattgggggcttatcatatataattagattgaaagagcaatgactaacctactctgttctctggggtacttttatgctagcacataaccctaacctaagccttttgtgatcaatcccttcccactgctactttgcttgttgtacaacaagacagactcctataatgtgcttgaatatagcttgtttactgactgcaccatgtgttgctgttcgatgttgtgtttttaaggatagtagaatcaaatcctcatactatcagaagtacgaaaaattctaagagacttttgtgggtttgcacccctggaacttttaaaagagacttttgttagagtaactagtgcattgcctattgaaaagaaactagattggcagttcgcacataacctatgttcagaaatatatcattaattttgcaattgaaaatattatcataaagtagcaaatttataacttactgatatatatatatataacaatagaggtctgtgttgcatgttggagacttggaaaaagtttcttaagatattgggatgagaagtccgttaatttgatggcacatatatcttcttaaagctgtacatacatgtgtcatcttcattatgcagtttacattttgcctcttaatctcttatggagcaactccttgttattgttgttgtttttgagatatgttttaatagaaatcattgcaggtcatcgagcacttgccctacgatcagagagcagatgttttcagtttcgggatagttatttgggagctgctgactggaaaggttctgttacacatgccaagcggttatgtttagattctctgcacttgacatctgtgctgaacttttgcttttctgttttctgctacttttttctcagcttccttatgaagatatgacgcctcttcaagcagccgttgccgttgtccaaaaggtacgagataacaaaccttacttttgccatcttatagttctcccaagaaagaaactgtgctgagttgggacctggcaactaaatatgcactctgcaatacacgagtcactaattgctgtaagtttagagaagaggaatctggggattgaacagttgattcattgaaggcccaaaggaagcatatatacatatatatacacacacagtagatgagaaatgatccttgatattgcactttcatgtttgcaggatctgagacctatcattcctgctgatactcatcctatgcttgctggtctacttcagaaatgctggcagaaagatccagctctaagaccaactttttcagagattcttgatatactaaattctataaaggaggtttgtatatttgatgggatgtctataaaatttctcagttcgatttgtgttttcctttcatttgatttttttttcattttgtgcaatcagcaggctgttcgaagttctggacatcagaagagacactcaggtcgatcttattccaggcagagacgaagcggttgatgcagcaattttcctttttttttaaaaaaaaaatcttgtttcggtttagtttctgaaatgcggcaggttttgtttagcgttccacaccctcccttttgttatggtcatttccacggcgagcaatttttacttggttgtatctcagcggtaacgttggaatataatctggtgagtttcttgtatttttttttcatgtcgtgagctggtgtaaacgattgttgattataatcctttcagttcaaccacgagatgtcatgacttctttttttttaaaatcatccttttaactctctcaggtcttttgatgtgtgactttgaccataattttgtattaggataaatctgataagtttaagagataataatatttatcaaggcaagcctatagttttcttaaaaaaaagaggcaaacctatagcatttttacgtcttgaaattaagtattttattaaaagttattgatgattaaagtttcgaaggtttgtttccagaacgttaagaggagaggtcttatgaaccttcttttcgagaacgaaaccacgtatgtctaacaaatggcataccaaaaagggaaaagaaaaaaggtaggaagagtggctttttctgatggtacaaaaagtccaaatcgattcaagtgcctgtttcaaatttcaaattcaaatgctgcgtttgttcattcgtgaggtccatgctccacctgtttgtaatcttgtttaggaataagttgtcgtcccttaacttggtttgattgacatttctaatttcaaatatcagaaatcttcaactctaaactatacaaaatcgtacaattagagtcccatggtagtatagaccccatttcctcctatttttgtttacgtggcagatatctgagcccacatgtcaacatgctgagtcacccatgccgtttcaacgtgctctcgttggctgtttggcaggatgtcctcctacgcctgcagcgcgtccactgacatcgattgatagagacaccgacgctgtgatgatggtgtgcatgaactgcatctccctcagctcatcaaggtcaaatcaaatcattcacgtcgtaacgagcgggctagagccggattgcaccattcacgctgtaacgagagggctagtgctgggccgtcactctacctctagggccatcaccactacgctcaaggccatgccgccacatgcatccaagccgcctaagccggcgtgccattgttgcgccttgagggcaggccactgctacgcgttgggcccgcccagacgcgactgtgcctcaatgctatccgattctacgtgtcggggccaaccaaccgatgcgctgttgctccatctaaaggctgcaccgtggctcgaccatgaggctggggctgcccagccaccactccggcttgagatggcgaacttggcgctagcggtggagtcatcatcaacctctatgcaaacgctgctgccgtcaggagctagcaaacaggcaacgagagagctcactccgttgacacggcattggtgataacatgctgataagtgggcccaaatatctaccacgtaagtgaaaacaaggaaaaatatgatctatactgctatggacctaaggtgcatggttttatacagtttagggtatagacttctggtatttgggagtatggatgtcgatcaaactcgacataaagttgagagttggccggtggacttatccctcctgtttataccaccgtgttgttgtgacccatggtcagcccggcccaataaacacacgaaggcccaatagcccaaacaatctaaaaccctagaaatccaatatacaaaggtagtgtgctcctgcctccgcgtggtttccatccccgcgcgcgccgcccctctccgctgccggcctccgctcctcctccggcgccgtcgccgtcccatcggcctccgcttgccgcccgctccgcgctattcaccccggccggcaggtgagcatcggtttccctctccccgttttccccccatggtttgggtttctccgaggcaaggggaaccgcgtgcgtgtttgttcttgccgttcggagtcgccgttgatgccgccgcgagtatatagacataatcactgagatgcatgtaatgaagtatctggagcgagcgaatggataaaccctaatctctcccggctcctcctttgaaggagtgaagaaaaactagactgttattatcattcaattgtgactatcattttcttagcttcgtgctgcatgattgttttgattgacttatctgtatgtattgcattctgtggtgcctatcatttatgggattgtgctgattgatttatcaatcctgcagtgacaatggcaaggcttgcagctgaagacccattggttcgcgatgaagccatattggatgatgatgatgatgatgttgataccgacgaggaagagtccgagtcggaagatgattcaggggaggaattccatgccgagccttccaagaaagctgtctacaacaaggaggggatcctggagaagctcgaggacattgcgtggccggagaatgtggactggaggcacaagctcactatcgaacatgaccagggggagaaagtcgatgtgaacgacgatcttgctcgtgagcttgcgttctacacgcaggctttggatggtacgaggcaggcctttgagaagttgcagtctatgaaggtccggtttctcaggccggctgattactatgctgagatggttaagaccgacgctcacatgcacaagatcaaggggaggctcttgtctgagaagaagaagattgaggaggctgaggagaggaagaaggcgagagaggccaagaagagggcgaaggaggtgcatgcacagaaagaaaaggagagggccaagcagaagaaagaacagattgagtccgtcaagaagtggaggaagcagaggcagcaagggggctttgccaagggaaatgatgatgggccagatctgaattttgaaggtgacgaagggttcaagcaatcaaagaaaaagaggcctggtgtttctcctggtgataggtctggtggtcttgctaagaagggtaaacaaggaaagaacaggaaatcaagggattccaagtttgggcatggtggtcggaaagggctgaagaagcaaaacactgcggagacgacaaatgacttcagaggattcaaccagatggacaagtcacaaaacaagaggagaaaaatgggttgacgcgatattgtaagaatctgcgtctgcttccttgagctgtattactagttgtttttggtaactttattttactgcagtacatcgttgctagatgcgaacgttagttgagatagattgtaggaggcagttaaaacaaaagaccattttatgttttaactatgctgttctccacaagatatttgcatgtatctggtgatggccctttttcgttgtgtgatgtggaagaatcaatcttaccctggaattatcctaagagtgtcttaaggatgcttggtgcacttcctgttttgatatgttatctttctgaccgttattttatattgatgcaacaaaactgaaacgtaaacaacactttcctattgtgttgtaaatttgtttattggtgagtcaagtctccctctcttctatcttagattatactccaatcagcataactcatttggttaccttgtttctttccctgtagtttctagtgaatgatatcatttgtgagtttcctcactgcattagttgtgatggaatttcagaaagagcttgcttttgtactgcatttgattgtgatgcttccttgctcttcatggtggatgtgcatgtccatgtggagtggataccatttcccattaagatcgtgaatatggtagtagtacttttgcattatagctacagtgtccttttggtctttacctcgattagcttggaatgagctatactgatagtgatttgatgcatggaagcccatgcttatgttgcttctttgctggtgatggttgtctatgatttgaaagcaattgcctactacatgttacaacatatcctctgaaaatatctgctagtattatataacctcttgcagctgcactagtgcgttaagaagctgctactataattcttgtgatgtgtttttttcttgtatattatctgtccgatcatgttgatagaaatttttacgcgaactagcaaagtgcccatgctttgcttcgcagccgaacagaccttataggtaaaagaaaatatacaataatatgtcatagataaaaaatatttcttattagtattgcttgtttacttatttaaatacatggtatttatttgatttaaacaaatattagagtattgcataatatcaaaaaaaaaatattagggactaatttgtaaaaagtgctaagtagtggtggtggcaggaccatcaccgctagtggcttttatagtagtatagattatgaagtgggggaatgttttgatagtccttgaccgtacatttgaggtggaggaaatttctatcctatgtcatctcagtcatttatttgtttgtatccaagtctgtcacttatatgtgatgaagactagattgcatcatgcatgccatggcttgttattattatgatacagctacttctttggatgctttaaacctattttctcatgagtaaacctgtaagtgtttaaaagaaatgccagtatccactatccagtcatcgatcatctgttttaacagtgagtgaaactattttactaaccttaacggtgagtagttttgaagtcaggagataaggatgatatatgtggcgtatctgttatatattttccatcttgagtgtttgcttattcagtagagtgttttttcattagagtttgagtcgatgctcctggaatcatggttaattgttatcaagcattgggagggtgacttgcctaaagtcctatatgtagaattgggagtcaatttattattctagaggatgctttattctactctccattttaaatatacggtgtatttttgtttattaggagtaggacaggacttttaccaataattattttattagtaataatttttatgaagcaaaattgatgctattagatttgtctccaaaagtatttttgtatgaatatatatttatatcgcataaatgatattttaggggagtaattgttagtcaaattcttttcctaacaaaataagaacaacctatattttgaaatagagcgagtataattttggcgagtaatctggtggcactgtgcattagataacttgccacttgcctggatgcacacttggcaattattattttttggtcacgccaacttctttaaggatccgaccaaacaaaataattgagctccctgtgccttgtccacatagacttcaaatttttttctgacttttttcatcaagttccaacagtgcacctgatccattataatcttcttgatttatgagcaaggaaaagattgctattgttattgttatacatgctttctggcaagaactatgaagtgtgtttggttgcatatgttagacccatttgtcagttaatgctgggagaaattccctttgacagattcctttcacttcaagtcttcaacagtctacactctacagaactatgcgcaccggtaaggtatactctcaaataaattgtaggttgtaacgggacataatctaatacagcgaattcgaaccggtcaaaccaacctagattatgatgggacataatctaatctaatacaaaacgaatctgacagcctactattttgggaccaagagtataaatctgttccatatcaagaatcagttatagaacagtaatgctatgttgtgttccaggcgttttgctttgacatgcacgttcacataataaaactgaaactaatgaactggttctcgcatatattttcgttccacattgcgttattatactatatggttcaaagttctgtgccttggtctcgatcattctgtttggtttgattgtctattatgtatttcactgatatctgaaggtaactcaatgctgatacatctgcacaccgtcaatagtctagtattcgcatggaatttgttctatttctgatgatcaggtggggaagtttagattcttttgtttgaacaaaggaatataacttctgatgaactggcctatgcattaactaaaaatacacccaaccatttatatttgtatacgccaggatttatactttgatgaatagagtcatgcattcacgactataccatacttataccatatttatgaaggtctaagggtaattgatcacttgatccgattctatgtacgtagtacgatttatttggtacgagaaacagagtgagttcttctatattgccatttcattgatcaatgatacatacttgtaaaaagagagagaggtaaaggtatcgggaggtaccacacactttatagtgtaaaatttggtaagtgtgaaatttggtatctccagatacttaaaaaaaaatacgtaccttgagatcttttttaagggactataaaatttctctttaaaaaaagaagagggtcatccatcccaaaccccaaatttgagggataatttgtgatatggatgaactcatttaaataatataaatggtctaatccctaaagggaatcaacaagggtagctgtatttatccatcaaaaatgatgatgggatttgagaatcagagtagtcgaataaagccggtttgctaggcttttccagatggaccacgcgtacggttcgctttcttctacgccccctagcgttggcctaaccaaatcatgagtccattttcttcttctcgatcttcaagatccaggcaaagctgtcattgcaccttgctaattcgtacgttgaacatgtccttgcatgcacgtactctatctgatcgtaatattatgcatatacaaggtgactttgcagtggtgtttttgtgcgcgtgcacgtcctctatataattgatatttttaaatgtttataacaagatgtttgttcaattttttttaaaaaatatactataccattaataactgctcaaatatttagttaaaaacatatgtgagacttatgagattttaatttataaacttttataatacaaagttagtgatcaaatttcaaaagtctaattgaatctaaccctaaacataaaaagatgaccagaaggagaaaataatcatatatagtattttaggtccgaaaatttggttttccggaagtatctttaatcgggaacacatacctgtcttctttatgaaaagaactagcatattacccttgtgttgcaatgaatctattaccgcattattaccataattttgtacatatattacatcttaatttttacatatatttgttactaatatagactctttgcccatattatccttttcccttacaaaaaaaaagggagttgatgaagggggttgacatgcatgtgagccctgtagccccatagtacttttccttttcaacaaaagtaagaagttgatgggatggatggtggcatattcactactcgctactaccacactttttaagggaaaatttgaaccatgccacacaaattttgcaaaatttgtgatatgccaccctgacccatatgtcattgactcatgtgggtcctacatgtcattgagatacggaaatagatataaatgttttagaaaagcgtggagttaaaattctaatatgttactacaaacaataaacatacaacttaagggcccctttgaatcgcagggtagaaaaaacggaggaataggaaaacacaggattctgacaggaattgaagtgtaaaacagaggattgcaaaacacaggaaaaatacaggaatggtcgtttgattggagcgcaggaaaaacgcaggaatcggataagagagatagactcaaaggaaattttccaagaggttagagctcttgctaaatttcctccaaaatccacatgcaatgtgccattccataggaattttataggatttggaaagcttcaatcctttgaatcaaaggaccaaataggaaaatttcctataggatttgaatcctataaaattcctatataaattctttgattcaaaggggccctaaacatgttgggcgcaccagaacagaacatttgatggtttctgaatttccaccaaattcagacagatagtactgctgtcctgacaagttggagcttggaagcaaaaaacaaaaacaaaaaggagagaaaggggaaaaaatagatatgatacgaagaagaagaagaagaagaagaagaagaagaagagcagatgaaacaaatggccctaagcaatgcacgtcgccattagggagcgagcacatgctacccttgtgatggagtcgccatcgatcatattcataattttcctttccctctcccaagaacgatatatatcgatcaaggatcacgacaatgtgtcacctttcatgttccagctgccaattccgttagataacaatttgcaaattaatacagagtacctttcttccaaaaaaaaaaagattgtgacgctcctgactgatctccaagctcgatcgatcgatctctgcatacatatgcatgcccacacaaggaaaggggctaaggtatgggttcccaaatgcttgtcatgacggctaaaggtgtaggtgagcaacttaacttagcccctgctagggtttgaagcaggccttgattaatttgatattgatgtccatccatttgaatatggcacaatcgcattcacctttagggcatatatatgtacaatactacaacatgctctcttagatctagtatgatttaggatctaaaaatgcaggattaattggagtgtcatggcatgttgattactataggaattactgctttcaatggctcgaagaaaaaatacaagaattttagattatatattaatatatatatatatatatatagagagagagagagagagagttgcattagacttctcgaacgaaagaaaaacgccgaggttagatgacatgccataaatcttatggaattgaggtataggaatgcattccattggaatttgacaagtttaaatcccatcatccaaaagaccccaattggaaaaaaacataaggatcaaaggccttcatttttctatataaatcatgcatgtccaaaggagcattaagagagtatctcaaaacatctatgcaagagtctaatcctctaatactccacctgttcctaaatacttgacaccaaatattatttatatttaaaatctgactattagtatatttggaaaaaaacatacttaataatttatggatgcccattctccaaaaagatcttctatgtatgataatttcaaacaacatctaggggcatgctatcgtgttttggagtactgacaagcttttacggaacacatcactaaggaggtgtcctggcgtagtgatagtcgtgtttgctaggtacgtgcaacaaattataatgtaccaaaatacatgcttggtacaaagtatatatcactatcgttctataaaatggagcaacaatgtgactattaatgtaccccacatccatctacactttgattacaagaattaccacgatatagtcccaagttggatatgtcgatgtagtgatacatatgtgccctgttttgtcccaacatagttcctctcctgaatggtgaaggtgggcccggcacaggcagaagctaacgacaatgttcaattacaaatctgaaaggaaagccacaccaacaacaatcttaaagggtatctcactctcaccacattcctagctgagccccataagtctctctctctctacccatcatgcatccatttcagaaaaaaagaaaagaagaggaggaaatatgatccacttaggatagtgacattctacagaaaattcgccttaaataatgtacatatatgggaagcaggtcatatatattgatatatatgtgtggatgatgttgataaactatagactagcttgggctttgattttgggttagtttgttggtcagtcagagtaggcagctcccatgtgctctgctccaggatgaaggcaatgtatcacctgaaatcttgctagctagctatagttgacatctgcacgcatatcctccttacgaaaatacaaattaataatgatatattattgttataatgcatatcttgatcttaggtttatatatgtacatgcgtattaatatctacaagcttgtttgatacggctttagctcataaagttaactccaggaacagagtttagagtgaagcaggccaaaccgtattcaccagttcattctgattctggctggaatacgtagccaaatataccattccatcacaaaaaatgacatagagaatgttgacgtatccattccagccccaggtttctttagaagacaccaatagagaaaaaaaaatcataaaacttagttgcattctctgtaaaattcctcaaaaggtctaaatattgtctgctacgtaccgaatattaaagccatcttacatatgtagataccaggtaaattataggttataccttttatatatgattccatttatcgaatattattaaatgtaatgcatttttgaagtaatgcatccatttcaaaataaaagaagctttaggctttgacacggatattaattaaaatactaggtggaactaaataggagaggattgtgactggttgagaagaaaaaatagatgaagaatttgaataggggaatattgtgattagttgagaaaagaatgtagccggataagttattatattttggaaaatgctaaaagttagtataggacgtagagagtacatataaatgtcatacttattattaatatatcgactgcaacagtaagcctagctagccaaacctaaatgatgtctggaatgggatcgacaagtaatcatatatatgtatatggtccatggttcatctgccagatggttggaccttaattgcatattcattaaacttactaagtatgtttctacaatataataatgataaagctgagaactataaagctgagagatacttatcagaaaatgattgaaatactaaaatttcacaatctagtacagctggagataaactgtacttgttagtgctactagctagtagcttagccaacaaagagaaatacaactaatattccctccaaatcaatcaattaaggcctcatttccatttgcactgtctcatcttataaacacaaaagaaggaaatgtgccacacatattacagagatcatacattgcaaacataattacacactgatgatattacaaagtacgtactcacatctagaaaattcaaagccggatataaagctaattaagaagatatgttacatcatggcagccagtacatgccctcctgaaaacatgcaacattacgcatgtaacgtgcacatacaggcacgcgttaaactcaccaggagggcatacaaaaaaattaatgaacatcgatcaatagcaacaaatcaaacatcaccaattctcccaagaatcaagtcatgcatggatcaccaatccgaacacaaatacctagattaattagatcatcaatgatcagcttcattctcctccatctccaaaaggatcatcaatccatcatcagagagagagagagagagagagagagagttcagactttcagagctatatatatgtgtactaccaaatcttggtcctgccgccggcgcggccgccggagccggacggcggcgagcacttgttcttgccggaggcggagcggaaggcggcgaggatctggtggaggcggtcggcggagcaagggagcacgatggggcggccgccgggggagccgaactcctcctccgccgtgctgaggagctcccggaaggtgtcgctggcgaggcaggcgatggggacgaagaaccggctgccgtcccgggtgtacgccgcgaagtgcccccgcgggcacgccgccgccgccgccgtcggcgacgtcaccttgctcgaccctgacccgctccacttcctggagatctcggctagcctcagtgagctcaccatgatcgatcgatatatatatatagaaatgacagagaaattgttgctaagctaagctaagcttcttggagcttggagaagctaagcttggagtagcttgtggctggtgatgtgtgtgagagagcagtggagctcaaggggggtataaatagaggagagaagctagctatggtctatggtgtgtgtggggctaggttgctaggtatgtggggttgttgcatttgcatggagaggatagggatggatatagctatatggagagagagagagagagagagagagagagagagagagagtactagcttagctacagggtgaaatgaaatgaagatgaaagaagaagaagaagaggaatgcattgatcattgctaattaagttgccagtatatctgtattttgcatgttaggatgtgtaggccagtcaagtgggtcctgctcatgtcaatcatgcatgagagttgagaggagtggtgctcgtctgctgttgtcccaaaataaaacaatgttgatcctatacctaaaaagattgccttttatttcccccctgtggttcgtaaagagaaactggttttgcttcgtactgcacatgtgatctaagttatatatatttaaattcgtgcaaatttttatgtggatatcgtgacttagtgggtttagctacagagcacagcgaaatgcctctggccccgcttgtcagattcttccttgtagaggcagtggtgcatccattgcgtgacaatgacctccccatggtacacagccaaggagtgtggcggcattagccacacgcccaatcttcgcggtgaagtcggtgaggaagtggtcatacggatgagcgcgggttgttggggagggaagccaggatgtggaagaagcataccactttcagccgacacatggtgtccaggtcagggcagagcactagggaagtaagccccctccttatactgcactagagatacatcgattatgcactatggtgagcggacggagccccattgttgatagatagactagacatgatgtcacaacgcatccctcaggtgatgacccaataaaggacgcaaattcagtgatcttcggtaacagggccctcgcttttgacacctcgtccatggcccacagccttggcacatataatcaacagattagccgcacccccatgtgtctatcgccaggtcctgctcctcctccgctgccactacacaccacaacataaatgtatagaagcacttagtttgttggaagaaacaattgttagcagtgaattggtgaaatattttacctacttttgccactagaaaattttcacctcacgtactttttttatgctttccgtcggttggtcctgctcatatggtatcaattttgactgacgcctcttaatataccgacaagcagtgagtgcttaccggcatatagtatgccatgttttttttgagaaaattcgatccatagcacagaaaaaaaaatgcagtaccaaaaaatagcacaagaagtttccgctttcgattcatagcacagaccaccggtttttcttcgtcccgtagcacttccgtcgcattttgaagtaacggtgttagattggagtggagaaatttttcatcggactcatttgcccttcgtctcatctccaacgacggccgctcaacacaaccgtccgcctcttcatgctgtccggcccaggcatcagcgtcgacgacggccgcggccgtggcaggttgtcgctgatgctgtacttccacggcggccacaggtggggaaaggaagcgacccatcggtggctccccccatccgcaagagctccagcatggggaacctttccctcatatcctcttctccgccgccgaatctaaaggccaagaatgatgttcagttcctattagaagaattgagcaattctctgttaaagaaactgacctgagctcggcaatgcaaatcaatggtgtccttggagttcggaatttaatttttgcaaatcattgattaagcagtacacaacaaactagttcatcaagagttactagccaccaccgccgagcaagccgtgacattgattccgctggctgccgagcaagccgccgccgagtatcctgccagccgctgccgttgtcgccattttcgccccgtcccatgcgccgcctagccggctgctctcacgacagaacaatgatgaacaggcaatggtccagcccaaagtcatgtgtgaatacgggaggactaagggcaaatttgtcattttttattcctgctcacgaccaaacgcttaaccctcacggcagatctgacggaaataccatggatcgaaaaaaaacaagtgtgttgtgctaccagttgaaagtgaaatttttttttactattttttggtaccagcttaacttatgtgctatagatcgaattttctcatgtttttttgccgccagatagtctgacgaagcattatttttttaggaaaatgtctgaattacgccctgaactattattgtggtagtacggatcccctcaattcaaaaagcaaatattctttactcttaactttttataccggacgaattacccccttgatagactctagagcggttttggttttacgtagcgcacaccttggtggttttcatgctatcaaaacaagttttctacaagtttatgtactgaattatacccatataatttacgctttttcggatgtctaacgggtttgcagcaactaccgaattgaaataagtcaaccctgcagtctctcctctccctcaaatgacaaatgaaacgatacccatttaatcaatttctttggacaacttatttcatacctcattttcattgaaaccaaatctatacatgcatatgtactcctacatgttacaccaaccatgacgcatacctgtaacctgcttccacgggtagagaaacaatctttagtcggttgacccaaatccacaatagtcccggttccattaaaaaccgggactaaaaatgattttttagtcccagttaataagaggaaaatctttagtcctggttgttgttacgaaccgggactaaaaatcatctttagtcccggttggtaactctaaccgggactaaagttcataccaaccgggactaaagatcatttttagtcccggttgattccatgtcaggccgtgtcagggccctaggatctttagtcccggttaataacaccaaccggaactaaaaataggtttttagtcccggttttcctctctaacttcttatctctttccttatctctaactcccctcctctccctccttttcttcctttttttccttcaccccacagcaccctcgtctccttccttttttcccgaagaagcgtgcaggctgccggcgccgcggcggaggctcggggggcggcgcacaggctgcggcgcggggggccacgcggaggcggcctgcgcggccgcttgggtgggtggcccgcgcggcggcgcttggggcccggcggcggcggcctgcgcggcggctcggggggccaccccgcggcggccgcgcggangggaggaagggagaccgcaatgaccgcccggcccgattttttttagatgggaatctgggattaatttttgctgaaagtgaatctgtgatgaatttttagaactatgtgatgaaattttttaagagtttgtgatgatttgc

SEQ ID NO: 78192 - DNA, 4664 bp, Oryza sativa
  unsure (1)..(4664): unsure at all n locations
cagcttgaccgctgtctagctatatgatggacctattggatttataaaatttagtgaggtccacggcaatggcagagcttgacttaaaaaagattaattaaggaagcaagacatatatcactaaactacacaaatacatatattgaaggagcaatttgagaattgagagcttaatcaatgctaaaataactaataatcactaaactacttaatagggactgtttaataactaatgatccactttaatctacatgatgtttcactcctgtccatagatttatagttggtctccacctgttgaaacatgtgttgaaaacacacttatcggggaaaaaaaattatgatggttttatgcacggtagtaatgtggttgcatgaatgttggtgcgtgggatattaattttctcggcataattcatccatgttggttactagaaataaactctctccgttcaaaaataattataattttaatatttaaattttatccataaagaatgcatctttcccttcaaccgcctttattcaaaagttctcatcatcttatccctaaccagcatccgctctcccaatcatcaatcgtttaatgaggacatacaagtcatttttttatactaacctttttcaatactacctccgttttttaatagttttttaatagatgacgccgttgactttttatcacacgtttgaccattcgtcttattcaaaaaatttacgtgattataatttattttattgtgaggttttttatcactcaaagtactttaagcatgatttatatctatacatttacataattttttttaataagacgaatgatcaaacatatgttcaaaaatcaacggcgtcatctattaaaaaacggagcggagcgagtatattacaaatgtaatttttatactgagggagtatgatcctaaatccacaaataatatagagtatataataatatatcttcggtccaagtggccacagaggcagcaacaaggccagcggccaggagaagcagagtctgcaactctgcatgtgtggcttgcttgctactccacggatttgaaatatctgaaaatattccatgaaaagtacaaatgatgagaatacgactcccgcgcggtgtaatttaccaggttaaaaaatgccaccttaattacaatgttccaaacttttggtgctacaaaatgatcgtccttttttcttcagataaaaaggattttaaattagacttaccacgaaaaaaagtaccctagagatgtaccctctttatattattatcaatttagcattgaggtggatagtgataatcttattttgtggaataacttttagatattgtggggtttgtcaagtgtttttttaataaatgttgcgaatgataatgttagccattataaaaatatgaaacagttaggagagacatgataattgcataaaatatttatctaaccttaatttgatatgtgattaaactataaagattatataatcttttacaatactaaaaaaaaagaacaacacaatataactttacttcaaacgggaccttagtgtgatagcaaacaataagactatagggtggtcactacgggtgtctcgtaaagaataactgacatatcttggattgaccaagtgaatggaagaaaccacgaaacctttcaacaaaagaagctttcgccgagcagcttgctgacaaaaatcaacggggaggccaagacatgggccttagtgggcgtgagacagctgagatggcttataccttaactaactcggaccaaaggtcttgagttttgccttttctttttatactgtacagtttactccttccctattctatgaaattggcgactcaccgattcgctaaaaaaaaaccacggacatcttatgatcaatggatacgacgtccactgctaaaaagatatagtacttgaatccatgtgtgaacaaattttatcacataagaaacctaaccagttaaagtatgatcattccataacaatttaacactataacatgacatatatatatataacaaccataaactacttcctccatttcacaatataattcattctaacatttcccatattcatattgatgttaatgtataaatgtgaaaaatgttagaatgacttacattgtgaaacggagggagtaagtattaatgtgaaagctcccttgcatgtgattcggtttcacatcacagctagctacatatattcctatttgcgaattgaatggttacaatttttaggatggaggagtgtgcactggccaccacacacccttacacgtacgcatgttagctagcgtatcgtgatcgacagtgaaacgcagagccacatacatacatatggagacaattccacagccactactactggtatacagggcaaatccaaatccatggtatacgtactgcacgcgtatatacgtacaagagagaatgatgtatagtaaggctgcgtttgtttgtgtgatatagggtgagaaagcatctcgtttttcatgtacacgctttctaaactactaaacggtatgttttttgcaaaaattttctatagtaaagttactttaaaaagtcatattaatctatttttaaaatttaaaatatttaatactcaattaatcatgcgctaatgattcacctcgttttacgtatcttcccaatctctctaatctccttcttctcaaacacaccctaaatcgctgagaggcggatacgtacgtacgagagtgcagtactagatagcacgaattgtgcgtacgaaattgaagtggctgatctatctgatgatcccctggccggatagagaccggccggcagcagccaatgcgacccatggagcccatatgggtacgatcagcagcacaatccatcatggcgatccagtactgtcaggtaggcagtcccagctagtgtcatctgggcactccatgtgtgcctgcctacatggacatcacaagtgtcaatggtggtggtccacgtcatcaagcctggcaaatcttgttttcatggatagctacctttgtaaaaagattatatatatttacatgacatgtatgagatttgctccagtaaaaaaaaaagtaccttgatgtaccggtacctcacggtacgtatcaaattgtgtaagatccaacgatcaaaaacgatttggtaccgtgaggtaccgatacctcgagatactttttgttggaccagagcaaatctcatagtacaaacatatgcgctcatatcactggtggagaaaccatttttggtcggtcggccgaaattcacaatagtcccgattccactaaaaaccggaactaaagatgatctttagtcccgattggtggctacaatggtcatatttgatctttagtcccggttggtaacaccaaccgggactcccggttctagacctgtcagaccttgtcaagccccctgggatctttactcccggttggtgttaccaagcgagactaaagatcctaactttactcccggttggtgttatcaaccgggactagagatctagaagatttttagtcccgcttggtattaaaattcaacgcttaatatataatccttcttccctatcctctcctccacaaccgcctcgcacttatcctctagaagatttttagtcccggttggtattaaaattcaacgcttaatatataatccttcttccctatcctctcctccacaaccgcctcgcacttatcctctcagatctcgatctccctctcctccctctcagatcgatctccttctcctcctccccctccgcctcctccccttccttctcccatccctggccctctcctccccgtcctcccttcccatccgcttagatcgatctccctctcctcctcccctcctcttctcagatcgatctctctcctcctccccctccgcctcctccccttccccacccatccccggccctcttccttcccctcttcctttccacgcaggccttttcttccccttcttccttcccacccaagaagcgggcggctaggccccgcaccggcccaatggcgaaccgcggcaggccgcaaccgctaccggcattttttttttttttacaatttgtgattcactaagatgtttaattttatgatttggtgcatgacctgagatgtataatctgtgatgtatttggtttgtgtgtaatttttttaagatttgggatgctattgatttgtgtgtataagcaacttaagatttgtaatgtgaatgttttgggatgttactttgatttgaggtttgaattgggatatgtatcccacttgatttgggagaaaattaaggattaaactcttgctaaaaaacaatgaaaaaaaaagaactaatgggactgccgctaccctctctttagagcccgttgtnnnnnnnnnnnnnnaanntntaancantttttttntnntaacaatatantaataaaactttatttaaaaaacattttaataacaaatatttttctnacccatcattatccccttttttacccccccatacatacctcttcctaatctaacacaccttccactattaaatcatcctnctctactcccaccccataaaactttctcctcccttaataccatttnctccaccatctttctcatctccccccccctaatccatatttcatatccccccctcttcctcc

SEQ ID NO: 78193 - DNA, 3533 bp, Oryza sativa
tataaatggtttctcctccggtatacatcttaaccatcgtgtctcttgtttttattgctacctatttattatatgatagtcgagaaatatatatagggtacatttcctgacatgtgcatacaggagcatataagttatatatatactgcctccttttcctttttaaatgtatgacgtcattaatttttctcacaacgtttgaccatttatattattcaagaatttaatataagtatataaaagtataagttaagattatattttatttgataataaattaagccataacaaaataaataatacttatatatatttttaataaaacgaatgttcaaacgttatcaaaaagctagcagtatcatacattttgaaatggagggagcataatgttgtaatagttacttagttgtatgcaggggtggagttggaatgaaatagaggggagtgcctctcatttgttttactttgctttattccgagtttatgcaattatgggtgtccgagtttagattaaggagggtgcaaatgtggtaaaaatagataaactatgactaaaaagctttccgaattctttttcgaaaaatcacctctcctatatagctcggtcgtttctaattctatgtgcgtgtacgttatccatataatcgaaaaaaaaagaatgattctatggataaatgtgcatggataacctaataggataatctcttggccaggcagaagaaaaccagagcattgcatcctgtagaggcagaggctgtaagttactgcttcatccgtttcacaatataagttattttaacatttctcacatttatattgttgtctaatccttcatttcacaatgtaagtcattctaacatttttcatatttatattattgttaatgaatctagataacaatataaatatgggaaatgatagaacgacttacaccgtgaaacggagaaagtagtaaccaaccagaggggtagtgattgtgcggcggtggggcgtggaaggacgaatggatggatggctccggtggcgcagggcgtctttctcgacggatcgcatgggcgcggccatgggcgtttgccccctccgccggcgtgcagcggcagcggcatgtgcgcgcgcgcgcgccatcggcagccactcgttgctgcgccggggccatgtggcacccgcgtgggcatgggccctgtttccatctcgtggccggcccgcttgctctgctccggccctccgcccagccagccatccagatctctctctcccgcactcggcgcgcggcaggcaggggccccgttgccgtacgtacgaaccccctggatcgcgtggacgagggcttaattagcgtctccatcgctcactcgcatcgcaggcgtgtcttgtgttacaaggagtgaaaatgggtcatgaaatacgaggatacggatatgtgatataaggatataatatttttctaagaaacaaagatacgtggatacgtctatatataaaataagaataatatataataatatacatagaaaattaaatgtgtagaatagtagaaaactagacttgtttggcatacatcatgttcaactcagccagaacgagtagattgctactctctccgtattttaatgtatgacgccgttgacttttcgaccaacgtttaaccattcgttttattcaaaaattttgtgcaaatataaaaatatttatgtcatacttaaagaacatttgatgatgaatcaagtcacaataaaataaataaaaattatataatttttttaaataagacgaatggtcaaacattggacaaaaagtcgacgacgtcatacattaaaatatggagatagtactgtacaagataagtttggttgtttcttgcatctactgatacagaagtggaatcttcagttcgctgaagaaaatcagcaatctagcacaaccatgaaacactcaaagctatctcctccaattcaccccccccccccccctcgcgcgcattagaagccacactagcactaagaaggctagatgcctagatgcattacaactcaagcttccatcaaaatcaatcgcatctaactaaatatggatggcacttgtagtctctttgttcttaaaaaaaaatagcaaaaggaacatattgaagataaggctatgtttagttccacgtcaaaattggaagtttgaagaaattgaaataatgtgatagaaaagtcgaaagtttatgtgtgtagaaaagttcgatgtgatggaaaaattggagtctaaacagggcctaagcctggattggaagggaccaagtactaggtagcgcgggctatgcctggttcggagctgtggcaaccggcagccagcgatcaggcgacgcccctgcgtcagacggcggcgctaccggcggacggcggaggcactgcgacatacggttgcacagcataatgcccgtagacagtgaagacgctgcggcatacagcggcgcagcaacgcccgcggatagcggaggcgctgctgcatacgacggcgctgcgatgccccgcgggcggcggatgctcttccctcggtgtccagcatcatcgttactgcacttcgtgagatggttgtggccgcgtcgaggccagggggaatggcggtggcgcatcggacgtatcgagagcgtatccttaattattttgtttatttgaaaatggtgttaatcggagatacgtgtgggatacatatcaaagcgtatccgatataaatccgtatccgaggatgtatctgatacggacacgtgaggtgtttgccgtatctgtggaatgtaggttatggaaattcccaatcaacctagtgacgtccgtatgagggataccatttctggtggttatcatttttggctgtaaataaattttgttttttctttaatttatttctgcattgtattaatgttgagactaagtagtttaaatgataaatatggtcaattaccggtcgatcgagcgatatttcagaagagatgctactaattccgactgttttctcccctaattgtgtacagggtgagctcctgattatcccgtattgttaccgtcaactcgttatatgtctacttcaagggatgaaaacggtgcaggaattcttttttacgttccgatggtgttttcggaaaaaataatagtagatgatattattttcaatcactataaataacaactttttaatattcccttatttttacaaatgggctataaagagagccatctgtcaaaatgtacaaatatacaagaaatgttcaatcgaggcccttcataggtagacctgtcaagaagcctgtttacaaaaataagctattttcacatatggtggtttttcttgtccgcctcgaccacatcggtcgtaatcgttggtacctctcattttttttctctcctcgtctcccccacctctactttttcctctcctgcttcccactactctctcccattctaggccgccctccctgaccaactctctcgcctcgatctctctagtcttctttccctttcctatccccactcaatcgcctctccaaatccctc

SEQ ID NO: 78194 - DNA, 6428 bp, Oryza sativa
tctaaccccttatgttataattcccttgtactcccttgcatttattttgcatttgtgggtgtgtcttgttgagtacggtggttgtactcagtcttgcttaattttcccaagcccagatgaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcatttatcgtcaaaatctgatcttttaaaatgttgcttttcttttgtttttgtttgtagatggccggcagcgttacccgtcgtggtttggacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcctgagtggacttcgctggcagtcactgcgggtggagattccttccccgccgcttgccagaacgccgctctcctcgccatcggcactcttcaccagcgctacccggacgagttgcagcactcgccctaccgctaccacccccgtcgcggaggagccagcgaccacgccaccttccgagacgccagctcggaggatgacgctaccgtcgtgcatctggcacgcatggtggaggcgtacgacgcggctcgtatcgacttccatcagatggtgcgtcgtggcatggtggagaacaacctgaagatcctggagctgcgccaagagaatctgcagctcaagaaggacctcgacgcgttggaggcgcagctgcatcagctcaaggtcgcccagggagagatctgccgccccaagcgtcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcctgcgcgtgtgtttttcttcgttttttttcttgagttgtgtggggcatggttacaccggtgtgtggtgtaactatgtcggagcctgtcttattttgtttgcctaagcaacttgaaccttaatgaaccaatttaatagcagtgataaatttaagaataatggtagtcgtgggtggttagttttaatcgtcagctctccttctctgtttgctggttctgtgtggggttttcagatggtgtcgaccaggagaaatgttaacaccggagaaggcaaccaacccgaaggcagcaaccccaacccccaaggcaacccacctccaccaccaccaccaccagacaccaacgccattctcacccaaatcctcgcccagcaagccaacatgatgaatgctttcctccaccacctccaaaatctgccacagcagaatgctcccccaccacctccccaacactccaaactcgccgaattcctccgcatccgtccacccaccttctctagctccaacaaccctgtggatgcgttggattggttgcatgccgtggggaagaagctagacacggtgcagtgcagcgacgaagagaaagtcatcttcgccgcccaccagctgcaggggcccgcatctctatggtgggaccacttccaggctacgcagccagaggggcaaccgattacttgggctcgcttcaccgccgctttccgaagaacccatgtgcccgctggagtcgtggctcttaagaaaagggaattccgggagttgaagcaaggcaaccgctccgtgatggagtatttgcatgagttcaacaatctagcccgttatgccccggaggatgtgcgggaagatgaggagaagcaagagaagttcttggcaggaatggaccctgagctgtctgttcgtctagtctctggggactacccggattttcaacggctggtggacaagagcatccgcttggaagccaagcacaaggaactggagtcgcacaagcgccgcttggcgaatttccgcaatcagcagggtgctaaccagagggtccgctacaccaatccctacccagggggatcctcctcgcaacagcagcagcagcagcaacctcgctccgcgccccgacctcaattcgtggtgcgcgtcccacagcagcaacagcagcagaatcagcaagggactcgtgcgccacgtcctcctacgccaactgtgcagcctgttcaaggtcgcagggacgctcaaggtcagcagcgtctgtgcttcaactgtttcgagcctgggcactttgcggataaatgcccaaagccaaggcgtcagcaaggccaagcgcctccccgctccaacaacggtggcaaggacgtcatccgtggtcgcgtgaatcacgtgacggccgaggacgtgctgacaactccagacgtcatcgttggtacgttcctcgttcattccatccctgctacaattttgttcgactctggagcctcccactcgtttatatctgtgccattcgtggggaaaaatcagttgggggtagaaaggcttagaaaccctctgctcatcaccacccctggaggggttatgacagcaaagtattatagccctgccgttcctatagaaattcagggaattccttttccctcggatctgattctgttagacacaaagaacttggatgtgattcttgggatgaattggttggcacaattccaaggagtagtggattgcgcgaggcgcactgtcactctgtaccgaggaccggaacagccggttgttttctttgcacctccaacctctgtcagaagttcagaactgcatcaggtaggtctgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgagctagccgaagttaagaaacagttggaagaattgaaagaaaaggggtatatacgtccgagtacttccccatggggtgctcctgtgatttttgtagagaagaaagacaaaacgaaaaggatgtgcgttgactacagagctctcaatgaagtcaccatcaaaaacaagtaccctcttccccggatcgatgatctgttcgatcagcttaaaggtgccaccgtattctccaagattgatcttcgttccggatatcaccaactacgtattcgtgaagaagatattccgaagaccgcattcactacgcgatatggactgtatgaattcacggtgatgtcgttcggtttgaccaatgctcctgccttcttcatgaacttaatgaataaagtgttcatggaatacttggacaagtttgttgtggtttttatcgatgacattctgatatactcacaatcagaagaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggatcccgaaacagtgaccgccgtcaccgattggaagcaacccaagacagtcactcagattcgcagtttcttgggtttggcaggatactatcggagattcatcgagaacttctccaaaatcgctcgacccatgacacagttgttgaagaaagaagagaagttcgtgtggagcccgcaatgcgagaaggcgttccaaactctcaaagaaaagctggtttcctcgccagtgttaatcttgccggatactcgcaaggatttcatggtgtactgtgatgcttcgcgccaaggattggggtgcgtgctcatgcaggacggtcatgtggtagcctatgcttcacgccagctacgacctcatgaaggcaactaccctacacatgacttggagttagcagcggtggttcatgctctaaaaatctggcggcactatctcattgggaaccgctgtgaaatatatactgatcacaagagcttgaaatacatcttcactcagtcagatctgaaccttcggcaaaggagatggttagaactcatcaaggattatgatgtgggaatacactatcatcctggtaaggccaacgtggttgccgacgctctaagtcgaaagagccattgcaacactctcaacgtccgaggcattccgcccgagcttaatcaacagatggaagccctgaacctaagcatagttggtcgcggattcttggccgcgttagaagcaaagcccaccttgctcgatcaaatccgcgaggctcagaagaatgatccggacatgcatggactcctcaagaatatgaaacaaggtaaagccgctggtttcacagaggatgaacacggaactctatggaacggaaagcgggtatgcgttccagatagcagagaacttaaacagctgatacttcgggaagctcacgaaagtccttattccattcacccgggcagtaccaagatgtacttagacttgaaggagaaatactggtgggtcagcatgaagcgggaaatcgcagagtttgtggctctatgtgatgtgtgccagcgtgtcaaggcagaacaccagcgaccggccggactcctccaacctctccaagtgccagaatggaaatgggatgaaattgggatggatttcatcaccggacttccaaaaacccaaggtggatatgattctatatgggtaatagtggatcgattaaccaaggtggctcgattcattcctgtgaagaccacctatggagggaataaactagcggagctctacttcgctaggatcgtgagtctccacggtgttcccaagaaaatcgtgtctgataggggaagccaattcacctctcacttttggaagaagctccaagaagagctgggtactcgattgaatttcagcaccgcatatcacccgcagacagatggacagaccgagcgtctgaatcagattctagaagatatgctccgcgcatgtgtcctagatttcgggaagacttgggataagagtctcccctatgccgagttctcctacaataacagctatcaagccagcatacaaatggcaccttatgaagcgttgtacgggcgcaaatgccggacaccgctattgtgggaccaagttggagaaagccaagtgttcgggactgacatcctaagagaagccgaagctaaagtcagaatcattcgggaaaatctaaaggtggcacagtcccggcagaaaagttatgcagataaccgtcgccgtgatctggaattcgcagtggatgattttgtgtatcttcgggtcacgccattgcgaggtgtgcacaggtttcagacaaaagggaagctcgcacctcggtatgtgggtcccttccgtatcactgctcgacgcggagaagttgcttaccagctggagttgcccgcctccttgggcaacgtgcatgatgtgttccatgtgtcgcaactcaagaaatgtcttcgagtgccatccgagcaggccgactcagagcaaattgaagttcgcgaagacttgacctatgtggagaggccagtgaaaatcctggacaccatggagcgcaggaccaggaaccgggtaatccgtttttgcaaggttcagtggagcaaccacgccgaagaagaagctacttgggagcgcgaagacgagctgaaggcagcccatcccggtctcttcgccagttcttccgaatctcggggtcgagattccgtttaaggggggtaggtttgtcgcgtcccaaatcgactctaaaatctatcctcaaaattgtgcaaaagaataagtaaaattcaatgtgaaagcctccaacaattaaaatgtgcaaagataaaagtcaaatgaggcttggaggatttttgtatatttcctaaaagcctaaaatgcttaaataaattttagtggaattttcagagcacaaataatagttgaaaagaaataaacaaagttaaaaaggtttataaaaagaaaaaccctaaaagaaatctgtgtccccccccccttttcctcttgggccgggtcggcc

SEQ ID NO: 78195 - DNA, 5560 bp, Oryza sativa
cccgcaataaatgcggttaggtgagccccgctgtgctcacctaacccatatacgtggcggcaaacccacagggggtcggggcgccccggccctcggggtcgaaacgggagcagtccgacccctcggggagacaaagggaggtgtggccacatcaccctcgggcccgacccccccccccccgagggggtcaggccacgtgggtgatcgcggctgcccaagcctctagtcatgatactcccggtcccatgtcaccgacaaaataatacttaattaagcacgcattaatctactgcttggtttaacgtgcccgtaggaagggtttctagcccttcccaccgaatacagccttataacataagcttgcatgcaactataatataatccatatataactttcatgtaactaatacaaaaacaacacttgcacagtggtagcacatgcgaatgagcgctcatcgccggtctaaatgttcaacccctgactctttctttctttttctttgtatatatctttccctttttaacatattaccacagtaggagcctatcttgttatttcccataaaagaaaggaattttactgtagcacccgttccgtcgtggcgcttagcgggaaaactatctcttaaaaaccctagttgcgaaatctgtttctttgcttgttgtctagtgtccgtgccatctcagacctcaaatccccaatctattgtcgagttcaatcccgaatccaaatccttcccaaatcaaatccctccgcaaaagtctattttacctccctcgggttcgatgggccgaatccctctcggcccatctccccctccctccccggctctctctctctctctctctccccgctcttccgtgagccgcgccgagccctccctcccgctctcgctgccattcccgccgatgccgcccaaatcgccgcgccgcccgcgcgtgcgcgcgcgccgtggtggccgaccggccagtcgccgccgccgtcaacgcctgccgcgcctgccccgcgtctgtcgcccgtgttgccgctccactccaaaccggtccgccgtcatcgccgtcgtcatcgacccggccccgccaccgccgcgcgctggcttccaagggacggaggctgagccccgcccccctctgctgcatcgctccctctccctcctccttttccccaaagtggcaaggaggcaagcccaatttctctccccctttttcccttttccctcccgccggcgtcatcctcccctccctgtcgccgctttggccgcgaccgtcgagcgctagctccctcccttgaccgtcctaggtcggtttccaaaccaacatcgccgccctataaacccaggcgccctcccttccttttcccctcccaatcttccccgtttttcgcccgcgccattgtcgtcccctctgtctcgccgatcgccgatcgccgaccgccaccgtcacgtgtgccgaaggagtcggtgcacgttaggacgcggaaggggactccggacgcaccctctccttcctcttccccggcccgaggccggagagatcgctcccgtgccgtcggcccatcgtcgctgcgccccgtccgcacggtagtgcatctccccgttctccctcctcaatccatctcttccccttagttttcggtagtagcatgtatagcctccccgtagctagccggcgccgccccgactgctgccgtcgctcgccgtgtgctcgccgccgtcgccgcccgagctcggaagcgcctctcgttgccggcctccctcgatgcgattcctcctaatccggcgtaaggggtggattcccgtagccgtgtggatgctctcgccgccgggaatcggcccctcgtgacctcatcgccgttttccccttctcccgccgccgattgccgccaccgcaatccgccgccgtcgagcaccctcggtgaatctgagtcgttggctcgtctcccctcgtcctgtgcaacgtcccggtgtactcgccttcgcctgtatcgccatggttcgctccgccgcaccgcgtcctccgcgaaccgcacgcatgcgccgcgcctccctccccaaaccctagcacgccccgcgtgcacctcgctcacggtgagccgagtcgccgacaagcgggtcccacctgggaccacgcgggatggacctggcccaccggctctctctctcccctccccgcccgcgcgcgcgccttgggccgccttcttggcccggccggcccattaagctcggccgagccaccccttctctcgggtcgcgccctagccgcccgaggaaagtctaattcccctcccttcttcttttcttttcttttctttttcaaaaaggatttaaataaatccttttcctttagaccaaaaatccaataatcttagaaattcaatatcttcccaaccgtaagtccgtttgactccgttcaacttctaaaatttctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatatcgagcaaggcaagccacctttgaacatcttgagcctatatttgaacttaattatgttgcttgaaaaatattatgcattgctaggatcgcacttaatctacttgtcccgtctgcaaggcagattggcggacctacctaacttgttgcatttgacccttccattgtaattgttataccatgttcccttgtaaccacctagttgcgcctcggtaatcgtgcactctgcacgagtatcgacggtcgccttcaaacttaaaatttgagaaacatcttgggtaaaacttgggttttacaaaagacttggaaaacccgacacctgggtcggtgcttgcgaacctaaatgaatttccaaaatcgcggaccggggaacgtatcgggtgtacggtttcccgcttttgcacttaaggaccgtttccttggaatttcatccgaacataagacaagtacgaccacatgggtggaatgggacatccctggctgagtaattagctaaacaggggagccttgatgctgagagacaagtggattcgccggggtggtgtcggggaggacccctgggcttcctggcacagtatggtctgggacctaacctgttgttggtctgggacccctctcgtcagcatatggtgaacctgtgtcggctctcgaaatgccttgtcatgaaagccttaaggtctctagtcgtggccgttctgcacgggctggatgatccgggttagtaatgtcgtgtgggtaaagtgtaccccctctgcagaggttattaaactgttcgaacagccgtgcccacggtcatgggcggatgtgaggtgattcctagcgtagttttgtttgactactgctttgtgaaatttgctgatgtggttcgggattgatgtttggaaaatctgcggctgatgggatcagccaggcccgggtggccgtttgaaagctgttggctgggtgccaatcttgatcaattcaaaagactgatacattgcacatactccgaccggatgagtcgcactgtctcatccgtgtcgtttgagaagcactcacctagttgttttagaaaagagttcaaataaaatcaattgcaaaaaaaaaacaacagcctttccttgaagcctgcattaaacacttatttcccataagtcttggcttccgcttcccttttgtaatgcagttgtgagctcgggatctgtccgcagcccaacatgactgtactcctactctataataaagagacctttgttgctgtgatattctgtcttcctgtgataccagcactgtttcctgggactggtatcgattaacaggttaatttggagcgtcacgggctagttccgctcgggacttgttcggggcgtgacatttacgctctctttgttttccttcccaacagaagagaaaggggagggcaccatatgttgtatttgtcattagggcattcacaatgcgcgtgcgtggcgttcggctaacccgagattctccgccaactcagcttggagcgtgaccgaacaaggttcacgtagcccacattgggcactcgttcttcgttagaaaagctgtcgtgcgacgcagggaagaacggcacggccgctctgtgggggtcatggcctcgcgcttcgtggccccgtgcgacgccggagagagctgctacagcaccggagagggaacctcgtcgccgcccctgctcgtcattctcctctccgcgccgccgagctcgtcggccagtctctccgattcgcaactgtgacatcctggcccaaggcttgatagattaatagaatactcataacaacaagtttgcaacttcttttctggaagccgatctccaaagaactctgtggttaagcgtgcttggaattttgggatgggtgaccgaccaggaaattcttttcaggtgcacaagtaaggataaagtgtgcagaaaagacttgtgttggtctgtgagggcaatctatatccaagaaaagctgccagatgtaagtgggcctgacttgggaggggtgggacgttacagcaacggagagggatgtcgcgccggtgccggagggaagaagggagaagccacgggccggatctggaaaagctgccagatgtaagtgggcccagcctgggagaggtgcgacgttacagcaacggagagggacgtcgcgccggtgccggagggaagaagggagaggccgccgtaggcctaccatggagccgtcgccagcatcgtcatcgagccgccggcccattgctgcttatcgtgtccagattcggtgagtcacgggccggatctagagagctcggtggagggagaggccggaaacgaggaggaaacgacggagggagaggtcggaggcagcagccgccgcaagccgtcgagctgggctcaagcggcgtccacgattgagaggcgccgacagggagggggagcgacggagaggagggagagctgcaccgacggtcgggagaagtggagttgtgccagtggtggtggggaaggggaggagacatgtcggcttggggaggttaggggaatgacctggggaggggagagggaggccggcgtactgtgggagattaaaatttgttatgtgtggcttcattcacttttttgtctatgtcgagcacatggtcacacgaaacaagccggatgcactgctaatgcccttatgtgaccaacagtgtgctaaaagcagcgatcaatcacacattgtccccaccagtaagtcatccgggacttgttacaaatagacttcccagccatcgtattatttgcttcattcaagttagtacagtcaatactacaccctttccttccttttttttttcatataggaagactttactactccctctctaggggtcggtttcactgtccttggccgactctacaagctttactgttgaaatttgacgatgactccttttttttttcttcagaagtataatattttgacatcttcaaggtacgaaacgtacgtaatcttgtactatccccaaagttctaaacaatac

SEQ ID NO: 78196 - DNA, 15167 bp, Oryza sativa
cagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagggagaaaaaaaaggagagaggggagctcgtagaaaggacgaggggaaaaatagtagggagagggtctctagagttcaaaggctcttgctcttcagctctttgtaactccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaactggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaatggccgaacgagcaaaagcgcacaacctctctccgagcgctagcggtgacgacagcgagcagaacccgcgtcgtcgagcttgtactccgccgcccccctctcgccgaagtcttaggcgggaggaggcgctcgagggggtcgaaagatccgcgacttcgccgcccatgagtgatggagaaggacggcgagacggggagcgtcgtctcctcgtctacggtgatggcagcacgccccagggcgcgctccaggctgcgggcgcgctcctgcgtcacccgcccgtcgtccctgatcaagagactccaactcgacgttggctagatgacgtggccaacttggtcatgacggcgcagcagcgtttaggcgccggcgggcggtcctccgccaccaaggccactggcgctgctactgccggctccgtgtcgtcgaggcggagggcgcggcgagcggcggccgttgcccgccgttcgtccgccattccctcgtcaatgcctccgacccaagaagatgtgcgtgaggggccggatgcccgcctcaatatcgagcgccggcgcaatgatcgccgtgctgcccacgcatcggagggcgcttcctcgtccggagcgccacttcggtccgggcacggaggccagccccccgtgtccccggttggcggtgccggctgtcgagactttgtggcgagccttcagaacgtccgttggcccccaaggttccggcccaccatcaccgaaaaatacgacggaagcgtcaaccccgccgagtttctccagatctacacgactgggatcgaggccgccgggggtgacgacagggtcatggcgaatttcttccccatggccctgagaggacaggcgcggggttggctaatgaacttgccacccgcgtcggtccactcttgggaggatttgtgccagcagttcaccatgaacttccagggcacatatccgcgcccaggtgaagaagcggacttgcacgcggtacagcgaggggacgatgagtctcttcgctcgtatattcagcggttttgtcaagtccgcaacaccataccatgtatccctgcacacgcggtgatctacgcgttcagggggggcgtgcggcacaaccgcatgctcgagaagatcgcctccaaggagccccagaccactgcggagctttttcagctcgcagaccgtgtggctcgcaaggaggaggcatggacctggaactccaccggttccggtgtggcagcttcagccgcccccggatctgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaaggccccagcggctccctctggcaaccggcgaagtgaggccaagcagaaggtccccgccgaggacattgacgatggcaacgatgacctagggttccaggagcctggggccaccatcgccaccgtcgatggggagcatgcgctcacgtttctcgccggagcctcaaggccatgaagcgagagcttctggccgcggccctacccatgaggcgatgcggcgtgcgtggtggtcggaggttgccctcaccttcgaccagaccgaccacccgccgtgcgttgcccggggaggacagatcgcgatggtggtttcccccaccgtttgcaacgtgaagttggggcgtgtccttatagacgggagagcagccctcaacatcctttcccccacagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggctcggcacctccgtccccgccgccccgaggcagcggatgatcacgtgcgacgaggtcccggtcaaggaggttgccctgggcgacggcccgtccaagaccacacgaatcggtggtctgctggacggcaaataggaagacgcgctcgtctccttcctgcgggcaaacgctgacgtcttcgcatggagaccggcggacatgcccggggtccccagggaggtgattgagcaccgtctcgccgtacggccgggcgcaaggccggtccgtcagaaagtgcggtggcaggcctcggaacgtcaagccttcatccgcgaggaggtggcgcgacttctggaggccggattcatccgagaggttatccatccggagtggttggcgaacccggtcgtcgttcccaaggcgaatggcaaggttcgaatgtgcatcgactacaccgaccttaacaaggcatgtcctaaggacccttaccccctaccacgcatagatcagattgtcgactccaccgcggggtgcgaccttttgtgttttctagatgcatactctggttatcatcagatttgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaagagaccttactctcggatctagcggaaactttcgaaagtctccgcaccgcccgcataaagctgaaccccgacaagtgcgtgttcggtgtgcctgcgggcaagcttctcgggttcttggtctctgcccgaggcattgaggccaaccccgagaaggtacgagctatagagcggatgcgcccccccagcaagcttagggatgtgcaatgtgtcactggctgtatggccgccctaagtcgattcatatcgaggctgggagagaaagcgctacccctatttaagctcctcaaacgctccgggccgtttatctggacggaggaggctgaacgggccctcactcagttgaaggcgtacctcagttctcccccagtcctggtcgccccggagccagatgagccgttgctactttacctggcggcaaccccgcaggtggtcagcgcggcgttggtcgtggagcgtgacgaggacgaccctcgctccgcgcatccccaccctgtgtcgactcgacccgggagagagcagggaggagaggcccccgagccgaacggtggcccaaggcccccgacggccggagctggccctccgcccgcttgtccgaaggtgccaggcgcccccgacccccgggatggccacggggccactgcgggaaggccgcgcctgtcgccttctgaccccgaggtcgtcagcacagaagccgagtgcgccccgcgcggcctctcggagcgtgacgaggacgaccctcgctccgcgcatccccaccctgtgtcgactcgacccgggagagagcagggaggagaggcccccgagccgaacggtggcccaaggcccccgacgaccggagctggccctccgcccgcttgtccgacggtgccaggcgcccccgacccccaggatggccccggggccactgcgggaaggccgcgcctgtcgccctccgaccccgaggtcgtcggcacagaagccgagtgcgccccgcgaggcctctcggacgaagagcgccctggagatgcggcccctagtgaagaagatcggccccgccgaaaggtgcagcggcccgtctacttcgttagcgaggccctccgggacgctaagacccgataccctcaggcccagaagatgctttacgctattctgatggcttcgaggaagttgcgccattattttcaggcgcatcgggtcacggtggttacgtcttaccccctcggccaaatcttgtataaccgagagggtactggacgggtggtgaaatgggcaatcgaactctctgagttcgatttgcgctttgaaccacgccacgcagtcaagagccaggccctcgccgactttgtggcagagtggaccccggccgctgagcccatctccgtccccgaggccagctcgggcccctcgcagctgcctcacaccgcctattgggtgatgcagttcgacggctccctgtctcttcagggcgccggtgcgggggtcacgttgacctcgccgagcggagatgtcctcaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccgtgtgcggcgtatggagcgccattttgacgggatagagcttcggcacgtgcccagacgggataacacggtcgccgacgaactctcaaggctcgcctcctcgcgagcccagaccccaccgggcgcctttgaagaaaggcttgcccagccgtcggcgcgacccgacctcctaggggagacggacgcgcctgaacggcccccgaggcccgtcggagtccaggcctcgggacccgaggggagcgatcccagctcccttagattgattgcttggatcgctgagatccaggcgtacctcgcagataagactctacccgaggaccgcgaagggagtgaacgcgtccagcgcatctccaagcgctacgtactggtggaagggaccctctatcggcgcgcggctaacggagtcctcctaaagtgcattcctcgggaacaaggcgtcgagcttcttgccgatatccatgaaggcgagtgcggagcccactctgcctcacgcaccttggttggcaaggcctttcgccagggtttctattggccgacggctctcaacgatgcggtcgacctggtccggcggtgcagggcgtgccagttccacgccaagcaaacccatcagccggcccaggccctacagacaatacctctttcatggccgtttgctgtccgggggctcgatatcctgggtccgtttagatgggccccgggcgggttcgagtatctgtatgtcgctatcgacaagttcactaagtggcccgaggcttatccggtcatcaagatcgataagcactccgcacttaaattcatcaagggcatcacagcccggtttggggtgcctaaccgtattattacggataacggcacccaattcactagtgaactcttcggtgactactgcgaagacatgggcatcaagctctgcttcgcctcccctgcccaccccagaagcaatggccaagtggagcgcgccaacgcggaaatcctcaagggcctcaaaaccaagaccttcaacatcctcaagaagcacggcgactcgtggatcgaggagttgccagcggtgctctaggcgaaccgaaccacgccaagccgagcaaccggggaaacgcctttcttcctcgtctacggcgcgaaggcggttctcccatccgagctcaccctgaggtcccctcgggccaccatgtactgcgaggctgatcaagatcatcttcgcagagatgacctcgactacttggaagagcgaaggcggcgtgcggccctccgagccgcgcgctaccagcagagcctgcggcgctaccatcagcgccacgtccgggcccgatcactctgcgttgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcaaacaccttcgtcgtttctacccctagtaggggtcgggtgtcaggtctcgggctcgggccaaccccgcaccccccctgggcgtgcagggttggccgggggctaccacatgcatatacttatcttttttctcttccgtatttcaataaaagcattttcgatttcctaaggactgtgtctgtgccattgtttcctttcaaagagtcttggcttgaattagcatgctcgtgctcgaccctgccctcggtgtcccgggccggcggaaatcgccaaacagggcccagaatcgagccgtgccccggggcgtggtgaactccgggggggaatcggcaaaggcccacaatcgggtcatccataaccctcggtcaccacgttcccggcctggccagtctcgacacgtggatctccccaggcactagccccgacccgcgccatttgaggctgggacctgggcacgagccctcgttcaaaccaagacatagaaggaccacggcacagaccatcctcgtctcatacacacaacaaacagagctgacacaaaaatttcctctttatttgattgcagattaaattagtttgtacaagaagggggcccgaatgcctcggaagaagaaaggaaaaactatttaagattggcgggggcctgggggctcacttcgaggctcccgggtcgccggcctcgtcgtcgctgtcgtccacaccaccgtcgccgccctccacgtcggagtcgagggcgaacgcgagccgaggggccgtaccctcgaagctgtggacgatgtgatcggcggcgtcccggacctgcgcgcgcgcgtcgtcctcggttccgggagggaactcgtccagcgccgcccacggggagaagtccgggtccctggcctggtagcttgccagtacaagctccactgccccccgggcgaggtctctcgaggatgacttgatcgtctcctcgagctcctcgaggagccgctggagagtcccggccatctctgagaggcgctgggcgaggaccccatggttggcggcatatttcgcgatccgcccgccccagaggcccgcctgccgcccagcgcggtctagacgggagacggcgtcccgaagcatgccgggccctacctcgcctgccaagcggagggcctcgacctccccggcggacgagtccagcgcgccctgcagctcggcgatggtgtgttcggcagctgcgaggcgggcggctagatcgccgtcgcccgtggccgccccgccgctacgcgccctcgcatccagctcccttgcccgtgcctcgagctcagcggcccgctgatccagtgcggccctctcggcgcgggcaccttccagattgcgacacgtttgtttctccagcgctgcctcacgaagggcaggctgtccgccagcctttgcgccgcggcctcggcctcctcgagagctcgctcccgctcggtgagcgcatcctcgcggaggcggagtgcggactcctcttcagcacaggcggcttcgtgcgccgccagtgtagcctcccggatggcaacggcggcctcgcggtccgccaggtccctctccttcacacaggcgcgctcttccagcgccgtggcacgggcctcaagggcttcttcgcgccaccgggacgccgcctcggtctccgccgcccgccgtttccgggcagcagcggcttcaaggaccccccgggcggcgtcgagcttctttcctagctccgccgcccagctcccgtattgaaggcggaggtcgtcctgcgcctcgttcatcactgcggtggcgatgagggcagcctcccgctcctcctccacctccctggcgatctccgccagctccttccgacgggcctcgagctccgaggtgtgccggcggtgtgccttgcggcccgcctccaccatggcctccaccgagcgtcgcccctcttcgacacgtgcccatgcagcgtcgagctccgcccgctctgcctgcaggacctccatctgggcacttaacccgtccaacactgtcgtgttcgcggcggccaaggcctgcagaagggcctctgcgctcagtggggcagcggaaggcatgggggagagccgcctcggtgaggatgccgcacggctcggcccgccgatcgacgtaccggactcagggacgacccccggacctggcttgtcctgagcgtcgcccgaggggtcgggcccgagcggtgcgcccgcggcctcgtcgtgggtggcctcggaagtcgtcgtcgcctcgggcggagtcgggtcgggggcttggcaggccgcctggcgtgcgcgcgccgcctccgcctcccgggcggactcctcggcccggcggagtctggcctcctcccgagcggcttcctcagcccggcgagcccggacggcctcctgggcagcctcctcggcttcccgaaggcgatccgcggcttctcgccggtcagtttcccgtctccgggcctccgcggtcgccgtatcctcggcctcagaccggccggacttggaatggcgggaggggcgcgacgggatctcgctgaagcagaagaaaaaccagaagacaaacaaaacgggtgagtgaaaacttgcattgggagaatgaatacagccacagtgggcgcaggacgaacctgcgaggaggtcggttgaacgaccaccttgggggggagataaggtttccccggtatgattcggtcccccccatcttgcagagccgtttcttcttccgctccccctcgggctgcggcgtcggcgcggccccctccgggcgcctgctgctgacacgcgccgccccgccccctcggggaggagatggggagggggtaccctcttgcttcctcttccctcgggcgtcggcagggcggctgccccccgggcccctgtcacggggcccagaagcacgaccccctcctggggtagattgttctcccctgcggctcccgcccgcgccatcgtggcctcgaggagcccgctcctccgacgccccgaccgccatcatgatggtcaggatgttggcacgatctggatcgctgcagagggggaggactccttgggggatgagggacgcctccacggagctgagattcagcacccgttggaccactatcttgaagtcctcaggggcctagtcccatctgaccccttggtgggtcctcatgtagtcttcggacccggtgtactcccaggcgccccgggcgcgccgctggagcggcgcaatccggcgacgaaggtagtcgccgtacagcatggcccccgtgagcccctgggatcgcagacccgccagacggtcaagaacggcgtcgtagccatctcccagatctagcggcgcccgccaactggaggcctgcgctgggggctggctccgaagttggaggcgcgcttcgtcggcgaggggggtgtagaaccagtcactcttccagtcgtcccacttcttgcggaggacgcagggaatgtagcggctcagcgccggcccccgcggctggaagtagcagccaccaactaccgacggcggcgacactggctgtacggtgaagaaccaccgaaactgccgaagagatgggcgcaccccgataaacatctcgcacaggtgcgcgaagatggccaacgtcattatcgcgttgggggtaaggtgcgccatctggaggtcataaaactccagaacatccatgaagaaagaagagaatggcgggaccagccctgccattgcgaaagggaggaagaagacggaccgccccgggtagtgtggtaccgggcgtccctcgcctagctcgaccacctcccggccggtggcagatgccggcatgaatcggcgcggcagcccggcctgcctctcgctcacgatgcgggaagacggcagcacgctaccgtcgagtggtgcggagccccgtgccatgacgccggcggaggaggagcttgaaaacgagtgagtgcggcgagggtagggcacaggaaacaaggagttagggcgcaagcggcgaaggcaaggggaataatgacgagaggaaggaagcgaatctcttcctcggcgtctttatacccttgccaacgctatgcccggctcctcgcttcccgcgcccactatctcgccccctcgtttctcgcgcccacgtctccactaattccgctcgcccgtttgcggcgcacgaggcggatgtgcggctgtggcagttgagatgggacatatcgtgcgcgcgttaactacgctcgccgaccgaagcgccatcatcatatctccaggcaaaacgaaccggctcgtcccgattcgcgtgctactcgagtaatgtagcggtcttgaagagaccgctcattatagacagtcggttttccgttgctgatgtgcgcgatttgcgaccgctgggtttctgcccgcctgtagagaccggccccacctgtcaccaggcctaaggagtggcgtcacgcccgagcgcttccttcgaggggggcgatcgccctggcataacgccgggggctactgtcggtgacatgggaccgggagtatcatgactagaggcttgggcagccgcgatcacccacgtggcctgacccctcggggggggggggtcgggcccgagggtgatgtggccgcccctccctttgtctccccgaggggtcggactgctcccgtttcgaccccgagggccggggcgccccgaccccctgtgggtttggcgccacgtatatgggttaggtgagcacagcggggctcacctaaccgcatttattgcgggttggacgagcgcgtcacgccgcatgtaatgcagcgcagcgcgctcgcttatccggtccgtgaccgggcgcagcgtgtgaccggtcacagaccggtcagatcgcgggttaggtggtggcaggtggcctgttacacgcctcgccccgtcccgtcggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagagagaaaaaaaagaaggagagaggggagctcgtagaaaggacgaggggaaaaagagtagggagagggtctctagagttcaaaggctcttgctcttcagctctttgtaattccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaaccggcaaaggggggcccgcgcggtctcccggtgaggagccccacgctccgtcatatttaataaaacttttaaattctattaatataatcttttaaagtaacttcgtttagaatacttttacaaaaattaccattcagcagtttaaaaagcgtgcgcgtggaaaatcagaaaatagaagtttggaagagaacaaatcctaagttacatttgtaaatttttggatgagttttctatggaagttgtatatctagtccttattttctaagcccagtaattattgcagcagacatgaaataatgcaattgcccctgaaaaacaaacattctctggaaactcaagctgaaggcacatacttgcgattatgttggagtccaaagtgcttggatgcaaaattccctttgtctctactcgctcacgtagcgcttgctagcattaagaaaggactcgctgtacggtcgtagataagtccaccattccgcgttaaagcgttttcccgcacgggctgagctggtgcacctcccacgagccttctcatcccctccggcccatccacctcgcttcgctagctagctgctctccccacctatataacagcgagcccgcccaacacccgctcgccctcctctacttctgccgcgccaccaaccatccatcgctgacgcttccaacccaactgaattcaaacgaagcgaacaacacgaaccatgcaggcgcaatcccgcctcgctgctgccgcgagcggcggcagcggcagtggaattagcgggagcggtggcattagcaggttgggtggtggagcgggggaggagcacgaggcggtggtgagggagctgacgcgcgggcacgagctgacggcgcggctgcgggcggaggcgctgcgggcgctgcgcgggcaggggcaggccgaggccaccgctacattcatcctcggggaggtctcccgcgccttcaccgtctgcctctccatcatggccagcgcctccccgtccgcctcgccgccacaaccggacgagacgccgccggccgactcagccgtctcgccaccaccaccgcgcgcggcgagagaggacaacgtcccgcgaaagtgagttattctgcacgtgctatacagttatactggaagcataaataaatgcctagctagctagcttccagccgcagaactagtagctagctaatcaattagtacaagatcagctgggttaaatatgctataggaattgagtacgagtttatctgattcatcccgtgcattgatccacaggagattattgacagcctctccttacgacgatgggtaccagtggaggaagtacggtcaaaagaagatcaacaacaccaacttcccaaggtttaaattaatttctcaaccccgtgcctgcaggctagatatatcatataccttaacccatggattaattaatcgacaaccctgctcatgtcaaaatgctcagataattaaccatcgcgactactcgttttgtttttaaatgtaacgagattatggttacgaatttagatacgcatgcatcttctcttgtccagattcatagccataatttttatatttagaaacggaaaaagtatatatttagcaaaaatgggtaatttaccatgtcgttgtaaataaaaaaccaaggtgagtacttttggaccatgacggttctagctagctagagacagcgtataggagaaaaggtattattcgtgatgtattgattggactttgttggatagcgaaggcgtggcaccggggacggaagagacaaacggaaaatgtcgcttgacacgcaccctacaactttatagattcttttgagcagccaggcgaattaattgatcgccacatgtttgaaaccatccataaagttaagccttatcagttggagaaaccaaagttaagctgattttttttctgtcatgtggaaattaagctgttctgttttcttcacatgatcattttgtccctggtgtcacgttgtgtagcgcgagcaaataactgtggtttatctgcgtgtatcactgtgagctctctgctagtttaaagctggagtttgggttatattatatcggaagcatcttgtgacgtcatcacctaataattatttcttgtgatgtgacctcatcaggccagcttgctagctagccgccatgttcttggattaggttacctaattatgtatacagtacacgaatcttaattaaatcttaatcgtttgttatactgatgattcttcctaaacacgcaggagctactacaggtgcagttaccaccgggagcgcagatgccccgcgcagaagcacgtgcagcagcgcgacggcgacgacgtcccggcgctgcacgtcgtcgtctacacccacgagcacacgtgcctgcagggggcgcccgccgagcttcccgacgcggcgacgaacggtggcgccgccgccgccgcgtcgccggactacttccccgccggcggcgagacgccgtcgtcgctgcggcggctccggggcgtcggcggcggcggcctgcagcctcagttcgtggaccaccgcgccgccatggaggagcgcgagcgccaggtgctcgtctcgtccctcgcccgcgtgctgcaggggcggcagtgct

SEQ ID NO: 78197 - DNA, 8263 bp, Oryza sativa
ccttaccatgaacttggtgtctccttaagggcaagttttatggtagaggtgactaccatatccaatttcatacatgacatacataattaaattaagaggtgatatgtataataggctatctctatcacataattcccaatatctctaacactctcacatgtttattgaagtttgtgtaggggctgccccttgcatgagaggtgactatttctctctcatccttcttctctcctccacctcactatttagtcttttgtgtcatcttgggatttatgtttgaatgtccatagtacttgccctaagttatctacagatactccgatacttcgatcagtttgatgagtaaaattttagcacgacacttcgaaaagttcatcaccgagaagttggctactctaaaaaaaagttagcatctggtacagtgagctcgaatctgaatcattttggagcgaccttgaccggagcgaatctgtgtggtacacttgcggttgtttttcggtcaatcccaatcccctgcatgcgcccttccctgcgcgcgtatgcatgtgatcgatcgatcatgagctctctgctctgtacatctggtacgtgtgcacgtgtgatcgtaatcttggttttactaaagaaggagatttaggcgttgatcattagtagaaaagatttagcgttgatctgttcctgccaacgacgacccggggggaatcgacgcccgtatcttattgaaaccaatcgaacaatctatctattaacttattaaagtaatagaaaaataagcatccacgttggcttttacggtctaaaaattattatattaatcggagaaaaataaaaacaaattccatataaaaatacaatttaaaaagtaaggaatattggaagaggagactagaagcctccacgctcgctctcccggcctagaaattctcatatttaaaaaataaaaacagagtccatatagaatacaatttagaaatagctaaaattcagaatttaaaaaataaacaatattagaagaggagactagaattcatgacgatatacaatttagaactaatgaaaattcgaaattaaacaataataaaattaaaattaagttagagtccatatagaaatataattaagaaataatagaaattcggaattagaaaacaacagatattagaagaagagtatagagtccatataagaatttagaatgaactaaaattcggaataaaaattaaaattaaagatagaatttagagtctatatagaaatacaatttataaataataaaatttgaaattaaaaaatttatggaagaagagtctagagtcaatatagaagtaactgaaattcaaaaataaaaaaaaagaatattgaaagatgggtttaaagtccacatagaaaaacaattagaaataatgaaaattcaaaattttaaaaaaaatattgaaaaaagagcctagagactatatagaaatacaaattacaaataacgagaattcagaactaaaaaaatgaggaatattggaagacaagtctgcagtccatatataagaatacaatttagaaataactaaaatttgatattaaaaataattaataactatcacgtatatacaatacagtatgagacagtggtagtttagtaaagttagtacaaaatttaaaattatgttatcattttaatatattttaataataaattgagaaaacatatatgtggccaccgtgctagttctgggctgtttagttggaaaaaaattttgctcctgtatatcacatcggatatacggacacatatttgaagtattaaacatagtctaataacaaaacaaattacagatttcgctagaaaactaagagacgaatttattaagcctaattaatccgtcattagcaaatatttactgtagcactatattgtcaaatcatggcgcaattaggcttgaaagatttgtctcgcaattttctgacgaactatgtaattgatttttttatctacatttaatactgtatgtatgtgtctaaatatttaaggtgacaacgtgaaaaattttgttttggactaagcaggccctcagttgatcagatgagagatccacatggaacacaggactctgaaccatgtgatgatgtaacgtggcgacgatcgaggacacataattaaaaacttggccgcgacacgtttttggcaacttctacgcgcggccgtcgtcgtgactctcgccatagttttatcatcatcatcagcgatcgatcgatcgagtagccgagtacagtgaccgagtagcactagtgtacagtgtggctcctcgctccatcgatgggtcgcgacaacgccataattggggacatcgacagagtagttacgtgtactgtagtagcggaaggggaatcacgttgcggccaggtgatcgagctgccgaagccgagtgaagtggcggggcggagatctcgttgtcgatcgcgcagcagcaaagcgggtgctcggtcgctgagcctgatttgctcccttgtcagtcgcgttggttggccttgggcccttgggcccgttgcgaccgcggcgttggttcgcgcgggcttccttcccaccccgcgttggtgggggcggggttctataaatacgggacgcgacgcgatgtgcggggtcacttcactgcacggcgtcgcggttttcccaagctgagagttgtcgtgcgagagtgaggagcatggcgatgctggggagctcgtcggcggtggtgctggagctgatgacgatggggtaccagtcggcggcgtacctcggcgagctgctccgggcggcgtccccggcgcaggcaggggatgagcagcaggagctcgccgcggagatcctccgctgctgcgaccgcgtcatcgccaagctgaaccggggaggagccactggtgctactaccggcaagaagcggaaggcggcggagtccgccgccgccgccgccgtgacctccccttctctccccgtcacgccgaccaaaagaaggtgaggttccccttattgttttttggcgcggctaccgcgagacatatcgtggtatcaaaaatcgaaaaaaccgtgtggtaaccgtaagatatatcgtggtattaaaaatcgaaaaggttaccgtgcatgataaccgcgataatcgtgtggtaacggtacggttttgtactctatcatgcaaggtagtaacaggtgatttcttggtttggcgcagggcgcgtggcgcggaggcggtgagggaggtgaggagcggcacgacgacggacgggttcatctggaggaagtacgggcagaaggagatcaatggctgcaagcacccgaggctctactaccgctgcgcgttcaggggccagggctgcctcgccacgcggcgggtgcagcagtcgcagtcgcaggacgacccggccgcggcgttcgtgatcgcctactacggcgagcacacctgcggaggcgacgccgccgccgccgccgcgtgccgggacggggaactaatgccacctgccgtcatcaactccggcgcgtcgagcttcgccgccgcttggaacatggcctcgcgtgagccggcgtcgtcgctcgccgtcgagcggaggagctgcgacggcgacgctcccagcgagacgtcgcaggggtggtctccctccttctcgtcggaggtggagctggacgtggtgggattcgacctcgccggagccgactcgtcggcgtcgccggtgtgggagttcttgaatggcagcttcgactgggaattcgtcatcaactccctctgaattttcgatgcttcgtgatcagtagcacaccagctgccccaagagtgcagtagtctttgcaaaacgcacaaaatttcgcgggaactatcgaatttcccgcgtttgcgcttaagttaatagcctcagtagttcgtcagataatcgcacgcactattttaattcaggaagggatttagattgacaaagtatattaggtgagagttaatatgggagaattcgtaatgaagagttgaatgtgttgacgttgacgtacaggggaaaaacacatgctaagaagaaaaatggcaggtgaaaggggcaagaaatggcaaagctgagcaacagagcaggtaataatagagaattgctactcctactacttgcaagcatatatgtccagaagagcagccaaagagaacacaagaccgtcagcttgacgcataactgacgcacttctgatggtaacaaaaaaccggccaccatgtcccatgtgaacgaatggattcattagttgtaataatggtaatagtagtgacactcaattgcaatatcatgcttggtacagggttaaggatcagatggttagtttaaccaccaatagcaacaagctgaaacgaatactggttttgctggatttcactggatgttgttgaatatcacaagcttagagcacaacaacgttgcatcaaataaacagaagaaacagaaaacagctaggtacatctatgacctttggaggtcaatttcttattgttgttcgaggcgaatgtgtatattacatggggagaacaaaggagcgcaactgcgaggacgagtatgcatgcaagtcgtcttctgaacccaaccgtcaaagtccacagccacttggggactaaagacaaactagggttgcttgagtttgatggggatggaaacggaaagcaaatgggccagtcaatcttcaaacccaagttcctgtgatcatctgattcatccagggtgatgtgtaacctagagaaatgccatgttgtgagttcaacgacaattggttttatcatttatgcgtaacatcatgtaactagttcagttatcatttatcaaagcacataggcagtgtttatagacctatttgtatactgtacatgcatgggaaaatagcatgaaagtaaaactgtcaagtgttaccattagttctctgcagtactctcggagcttggacctttgtgaccaccagtcataatacgatgagtgtaaaaggctgtcaccgccccactgcagaacaattcaaaactagtttaaaaaaataaaggttttcatacatacaacaaatgtatttcttctgtataagcttaaaatggccatagtggctaggaccccaataaaaaaaaactgtgatatgtgacacgcccctaaagaaataaaacacagcacgataaccactgaatgaacaacttcaaaatgaaacctagtaagtcattggagatttggaataatcatggccaaatatattgtttgccatcaactacttacaggtcactgcatttaaaggaacattgctcatgtttggtttgacaagtttagttttgaagcagcacacaacgtgccaacagttttattactccctccttccaaaagtctaagacctatttctttttgcaccaagaccaagaagcaattaattcattcactatgtatacaaccaataagtaatagaatgacttcttgggaatttaatttagcacatggtgactacaaataggacttggacttttggaaaaaccaaagaatgaaataggtcttagacttttggaaggagggagtataaaaaatggaactattaactgtggaaaaaagaaggcactcaggtgatattcagcgaaaagtagtatttgtgacagatgtaaaaaaaaaactgtcagactgtcacattggattgcagtctaggtgatagatacagtttggggaaatgtacagtaaataagaagaaatctataagaaaaaacacaggataacaggaacatcaaaggcatatgggtaagaaaattcttgtataatcaaggcaaattctgtacaaggaattgacgcttactagtcatagaaagaaactgtttttaagaaatctcatcgtaggaaccaaaaatatgcaaggatcaccacattacatgttaacacattgctagatgtctgttagtcaatatcagagcaagtacaaaaattaagcatgcactcacctgagaaggaccacgaaaatatttggaaaccacccatactacaccatataacaaataaaaaaaggttaaaactaaattatggtggtgagaacaagtatgaatattagaatttagcaatgcaattgaaggcaaagaaagaaatcatacgtggaagaaaattaataattccctgaagaagatgacacttgcaattgctgcatgaaagtcaaatatgtcaataaatttgcaatgtaaaaggacaacaatccaatgacttggttcagcaagctaaatcatgggttcatttttcaatgtaaaatgatgatgaattcttaatttccaattagataatagctagaagtctgaaatattcatacttgtcatccctgtttgatttaacttgaactaatatggatatatccagtaactagacatgtcacataaaaacagagaacatgagtatcaaggatcaacacaagagaccagctatgctactcttatgccacttaaattatgaaaagggcatacaaactgaagagaagaaaagacagaagaaatgaactaaccagcttgtcctttcagcagaagacgaggacgacggccacctgctctttgagatctcaaacttgagatgcccatagctaacagcgcaaagccaagaataataccaaaacgaattgcagatgtcctcccagtaagcatgaagttcaggaaacctcctacggtaagaaaggtacctacaaaaaacagggcaggtccatgaactaaagttgagaacctacataacaaggcagcattaaagtgcctacacaacgaatgacacactttctcggtttattacgtgtttgtcaattccccagtatcaaattaattatcaacggaaattctacaaagaaaaatatgtaatgcattttagttaccaaagggaatgcccacgtgataatcctcatactctgatatcttcaacttgccaagagaattgaatgtctcgataatatccttaattgagtctggcgagttttgagccgcgagttttagatactcctgtccctcctcaccaacctctgtggcaatcacgctgagatccttctgtgctttgtctgcgtggatcttcagcttctctgaggcctctaatagcacctcccttgccctctgggagtagacaccatacgcctgcaatgtcaggccgtgcattcgctgcgcctcatccttgaactgcttaagcatctccttccacacttcttgagcttcctcaggcttcatctcacccttccctttttccttgtcatcacccgattctgagcccacctgaattcaggcaaactcaaccacataagttgtgaactctagacaaatgttttaagcaccacaatttagcaacagaataaacaaggaatttgccacaagaactcagttcaaaaccctgacgaaacgcaccgacattagtcaaacatgggatttatttagcgcaatgaactgatcaagacatttggcatctcaaaaagcgcattaacattaggcaaaactgtttggtatgcattacgtatttacgcttcgaaatagtcagacaaaaatcacttgacgcagcaaaaaattgtaaaagcacaccgagattatgtcatccgcgcatcacgcacagaaaatgggaggggaaaaaaaactagtcaaccaaataaaaccacacagatcggattgacagtaacaagaggaatacgatagaagcagccaccagcgggtaggatctcgaaagggcgagactactcacagattcctctccggcgaaggtggcgatgacgcggcgagtccgcggggcgccccatccggcggcgaggcgtgaccccgccgagagcgccctgagcggggcgtcgaggcaacggcggcggcgggtggagggggaggaagcggtggcgcacgccaggcgcaggaatggggaggaggaggcgagcgggtggaaggcccccacgcgggcggccggcgcgggggaggcggaggctgccgcggcgtggacgagcgaggcggccatgggggggggggtggggcgctccgcggctgcgcccctcggggaaggcgggcggcggcggcggggacgcgacggcggaggcgggcggcacgaggggaacgcgaggaaaatgggggaagaagaagaagaagagtttggtggggttttcgtgtgagggggctttcggtttcggagctctcggaggtgtttgtgtaattgtgtttggtgggctggaattcgtttcgttttcagctgtttcaaccgggttttttaaagtggacgttctgtcaatcaaacctttggccttgtgctcgcggcaagaaaatatgcgccgtccattggt

SEQ ID NO: 78198 - DNA, 23503 bp, Oryza sativa
cagcaacaggattatcaagttgcttgagcccagataacttctgtcctatgctagcatccacaaaggaatgagtgctgccagaatcaattaacatcaataattcaaaaccctgaatccacccccttaatttgattgatttactggattctatcccccacatagcttgctgagatatagccataagtgtctccttggtgtcattttcatcatcagtttcaaacacagcttctactgacacagcttccagaagttcttctactacatgcaactgaatggtggtggcacatttatgttcttttccccatctttcaccacaagtaaaacacaaccccttagatctcctatatgctttaagagctgccaacttgtcatctcttgccctagctgcatcagttcctctcctatcttcagaattggtgatactgagtgttctattgttagaagaagagattgggcggtggggtctggttcccacaattaggtcagatttcttgtatgacagagacttacaaccctctaatgcctcctccagaagtaaggccacagaacaggctgcatctaaatcagggggtttctgtaccatcactacagttctgatatcatctcttaacccttcaataaatttggtcacaaaatagtctggtatgtcagagttgccataggccatcagctggtgcataagattatcaaatttttccacatattcactaacagtcccagtttgattcaaatgaatccactgcctgatcagttctctttttctgtctctagcaaagcgattacacactatctcacataggtccggccaggaaattcccccaagttgtgttctgacagattgtaaccaaaaagcagcgttgcccacaaaattgagagtagcaatttttacccaattggcaggcaaaatcccatacagatcaaagtattgctcacagttagctcgccacatttgaggactatcaccactaaattgagggcacaacattggcggcacagcaccactgaaccccacagctccaagatcaacatccaattgcttatggccaagatcaagggaatagtgggcatggggaaagagattggaatcgggcgtaccggagaactttggagatgatggccccgaagcggtcccaatcttcccattgccacccgatgtcttctcagtcttgatttgccgctgaagagtgctctcgatcagatccactttggtattcatcgcctggaaagcttctccgatatcctcgaccttcctctccacggctggaattctagattccaccatcttcttgagctccagatactccgccctagtgcgctcatccgccaccacgcgcttcttctcgttctcctccaccattttcagcagcagatccagcttgctgctatcctgcgccatctccgagtctcggtgttagggctagaccaaattccgctaacctaggggaggcaagttgccttttcgcgggattaatccgaagaaaaatcccaatcctccctcaggattttgcagcagaattcggtagaactagcacaacggggatgaggctctgataccagattgttaggttctctcgaattcactcaaatagcacaggattatggcaattatattggttgtattgctccaattcaacagaattgagcctccgccgccttcgcctccaaattgccaaagccgttgttcttcatgttcgtttcagtatttaacgatacaagccaactcccacacgcaactctctctcacgggtacaactcacgcacgccagttgtcacgccacccactttgcgccatggtactttgggttgggcttcttgggccttgctggacgtgtcttctgtgtgtcatcttccttagtctgagtatcctcctcgcgtgccaccagctcgccctcttcagttatctgctcttcttctccatcatcttcagtaagcttttcctcctcttcttcagccagcttctcttcttcttcttcagcgacatcatcgtcaggtggaacaggtggacacctgacactctctcgcctgctaccgtcgtcgccgcctcccctgtgttcccctccgcacgcctccctcctgactacgggcactgttggtgacggcggtggcggctgggtcaggtaaggtgagcacgaggcgtgtgccctctgcctccctcctggccacgggcaccgggcgtcttcggtgaaggccacagcggctgggttggcgaggacgagcagaaggctctggaagaaccggcatctggactgcaatgcaacgcgtcgccggaaatcgggtcaatgcaagtggagcaccattcaagcaactaagaaaagtagtagttgctatgtctgatcatttgcccgtgtctttctgtctttcatcaaaatgttggggtgttggtttctgcaattctgctattgtttaaccaaattagttcctcggacctcagtcttgctaaaagtgatggggtgtatgatgtatcgctcacacagtcacactgggtagactgtttgcagcaatgacaaaggcttatgaattagtatacggcatctttggtgttctgaaatctagaatgtgatgaattgatgtgtaaaaaagattgtgattgtttgtctgaggttcatttctgcaagatatattgggtacaggggtagcagcaatcctgaaagaacacagcattaccacaagtgcagttgtgagcagcgatcatagcagaccatctcttttatttggctttgttcaatatcatcgtttctggacgttcacatttatcatatttccatgttctagagaaaaagacaagcgtgcatggagtttctatgaaaaaaaaggtaaaaagaccgaatgaacgtacagatcttcagaaatgttcagaaacgtgcagtgcaaatgttcagaaatcaacacattgtttgcaggtcttgttgaatttgcacgccaaggctttgaattatgtatgcgctagtgcgatccatggccaaaaagaaagtctagcggaatgtgtttttcgccggcaacaggctgtgaattgcaatcagccaatcacttctatctctagataaccaagctcctctggtcgccggcgtctccggcagagatcttcccagccttgatcgacgccgacgagggggcagctacaaggggaacgatgtggatgaggacgagagagcttaattagaaaggcggcgccgcggcggcgacggcaaatgcggaaggaccgctgctctgcggagccgatagaggcgtgcgagccgaaccgagttagccgacgtctgtgtccaagtcacgccgcctggagccccgcggggagcgccgtccgatccaaatgtaatccacgtggcattcatccgggccagggctccacagccaccggtttgcatccggtctccaccaaaatttttttcctgctacccgctgtgtcccggtttcacggcagcatatcaaacttatccaggccactggttttcggatccaacggtgggtgtatctctagtacacgttaccgtgcatcgcagttgcaggcttgaagtgcaagcagacaggcagagcaattcccacatggagcaaaggaacaggaaaaatcatggtgtaccggccgccgcggccggctctactccctacgtataaaaaactacggacctatttagattgtagccaaaataaatcctatcaaaatttagcaatttaataatattgttaagttttgacaaaatttcttatgtatttttcaaagtttgataaaaaaactaaatggatatatatatttgacaactttatcaaaatttggtaaggttcagtggtggatctagaacttttttttttagccgaggcaaacctaacaatagaaaacaaattaacacgtaaacacaaatacatgtagcattttatcatggatagaagtaaaattgagcgattagttaatgactgagtatgataattagtgctaatctaatggtgcaagtacagctaggctaatggctaagcaccatagttagttctaatgcttgaatgcatgcggcggagcccgggcgtctgcctgtgctggccggaccttggctccgccgctggtaaggtttatttcgtatacaatctaaaccggccctacatcaacctgatcgatgcatgccgtgtgcccatgtgcatcagcgagtttgcgcgagaaacctctaaaatgattttttagggataggtagggagctcctgcaatttcagtatagaagaagagagttgatccagtttataaggaaaatcgaaaaaaaaaacttaaactccataatgttttcgtttgcgtaacccaatcgtacgtctcacgtccgtcaaggtcaggaggaaaccggcacgatcttacgtgaaacagccaaacaggcggctgtacgtgctcggcttgttcgttcggttcgatgcagccagcagccagacctgtgcgcgcaaggttctcacgaaatcctttcgcgatgctgcaggaagacaagcagtgcactagtgaccgtacgtgtggctgtttcgcgtcgccacttgcttgctttcctagctacaacgtgaagttttgtacgctacctatctcctgttgggagacatacttgcatacatgagttacacgctcatactaacgacactattgatatttataaacgaaaaataatttataaataaaatttttatatttgtgttcttagcggtataaaagtaaatgctgaaaaataaactttgataaaaaaacccccaaaatcagctccaaatttaaggttgaaaattcaagaattggctgataaccataagcataaatgaaaagatgacacgcttgctcttccacttgccatcaaaattgttcgacatatccccaacgagcgatcgagaagacaaactccaccaaatactttctttgttttatattataagtcatttgactattttttaagtcaaacttagcaaagtttgactaaggcccagttctttttctcaactcctcgttttccgttaacatgctttttaaattattaaatggtgctttttgacaaaatgtttctacgtagaagttgtctaaggaattcaaataaacccatttttcaattttataataattaatacttaattaatcatatgctaatgagctttctcgttttgcgtgcgctgaaaatctgtctctcaactcagagatcgaaggggcttaagtttatagaaaagtttagcaacatctaaaatatcgatttagtttcactaaatctaacattaaatatgtgggactagctattcagctgtcgacagtttttaatagtgaaaactttcgaattttttgcacctcacaatctgcaatcaatgggccacacgaaacgggtctgaaccaactgaaagcacgaaaccaatccgtttagagcgtgcagacctgttaagaaaccctgaactaacttgtcagggttatgaataccacatacctaatagtagttgactaaatctcggcaggacccaccacataccatgtcctatacagaaacaacttgcggatataggaggagctccggataagaaaagacaaccagagttctacgtggaaacgacaaggactacttggattgtatccatattggtttccctagttctacttggacaaggggacacctatgggtataaatacaagaccccctaggaggagaggggacacggacaacatagacgccacaaagccacaagccaacatacgccaagacaagccgtcggatatcgacatcagagatatgcctggatcgaccctatctggtacctacagaggccggccgtagggatctagcgttgtctatgatctcgctgggcacaaactcgaggaggaaggctaccctgttgtcgactacgagtcagaccttcagaccgccatatcgacaacagttagataggctaccccaaatattgtactggtgtgattatggtgaataagagcaatattggcttcggccaacatgatatagggttattacctgacaatttaagggcccgaacctgtataaaaaccctcgtccccatctcttttacttcagtcttgcatataccttaataccaacgatgtccatactatgcaaataccagaatcgcgacatcaaacgtcgacataacccattttaaattagcacactgtaactagtctataagttctatgtaactgtaatataattaaacttattttgcatagcgcaataaaaaattaatgctctatgtgtagatgataattgacggtgactgtgcaaccaaacaaatatatcacatataagcaacagtgcaaccaaacaaatctctcacgaatcatggcgccagatcgaacggccagaaaatcgaatgtttccggcattcaaaactgttaacagctagctagcaaaaccatgaatatattttgataatatatttgttttgttgaaaatattactatatttttctataaactttgttaaactctaaaaagcttaactaaaatgttaaacaatttataatataaaacggaaaaattactatcttggtcataaaatggtactgatcgatagaatattttttagcataacaaattcggacagtgagtaatattttaggacgaagaaaatactgacacaagtcaaaatccaactcccatcccacctacccagccaccaacaaaccctttttttgcttttttaccatggtagtatcacctaagagcaggtacaatagtaggctataagccagctataaacatattttaaaaagataaaaaaagagagagaaaagcagcgggctacagatctgcagctggctgcagtacggactccaagacataatgtgtgtatgacagatgggaccaggtactaatagtatagtaagcaattattgtataaattagctattacattgactatagatattttggagctcatagtgagctatacgagctcactatgagctctaaggcttcgttcgttcttgggcgatctgggggattgagagagaaaagcatctcgttttccgcgcgcacgcttcccaaactactaaacagtgtgtttttttttaaaaaaaattatataggaaaattgctttaaaaaatcatattaatccatttttgaagtttaaaatagttaatactcaattaatcatatgctaatggctcacctcgtttcgcgtatcttcccaatctccccaatccctttctcctcaaacacaccctaagagcacccacgatggttatctataggctctctacaagatatctatatcagcatattttcctacttgaaagagattaaatgaagaaagagagcaaagctatctactaacttagagatagtctatagagaaaaacgaggcaatgcattagagagctatagatacccatatagacatactattgaggtggtttactattaatctaatctattgctgagatgtacatgttttataaaaagcacattcctttaccattgcgagtgctctagaggaccaacaactctagccagaaatatgaagaggactggacaatgaagccttgcaggccacaggatttccacgcactcgcacaccgtccaccgtgcgtgtactgccgcgcgcttgcacgctgcagcaccaccaccatggctcactcacctaacgccgtcacagttcacgtcgtttctcaagatcaccaaatgttattagatcattcataatgcgcggacgtgtcgttgagcgctaggaacggaatatccgacgtcacgtcctctgtcagcgttgccccgtaaagaacacggagccaaaactgatcacccattcttcggcctgaccgaggggaaaggggcacagctccacgttgtggaggtcggagcctcgccactcgtggctttgcgtaggcgtccacgcaccttttcccctcccgtgctttcctttctctcgtgcaagagcggtggaaaggagaacgagaacggcaggctggcaacacaagatggcagtggaagcgagaacaagcatcgggagagaagaggagcctactagggtctgtctgccgtcgcccacccgcccgccgccgaggccactcaaccacgttgccggcaagccgccaaaccggtgtcgatttctccgccaaatccgccgccaaggccactcaaccacgaaagttggccaggagaggagggccgccggttggggagatgatgaggagcgctggccgtgggaggagacggggttgccgggtgcaccgccccttcgatccgtgtcggtcaagctcgccgaccacgccacccggagctcgctagccgcctgcctctcgccgaccacgcttggactggtgtcgacattggtggagagaggaggggagggggagaggggcgccgccggcgagatagccgaagccggactgccggtgtagggagaggaaaagggagagaggggggaggtgaggggggattttatatatttgtttttttagatttttggggtgttcagtgtgaattttggacctctacacaaattacgaaaaatattagaactaaaacaaaaaatttagggactgaagtataaaaattaaagtcacttctaaagccacttacactgtgacactgtgaaggattaagattttagaccagtgatcttaatttatgtggcactctgagctcctcaaatgagagggacgcatgaatggccttagcaaccaaccaatcctccgccaccaaactcccctacctacccacagccgtcaactcttcaacggcgactcccctatataacacgcacagtcgcgtcgcgtcgcgtcgctcctccagcaacaacgaaccaacggctgagagtagagtacgtgaagttaagtgaagtgaagagacgctttgcattgcagttgccaccgcttcccacgcggccgtcgtcgtcgccatggacctcctcttcgtggagaggctcctcgtcggcctcctcgcagccgccgtggtcgcgatcgccgtgtccaagctccgcggccggaagctccgcctgccacccggccccaccccggtgcccgtcttcggcaactggctgcaggtcggcgacgacctcaaccaccgcaacctggcggcgctggcgcggaggttcggcgacatcttcctcctccggatggggcagcgcaacctggtggtggtctcctcgccgccgctggcgcgggaggtgctccacacgcagggggtggagttcgggtcgcgcacccgcaacgtggtgttcgacatcttcaccggcaaggggcaggacatggtgttcaccgtgtacggcgaccactggcgaaagatgcggcggatcatgacggtgccgttcttcaccggcaaggtggtgcagcggcaccgcgccgggtgggaggccgaggccgcggccgtggtggacggcctccgcgccgaccccgccgccgccgcctgcagctcatgatgtacagcaacgtgtaccgcatcatgttcgaccgccggttcgagagcgcggacgacccgctgttcctccgcctcaaggcgctcaacggcgagcgcagccgcctcgcgcagagcttcgagtacaactacggcgacttcatccccatcctccgccccttcctccgcggctacctcaggatctgcgaggaggtcaaggagacccgcctcaagctcttcaaggacttcttcctcgaggagaggaagtgagtactcctccatgagcgagactccatcaattagccaccagaaatcctctgctcacgtcgcatggtgggtgtttctttcttgtgtgtgtgcaggaagctagcgagcaccaaggccatggacaacaatgggctcaaatgcgccattgatcacatcctggaggcgcagcagaagggggagatcaacgaggacaacgtgctctacattgtcgagaacatcaatgttgccggtacgcgtgcctcggttcagttaacagtttcttcttcttctttttaatttattttcgttaaccatgttgcttgcagcgatcgagacgacgctgtggtcgatggagtgggcgatcgcggagctagggtgaaccacggggagatccaggagaagctgcgccgggagctggacacggtgctcggcccggggcgtcagatcacggagccggacacgcacaggctcccctacctgcaggccgtggtcaaggagacgctccggctgcgcatggccatcccgctgctggtgccgcacatgaacctccgcgacgccgagctcgccgggtacggcatccccgccgagagcaaggtgctcgtcaacgcgtggtacctcgccaacgaccccgggcggtggcggcggccggaggagttccggccggagaggttcctcgaggaggagaggaacgtcgaggccaacggcaacgacttcaggtacctgccgtccggcgccgggcggcggagctgccccggcatcgtcctcgcgctgcccatcctcggcgtcaccatcggccgcctcgtccagaacttcgagctgctgccgccgcccgggaaggacagggtcgacaccaccgagaagggtgggcagttcagcctccacatcctgaagcactccaccattgtcgccaagccgagagcgttctagagtgcacactaactagacagtgaactgcatcgtcttctctgttcctctagaagtatcaaccccattgtttggtttactcgtcgaataagccaaacgatatatatatttgtaaactagaactaatttgtgaataaaatttttatatatatgttattggtgatctaaaagcaaaggctgaaaaataaacttcgataaaaaaaaccctaaaatcgacttcaaatttaaggttgaaaatttaatttttgagtgataaacataaacataaacataagtgaaaagattattgcatcgctagttctctacagaagttccattatcatgtttcatgtataaatcttaccaccatcatcgtcatgtgcttaatgccgggctaaattcttgaaatgatcgtcagtcagaaactttgaaatggccaaactgaaaaatggtactcgtagaatttcttccgcataaaacacctaactcactactgtaatattttgtttcaattagtacattccccaacgttgtaatgggggataaaacgttggatccgctggttacgtacgtacgctacgtgtgtggacgcgcgatgggtgaaagtgactgaaggaggatgaccccgtttttaaattactagaatttccttctgtcttggaattcaaatttccacggtccgcaacactggtttttttttcagattctagcaaagcaactgtggttgtgggcagtctgctttggttgtgatgtttcagtttctgctaaaccacttcttctcttctggttaccctgacttctaaaatgcttgtgatatgtactagttgctacatagaattttcatcgatgcctgaccacatctgttaatcatcacatttcactggccaaatacccgtgctttgctacatattaaaacaaattaatactgaggtttttgggataattttgtacctatggatgttatactgtacatctgaaatatgatagaatatatatttacacggattattttataacattaaagtacatatgtaattggtactttctccgtctctaaatataagagattttgggtagatgtgacatatcctaatactacgaatctgcacatgtattcaaaatcccttatatttagggacaaagggagtagataacatgatggagcatgtggtaaataaaaaaaaagtaaatttcagaaaactgcaactttagtgataaaactatcaatttgttgcaacattagcgacatgtttcagtttgctacaacaatagcgtgtgaaattatcacaaactgtaacttttatgttatatgatgctacagtacaaataggtgacaactgaagcatcatatagatattataatgtacaaatattgaatatgtaaatacctgtgcacttctgatgtatttttaaaccacttattctaagttattttcagtttatttttcaaaatatttaattatcactgtaatgaacgcagttaatccgatcataaatcaatctctagcatggtccgatcaaaagtttagaccttactaaatttttagataacaaaccaaacataatctaaacattataaccataccacaatatgataactctcgggaaaaaatatttattaaaaagtttaccaaaatgtagtaaggtctcaataaaaatgtatatcaaccttccctagtcctttagtattatcaaattttagcaagttttatttgccataaactaaacatgcccaataatttatcaagacaaattgagttttctagtaaaattgtacttttaccaagctcaagagggggagaaggttacattgcaaattgcagtacacacaaacacatacttgaatgtttgacgtttaggataagattcaatcaaaattttaaattttgataatttcttgaatgttcaaatgttcaggaaaaaaagaaataatatatgtggatttgcttcaaactgtaccatatcataatatcataaatctgtatgttagaaatttaaaggtttaatcacatgttttttttctagacattaaatatttctgacaaaaaatactccacgataagtaatcgagagtggcagggacctaagagcaaaggaaatagtggactaaaagtcaattataaaattattatatgaaggagagagataaaggaaaatattgagtgtgggctctcaatgcaagatatgctgtaaaataaaatgcattaaattcatggtgagagaaaagaaaaaggagaaaaatgaaactaaccttataaataacttattatacatgttagctctaatgtgaagttatagttagtgttagctctagtattaaacttgctctaaacaaggttttccctaactcttgcactacctttggtatgcagtagcactgggatagaaaagtttccaatttaataagggcctcagactcagagaccttcatatgcaccctgcacagcaagtttctttgatcaattttttacatcagggtgcctctatatgtgatacacacgtgcatggtaaagtgcaaactttgcaatttgacatgtcaaaacacccacacataatcacttctttgcatgcatgagctgccagcctgtccgtccaataatcatcagaggtaaaataaaatcatcagccaacaaagggcaaaaacgcaaattatttttctccccccgtcttcctcgcctttcctgcaggtaggcccccgccaccgagccctctgttacctccccccttctcctccgcttcacccgacgcctcctcctgcccgcccggatctacctcggcgccgcgtcggcgggcggaacccaccggcggccgcgcggggaggaggcgatcgaaaaaacccgaggggggaatcgcgccgggataatcctagggcagaatgttcaagttcctcaaggaggtggtcgcgggatccggatcgggcctcaaggacttcccctacaccatcggcgagccctacgcctccgcgtggggctcgtggacgcaccaccgcggcacctccaaggtacgctctcctcccttcccctcaccgctcgatcgggggcgcggatcgatttgatagatccccatgagatggggcggcggagatatgcgagagcgtgccgctgattcggttcggtggtggtaagctagtgagtgatccgggtcaagctaagtttgagttggagctgatcgtgcgctgattctaacggcgagtctgagtgggtgctccctgggtacggtttggagctcgtgttaggtcgatattagcttgagtaatacctcaggaagtagaattggtgggctcagtgctgagtttatttgaggctgatctggtttaagggagcctgtgatttctgccagattactgggagttcgtcattgctcactgcacagttgcatgccatctggtaatagtgaggaccttactgatgtcagcacttagtcattagatttttttttttggctgtggaattagattattcgtgaggtttccttcatggttagtgatgttattgatttcagttggtggtaattgagcatccaaataaaagttatttttgatgttgttgcattgggatgctggagattgtgtcaggttttatcttttgttgactagtgggggcatgccttgtgcatgcgtgttctgcaaatggtgctgtagattagcacactctgatgatatatgtgacattggaggcctcatactgatgcttatgtcgattggagatcatggctcattcaactagggatgatcagatgtctaattatgcctaatgtacctgtgtttgggtggctgttaatggactaaaagaccaataatccatttctttttggcagttatggatgacctttcagggtgcaatgatctaagtcaagatggattgtatgtaacttatagtggcctttgtgtagttcaatatagagatgtgtagaacattcatgcgtcaattttaccacccagatggttgtgatgtgatgttgatcaaaattaggaggtctgttaagtgtgttatctggttccatttctttttcgcaagctttgatttatttgcgcagcatactcttttcccccaaatgattacatattgcattaattttacaacatatgtatatgatgctatcaacataattgttgccttgtcttttctgcaggatgatgggtcgcccgtgtcaatcttttctctgtcagggagcaatcctcaggacaggcacttggttgctggtcggaatggtgttaagagattacgaacagtaagttactaatgttgatcttaaatatttgtaatgtctacttgtactgcaagtgtcttattttaacagatgagaatggagtctatggtgatatactattgagttctagaagggtacaacaaaaacaaggaaaaaaatctgcacagagaagattcaataatggtggcattatatcatgccatattggcatttttttaaaaccaaaggccctttgacccagctttataagaaagccaaaaggttcttgcaacaatagattttggtttttgctgggatttccagcttacattaaagagtaggcaggaaattccatctgggcattagccattaggtacgaggttatgcatgccggtccacttttttggcatctcgcattaaattttctcagtgacttgcttctagtggacatctttacttaaatatcactttgtagtgcaattgagttttgcttttgtcatcggtttcattggacttctttactctcaatatgacacctgctaagttagttcagtgttattgacctgctgcacttattgcaggtgcgtcatccaaacattttatcctttcttcacagtactgaagcagaagttcctgatggacctgccatgaagcatacaatttatattgtaacagagcctgttacgccactttcagaaaagcttaaggaactgaacctgggaggcacacagaggtattatgagcttcccctatcctttggtgtttaacattatgacatatatatttgtgcagatatggagtacggttgctgcttaatttagtgtgagcaatatgttttttttgcttaatagtctagaactattggggctaatcaattctagtgcactagtcttgtcagagttggcagtttgcatgtttactgcaccatattgccagtagctatttctcgagagcaaaatttcatattgctcagtttttgtttacaatcatatttattctcactattgctgataaattatgggccagagatgagtactttgcttggggtcttcaccagatatcaaaagctgtgagctttctcaacaacgactgcaagcttgtaagccctccccccccctctctctctctctcacacacacacacactctctctctctctctctctctctctctcaaacggagtacaatcgcataatgcaagctgttgatgtggctactacttatctcacagaacttttcaatttccatcacaacaaaattatttctggtgggcataatttgctcatttttaaaattttaaaaatatcaatttatatttagtataagttacccttggaattagattgcacaaccaaattatcgtcaggatcttcttgtttacatgccaaattcttttttatccagatgagaaaagtatcacaatcagccagcttatactgtgtcatttcttcttgaccatttgatttcagaatttgtacttgtataactttgttgatatgatgttttactcttattttgttaatggcggataatgaacaatagtcaatataaatgcatgttcttatttgtgcaaagtcatgtaatgacacacgaaaacaatgtatgttggaagttctttggtcataaaatttgaaattgtcatcatcaatttcaggttcacgggaatgtatgcgtgacgagcgtagttgttactcaaactctagattggaagcttcatgcttttgatgttctttctgaatttgatgctaacaacgaagcctctaatagccccatgttggtatggtctcttaatcacagtcccgcacctttatatatagatatagaactattacaactctcttttggacatgtttggtgaatgtactgaaacaaatgcttttacaccgtgcttgtcatgttatcgtatgtcgagtttccattgtttctagaaagtaagaattggtactctttaatatcagggaaattcaacatgatagagggagatatataccatacttctttttacatacttatgttcctttgcagcaatttgaatggttagttggaacacaatataagccaatggagctaacaaagtcagattgggtgtcaattaggaaatcacctccatgggcaattgattcctggggactgggtaagcagagctaactccttttccttcattacattcttgtttgattgttctgtttccataattttacaattcggaaactgttcaacagttccttgtcggatgtgcactcggcattattgtactttaattgcaaaagttgtttattttctttaaatggatatctctctatgggcctgtatcgtagtttcaaatcttttatggtaaatactataaagttttgcactatagaccaggtcaagatcgaccaagaaaagacatgtctagagtcaaattaataaactatggttacctgaattcctttgttatttgcattttgcttttgtttgctttgctgcatatagactctctttaatattatttccagaatgatgaaatattgataataaatggcacccagcggaggatatatttttcgaattagagaatccattgtttgtaatcaacaagaaaaaaaatgggaaagtaagacaatctaaaggcaaaacacacagagaatagtcatatgttactaagctgaatctctttcacataatcacattcaaggagcacctgaaagtttcttatagcagtatttaacagtaaaaatggtttttagactcatctccaaaaatattgatctctggactcattgcagggtgtttaatttatgagctcttttctggtgcaaagctaaccaggacagaggaccttcggaacactgcttcaatcccaaaggttagtttgcacgatcatggtcctgaatctgtctctatttagctattgattttttttgttggtaatttttgtattgcttctccactgtttgaagtctgtaatgtagagcattatgctgactaatctatacattgttcatgcgtatcataaagttgttggtttccttctattttgctgcagtctttacttccagattaccagaggctcttgagttctgccccttctcgtagaatgaacccttctaaacttattgacaacagtggtaagttcaacatatttttctctcatcatttcaggaattactttttgtatttcgacacttattacatcgacgcccataaccttctacttttgctcttaatgctgtaattctatgtcaattatttggattactttaaataagctgcagtgacaattgtggttcttcattttcagagtttttccagaacaagttagtagagaccatacagttcatggaagttcttaacttaaaggacagtgttgagaaagatagctttttccgtaaactaccgaacatagctgagcagcttcctcgtgagatagtcctgaaaaaggtaatgttcaagtcatgaatagaacccattattcccccggttcttgtttatatgcttatcggttggttactctgtcaatagttgctccctgtgctggcatctgctcttgagtttggttcagctgctgcaccagccttggttgtattgttgaagatgggttcctggcttccagctgaccaatttagtgcaaaggtttgacttcatttctttcgttttcacccaatattcgttagtcattccagtaaatgtgtgttacgatgttataacacaagttaaaaccactggcattttcaggttttgcctacaattgtgaagctttttgcctctaatgaccgagctatccgagttagccttttgcagcacatagatcagtttggggagtcattgacagctcaaactgttgatgagcaagtatgctatcatttcctgtatggacatctgcatgtgtttctggaatgttgatgcttgacaggataaatatctctaatgcaggttttcccccatgttgccactgggttctctgatacttctgcttttcttcgtgaactgaccttgaagtctatgcttgtattggcacccaaagtaagaccctcccaaccctctgcatgatcaacatttgcaccccgaacaaaatccttgtggatgtctttcatttttactgattgtgctgtgttaacagttttctttttaaaaagtgttctaaatttatctatcgctctctctggttgtgtgcacagcgggcttttaaagaaaaaaaaatcctgggattgcaaatttctgtggtattattttttcaggaagattattgcttctttatgactaattcaccaatctgttactgtagttatctcagcgtacgatttcaggatctctcttgaagtatctatctaagctccaggtgatgttctgttctaactgaaatgcctcagatggactcagtttgacatgtgaaggtatacaatttagttaaaagtaaaaaaaatcattgttatctgtgttcaggttgatgaagaacctgcgatcaggacaaacactacaattcttcttggaaatattgcaaactacatgaatgatggggtatgtcctttttattgcttttttactaattttccttgaaatttcactgtagcaagctgactttaagataggtagccagtatatctggatttctgaccagcaagtttctcaattatttaaaatccacatgttttttgtaccatttatctccatggtctgtgataaactttgttaaaaactggctggttactggagattactgatcatagtgatcctggctagtataaggccaaggaaatgcataaatgcatgatagtaaagaaagaaagacaagaggaaataataatcacctgaaaattactagaaaatatgtttttgagttttgacccaaagaaagcaacacaaatatatcctggagttctccattcccttgcctagatatcgagttcattttctgtttgtactaaataagtaaatagtcattcctaacaatgtttggctattttgacagactaggaaaagggtattgatcaacgcatttactgtccgtgcattacgtgataccttcccccctgctcgagcagctggtacattgccctgtagagttgttctgttttactacttacaatgctatatcgtactaattattgacaagtaagtattgctttaccatttgtctggcaggcatcatggcgctaagtgtcactagttcatactatgaaatgacagagattgcaactcgtattctgcctaacgttgttgtcctcacatttgatccagataggtataacatacagcatttagctctcagtctctactttctcattgttgcttgttgtaacaagcaattaaaggctcagagatctgttagtttgatagaatagattattgtctcactaaccactagtagttatatccaagtaaaattcaaatggttggtaccctttccaacatgaatcatagcaccattgctcaatgttttgcatatgctagtagctatcagtctgatttgactttttttcttagaagcaagctttgcttattaactttctggcctaactgtcattgcacgattcattagcatatggtttccagaactaagacatctttgtgcattagatgtacccatgcacaattgatcgaaaaaatgtcctgtatggatatattataaaagttgatatggattgaaatatgaagtttaacagacaagacagttaaaactaacatgggagatttttgcattgacaatactactttctttaagttataactgtacgatgcatcttattttggtctttcaactaaggcatccaatggttttgtagtgatgtgaggaccaaggctttccaggctactgatcaattcttgcaaatagcaaaacaacatcatgaaaaggtatgcacatttagtcatacagtttatttgcttataatatatccactattctggaccgtttgttacactactggtttgctctagatggcatgctaacacaatgcatgtgtgttatgaccataatatgttggtagataacttactgtcactgtaaaatatcttttgtttttcattttcttttgctactaattgtatcataggttttagatatgccattacttttatccggttgtcatttctccactagtttagaaatgccagacgacttccaatggttttggctgttagaacaatgtcaaaagtctgaaaaaatacctcctctggcacatagagctataccccacatcctttttgcaacactagtctaaatactccaatctgtgttcatatatttttcatggctttggcactgtacacttgttgcttcaatttattgacatagcttcatacttacacttattgtagcttactatgggagacaacagcgcagccgaagctactggtatccagttaaagcctggaaatgctggtttacttgggtatgttgcctatgttccaatcactatatgcttgtttcatttcttgatattggagcctcatagatttataggctatcctctatcttacatgtcaatagaaataaatatttctttaagttgattgtcttgatttgatccagtcgtttttctaattactatttgaatactgggacaattatagtgaagtttctcatcctatcactaatacatttggctgcctcgtataggatgtgcatatggccagccttatataataaatggcttggtaacctctctaatactccctccgtactcgtaaaggaagtcgttttggacagcgacacggtctccaaaacacaactttgacctcttgtttctataaaaatatttattgaaaagtgatatatgtatacttctatgaaagtatttttcaagacaaatctattcatataatttttacattttcaaactcaacaacttgagagttattcatgatttatattcccaaggtttgacttaaacattgtcctaaacgacttcctttacaagtacggagggagcatttgataataataaataggaagctccttctctaagaatatcccttcctgcgtcatagatttgtatctttaggtcacagtacaacatttttttatgcttctctcttacacatgctgatgctttatagacatttatgctaccttccttttttatgactatttttcataatgtcttgtcctaagttctgatgcttcgtttacaagcaaatagaatctgttatgtatgatcctgaggtccatggttgtcaccggccattgttcttgttgaacaccaagttttggaggggccaatttgtcaaatattctgtgctgtgctgtgggatcccatttcatgggccctgtaatgtaggtttttctctagtcagtatatacaaaagaagaaaagaaaattgtaggtaaattcgtttctagttagccatcagccaaaggaattcataatttgtttacgtgtgtggaagtcatcttatgcttttgcagtttattatgatcctgtatgcaattgaattacttattagaaacatatccatgtacaggtgggctatgagttctcttactcagaagggaaaaggttctgaccatggtccggtttctagtgcaaatgctagcaactctcaaatttcagcaacctccagtgtcacatcaggtattagactttttttcaaattgctctaatcatgagtattaagctcagttttcatcactagatagggatcacgggctataaatgaaagaggaaaaatgtaaatatcttaaaagaggattaacaaagtatatgacgtgttacagttgaatgtgagctcttatcatttgtcaattctactgtcacagataatagatcttccaccgtagcatatgcaccatccacttctagctctcttgatcaaactgcaccagcatcagcaaggtcctcggtggatgggtggggtgaaattgaaaacgataatactcaggaagagaatggtagtgataaagaaggatgggatgatgtagatccgtttgacgagaagcctccaccatctcttctctctaacatacaggctgctcagaaacgtcctgtggcgcaaccaaaacaaccaggtaggctttgtttttgttactgtatctgttatatacacatatttgctaaaagagctgaaaataatgccattactttcttttatttattcaaatttgtcaactgtagtatcaaattcgtcaagattaaatcaaccaaaggtgcccaaaccagaagaggatcctctatggggttctatagctgctccagcacccaaaaatgcatcgaagtcttcagacatcaaaccttcaacgtcgcacaatgatgacgatgacctctggggttcgatagctgcacctccaccgaaatcagctgggaagcccttgaagccaccagcagcagcaaacagtgacgatttatggggtgccatcgctgcacccccaccatcaaccaaagctagacctctagcttcatcaggtaggggtcgaggaacaaagccagctcagccaaagcttggcgcacaaagaataggcaggacgtcttcaactgggatgtgaagcgccatcgtcatacaagtgttgtacaaggatgaatttttcttttctttttttttctttcgctttctgtcgagaatattcccattttgtaaactagcccaatcatttatatggacatgattatgcccaatgtattatttcacaattgtgtattacgatagcttcaggatatatgtacatcacaggagtgaccttcaattgttttcatcaatatattggttttgccttttgttctatctccagttcgctatcccagttgtgttggggccttgggggtggaacagataaagcagtttctacagttctctctgctattaaattatcgagcttaaagtcattctttatcaaatgtttatgctatcggcagccatgtg

SEQ ID NO: 78199 - DNA, 59821 bp, Oryza sativa
tttatttttttaaaatttatggtgtagtaggaagagaaggagaggatgaagtaagtagagaagtgtataggggagataggggggtgatcgcctatggcggtcacccgcccattagccggccccacattcaagacatcatgtgagataagtcacattaaatttaagtatgtaatagtggtgtttatattggaagagtggtgcctaatactagtttcttgatgatgtggagtttatggaaactatgtctaatgtcttgggttaggaatggtcttactatactactccctccatcccataatatatgggattttgaatttttatttgcattgtttgatcactcgtcttattcaaaaaaaaatttgtgcaaatataaaaaacaaaaagttgtgtttaaagtactttggataataaaataagtaaaataaataaataataattccaaaaaaaattaataagatgagtggtcaaacagtgtaagaaaaaactcaaaatcccttatattatgggacggaggaagtattaatatcttcgtgctgtaactggctacagatctgtagcctgctgctcttttatttcctcttttatctctttaaaatatatttatagttggtttatattctgctatggtacctgccctaaaccttgccacacgaaaacagtagctgagcagaacatgacaaagcaagagcacaatgctggaaagatggtgccaatccccaaaaaacaagattgattcccccgcagcttctgcacaccataacatcaatcagataatcacccttgggtttagctactgagctcgttgtcaccatttgccgcaacgtctgcaccactgccttgcgtatcgccactggtctccatcactgcctgcgcgggtgggatcatctcaccgtccataccgagttttatgtcaccgacaacgccatccccctctcctccacccaccgataccggcactactcccgtcgcagccgtcgatgccgcgccgccctccacatcgccgccgtccatcgccttctcgtagaagacgccgccgccgtcctcgacgtcgtacaggttccccgtgcgcacctcctgcgcgagcgcgcacggccagcagaagagccaccgcgcgtagtccgtcagcgacgccgagccgcagcaccaccggctccccggcagcgcgaacctcttccgcatctggaccctccagaacccgccgtacagcaggccgaggaagcacagcgcgatccccgcggcgcccacggcgtcgctcaggtcgtagtcgtggatgtggagcgccgtgatgttgaatacccagaagggcgcgacgcagagcagcaggaacatggcggtgtggacgtacatgttgccgaacccgagccgctccatgttccagccgaacacgcagaaggtgcacagcgacgagaggcagcacgccgcggggtcctcgccgcagtcgaggaggccgcccgcccacacggggtcgacgaccaccgttctcgttccgggcagctcggcttcgatcatgtgctgctgctgctgcttggcttcctcgccggaggcatcgtcgtctgtgtccctgcctagagggctgtacaccgtgtacgctccggcgacgacgggcgcgacgacgccgaggacgaagaagaaattgtcggcgaattcggatcgcgatctgctgcggtaagcccagtagaggttgcaaaccacgtactgagaaatgcaagtgacatggaggagagccaccacgacggacatgtgcgcccgttcgccgggacggcggtcgccattcttgcagtacaccttccggagctccgcggcgtcctccggccgccatcggcagagaagaacgaggtggtggatcaggctgggatgctggtatatgctcatgagcgtgaagagcgcgttaaggatctggttgtcgatctctatccagtgatgcctcaatggcttggaagggaaggccctgttcagcaatcctagcaggagcaggatcaacatgccaccagctgcagcgacgcagagcagccatgccaggagagcaatgttcagagggtgcttgagccagttcttgcagaagctgaacaccgagctccagttgattcttctgacgaagtgaacctcgacatggaggtaccggcggacgccggtagatggcagccggaaattcgtcagtggagaacagaggttgatattctttagccactccaccgagggagtggctctgaggcaatccaggagtctcctctcgtgatgaacagatccttgcattgatccatcatgaagagcaggaactgtgatatgatattcagtcaaaattggtgaggtttgatcagagtaaggtgtgcctgccatgtcgtcttcaggaaaattctgaaccatttttctctgtttaactgaaactctgaacaaacaggtatttcttcttcagcctaaaaagcagaaggcacacataacttaagaattcgcccccaaatcgccaaatccaacagtcacaaatttatcccccaaagccaaagaacagggttatgcatgaactgggaccgaagacataataagtcacaagtgaacatacctcacagatgtacaggacaagtcaatcgggcgaaaagcagctcaattcctccaaacaggctcaaacttctgaagaactggagatgtggagaactcttgaggtaggggaaagtagcagtctgctaaactgcacttcgattctttaaaatctcacgactttcgcttgccaggacatttgacttgggcgccaactaaatacagccttgtcatcttcccaagttgtagcagagctgcatcgaagtcgtgtgcacgaagttgagctgcatcgaagtcgtgtgcacgaacaaagcaagcagggatcacagttcacacatcagaaatctgaattgatgttatgctgtgcgcctgtgccccgggatccatagagtaccaaagcagtcaagcttggaggcatgtcagtgtactcgtgtatacgcgatgccatcaataaatcataaatcaagcggttttccttggtcagatgaaggcggcgagcgttgaattctcaaaccaggtcgtcgtcctcgctgggtctctttgaagcctccgcgagaggcgggcaagcagcagtgcagcacaacgggattgaccacggtggggagagggcagccggcagtgtctctccatgacgataggttccgtggattttttcaacaaaaaaaaaggagaaaaaagaaaccttccgaatacgccggtaggttgacggagatggaagaaacggagaaagactagagagggtttggcctgaaggcacgcgcagccccgcagctctgctctccaacaatatactccgccggccgcggatctcgtcggccgacgaggcgacgtggcgtcggacttgcggcctcgagggtttccccagtggagagccaaaccgcaaaggagaggcgaacgggaggaagacggaaaggttttcactagtagtagtactactttccaggggtagattagtttaccatgggtctagaagtaggcccaactccatgtaaaccactcagcctaaataaaggcccaagcaggcgaactctcaggcttgttctcttgccgaattgtaaagcccaattggtcttaattgacccacttagggcccctttaatcataggattgagaaaacgtaggaataagaaaaacgtatgattttgataggaatgtaagtataaaacagaggattgcaaacacaggaattaccgtttgattgaaccacaggaaaaacacaggaattggatgagagagatagactcaaaggaaagttagcaagaggttaaaactcttgctaaatttcctctaaaatctctataggattatccattccataggaatttcaaaggattggatagaattcaatcatttgtttcaaaggacttcatagaaaatttttctataggattaaaatcctctaaaattgctatatttttttttccaaatcaaaggggccctcagtaggcaaattgttcgtccatgctgtagtttgtggagaaagggggtgcgtagtttgtggagaaagggatgcggtagatttaccaggtttgtcatctcggtgtaaaaaaaataagtttgtcttctcactttggagagtttagaaaggaaaagcaaacatctacgtcgaccccatggatccatggattcaacggcggatattgtgtccggcgcctgtcatgttgctagattccagcaagcaagccagtggtatggatccgttaggctggccgactggccaatcgttgggcatagcaaatcagcacgccgctgctaaaaagggtcccgcttcattgtatcatcgcaaaatcaggaatcggggccgtgttcccgtccaagtacagcacctgaaacactagcttcctctctccgctctgtaatcacatcagtcctttctgtcgcgtagtacgcctcccacgcggaattaccatattaggccccgttaccagctgctgcttctacagcgatcatcattagcgcgtaaggatatgggcgtaattttcaccggattaaggaagcataggttcaagtggtactaatttaggtggtgccaacgagcgccatccacacgcctgaaatccccaccgaaaatgacgccgccggcgagcacgggcaagtgcaccggcgccgccgccggcgaggtggaggagccgctgctgccggagttctctggcggcgggcatggggcgtcggtctccggcgcggtgttcaacgtgtcgacgagcatcatcggcgccggaatcatgtcaatcccggcggcaatgcgggtgctcggtgtgctccccgcgctcctcctcatcgccaccgtcgccgcgctgtccgacgcctccgtggaattcatgctgcggtacacgggctgggacagcggcccgccgtcgtacgccgggatcatgggcgacgcgttcggccgcgccggcgccaaggcgctcaatgtctgcatcgccttcaccaccacgggcaccctcgtcgtctacctcatcatcatcggtgagcccacgccgtcgaggacgcgctgctctgcagctctgggatacatccgaattgcatgcggggagaaaatattgaattaaccgcgtcgagcatcttggtcgccgtcgcaggggatgtgctgtctgggagcgcaggagcaggagacgagcacgccggtgttctgcaggagctgttcggagcgcagtggtggacggcgagggagctcgtcatactggtcacggccatcgtcgttctgctcccgctcgtgctccgccgccgcgtcggtgagttgctctcgaatacaacctgatgcacttaattagtatttattaattgctactctaaaatagcttgattagtttaattgctactctaaacgtacttcatccgtttcatactaaactaagaatatttttattcaaactttattaagtttaataaaatctatagaacaaatttgacaatatctaaaacatcaaattagtgttattgaatatattttgataatatatttgtttaatgttaaagatgctactatatatttttttataaagccaaaaacttatgacatagaaagtaattaagctagtgctgagttgtaaatttgagttctcgagcggtgttcgacacgagtagttgagccacccgaattatttgggacatggagatggagtggctcattgtggacgtcggattgcgctcgtgcacagggtttatctcagctaccgattgagtcctctaaacgctttaacaaaaatccaatttgtcgaactacggaaacagcacataatggtggtgatttttcctcgatttccattaccatgactaaacggtatattttatttaaaaaaattgaccaaatggtatattttgtgaaaaaaatttatgtagaagttatttaattaaaaaaattaaataaacctatttttaaatttataataattaaaagtcaagtaactatgtgctaatggctctctcattttacatgctctaactttatctttatagtagaaaatatgacacccacgttgacgtgtcaactatttagccagtgtgcgctagttagagttacttttagaatgcatgaaagacataatatattactccctccgtcctacaatagttgtcattctaggttgtttaggatagattaagatttaataaaaaactataataccccttattaaataatgtatggtggtaagtgaaatgattattgagggtaaaaagggaaaacttttgaatagaaagtgattgatgggacaacttagtactccatagtgaccagtattttgggacaaaatttaaatcctaaagagacaagtattctgggacggaggtagtattagccaaaaattgttgacgtgttttttttaacgatcgatttgtcagccatcagattcacgtcacgaatagcaaatgtgagttacatataaataactatattatagatacactacaattatactacaaccgcgtttgaaagtttagccctatatttgaaaggatattcttctatcaacaatcgttgtagcagagtcttgcacttatgaaaatgaaaaacatcatattttccatcaacgtcttttttaaaaaaaattcatagtttttcatcaaattcatgaaattcagaagatatacgtattagttaggtcatgaaggaatatacttatcatcgtactacctccgttttttaatagatgacgccgttgactttttctcacatgtttgaccattcgtcttattcaaaaaattacgtaattaaatcacacttaaaatactatgattgataaaacaactcatgataaaataaattataattatgtaaattttttgaataagacgaatagtcaaacatgtgaaaaaaaaagtcaacggtgtcatctattaaaaaaacggagagagtattagttaggtcatgaaggaatatacttatgatgatgttcttgctggatgaacacaacatccaccaatcgatatcctcttttactatttttctgatggaaagattaattgaaaggaggagaagaatggtttggaaggttctggatttggtctaataggataatctcttttttctagattttttatgaacggatttgctagtttactgtcgacagtaaacgaggggaaaaaatgtcgaatttttgactgtttttgtctgtcggattcgcctcaagattagtgctggcacgttcgtgtaaaaaatccatgcgataactaaatttgtgtgctgcatggggttcgaacctaggacctcaatcccactagctatgcgtggtagccacttcatctcattaaagttttctaaaaagtttgcaagttatagttagttatactccagttacaccctagttacattgtaactatattgttatctctatataaattatatataaagttgcatatattatttgaatacatatatacaagttattattattatatattattttaatacatatatacaagttattattattatagtatatagttctagtgaaattatatactgtagctagatttgaaaattttcccctaaaaaaacactcgacagttttttttagctaatcccttttatgaataacttggagatttatttaaaaaattactatgccacatggttgtggcacgagcgactagcagtaaaaaccatcagctttagtaagatagatagataggataatatatttttctcaaattttttataaataacttggagatttattttaaaagctactgtgccacgtgtggcgcgagcagctagtggtaaaaaccatcagcttggggctgtttggatggagctaaaatatttttagtccctgtcacatacgatgtttagatactaattagaaatattaaacgtagactaatgacaaaatacattccataaccctagattaattagcgagatgaatctattgagcctaattaatccataatgtgctaattatagattaattaggcttaaaaaattatctcgcgaattagcactcatttatgtaattagttttgtaagtagtatatgtttaatagactaaattagtatcaaatatctgatgtgacagagatttttagttcccagatctaaacaccctcttaaagtttagttcgtggatcaaacacctccttaataagatagctagatagtttctatttcatccatctgccgttgagtccggaaggccgaaagagcgttatcttgggcctcgatctcatgtggaccctgagacccatttacacatccctttcaaccatgtgcaccaaatgtgcaatattgccatagtgcccataaacaaggatatcattgcctcgtcggattgttgcacgcggaccacgaggctggcccagttgtcagccactcgcccaccagtccggactaaattaaaaaccctatcgtccttcgaagttcgcagcgccacgccacaataatttggtcgctgagctccgttcacccatctgactaggctcttatcacaagcacactcatcgcccctcctgtcgttttcccgcgccacgtttccacgctctcgagccgccgattccaaagaaacgcgcaccaaactctcgtctagctccccgcttaacgtatcaacaccatggtgtccaagaagacctccatcgccgccgccgccgccgccgccggcgacagcggggcagcagaaacgtccctgctgccagagcgttacgccggagcggggacgccagccgcagccgcgtcggtgctcggcgcggtgttcaacgtgtcgacgagcgtcgtgggcgccgggatcatgtcgatcccggcggccatgcgggtgctcggcgtggcgccgacggtggcgctcgtggtcggcgtcgcgctcctggccaacgccgccgtggacttcatgctccggtacacccgcgggccgtcgtcgtacgccgcgctgatgggcgacgcgttcggccgcgccggggccgcgctgctcaacgtcttcgtcgccttcaacgccatcgggaccctcaccgtgtacctcatcatcatcggtaacgcaccacagcatatctccccccgagccgtacacccagcgaacctgcagcgctggtcgccgcgtgcagacgagtgatatttccggggattttggtgtgagtgttcctgcaggcgacgtgatgtccggcacgacgagcgacgggaaggtgcacgacggggtgctgacggagtggttcgggcagcaatggtggacagggcgggaggcggtgctggtggcagccgcggtgctcctcctccctcttgtgctccggaagcgtgtcggtacgtaagggagcccgcgatgattgttgtttctcattaggaccgacgagcagactctagatccagtgccccaaactaaaccgcattttcagtcatttggtcgaattctaaattcccatttccggaccaatttccactacgatttggcaaaactggacggtgtcgtatagtagtatatgaattttgcaaggttagaatgccttatgaatttgggaggagctacgacatttgaaaaatacctgaataccgtagtccctgaagtcataccctttaatttgctgtgacctgtgactaattgcagattcactgaagttcacatcagccgtgtccatcctactggcagtggtgttcatgttcatcagcctgggcatcgcggtgtacgccctcttcaccggcacagcgaagatgccgcggatgctgccggatttctcgcgcctctcctctccgttcgagctcttcaccgccgtccccatagtcgtcgtcgccttcaccttccacttcaacggtatcacatcgatcgcgccattgttaacactacaccatctttttctcgagactgaattatctgccttgcatctggcagtgcacccgatccgaacggagctaagcaagacgtcggacatgaaggcggccgtgcgcatctccctcgtgctctgcgcggccatctacgcggcggtggggttcttcggcttcctcctcttcggcgacgccaccatggcggacgtgctcgccaacttcgaccgcagctccggcgccggggtcccgcaggcgctgaacgacgcggcgcgcctcagctacgcgctgcacctcgtgctcgtcttcccgctgctccacttctcgctccgcgtcaacgtcgacgagctcctgttcccggggcggcggccgctggccacggacacgcgccggttcgtggcgctcacggccgtgctcatggcggtgctctacgcgctcgccatcgccatccccagcatctggacgctcttcgagtactccgggtcaacattcgccgtctgcatctcgttgatcttccccggcgccatcgttctcaggcacgccatcagatcaccaccatggcatcatacaattctcatcgcttaacgcttggttacagttgtcatgtaatgctacaatttttttgcagggatgctcatgggatagcaaagacgaaggacaaggcattggcagcgacgatgatcgctctggccgtgatcacgagcagcatcgccatcgcctccaacgtcatgagctccatcagcggcaaggtggaaggaggccatgccgcaggtaggtagcatgtggtatattggtttgctgtccgacagcatcaagattcaaggctactgcccctgtagcgttcctctgttttacattttttttaaaaaaaaggaaaaaaaacttgcagggattgactcgtaacaatgtatacttgtgtgttgtaaggatttagcggcgagtcattgttgtatacttttacaggagatgcattatcgtgtataatgtgatatagaataaggaatagtgccttcagagaaaacggttggccctcatcagttaaaaggtaaacctatatgatccattgaattgagagttggagatcggcaagaagaaagaacatgaataatggatcaaagtagagttgcctgcttgaattatggagtgtgaaatctgcttaatgcaactcattcacgtgtttgaatctcggcagtacgttccacatgctgactgttttttttttttttgagacatgctgacagtattgcattttaggcgaatgcaaggccggacttatgtccatgttctgaggctgaaagtatagaaaggcccatctcaacttttcaagcagtcttggcctgctacggcattacggcccataaggcctaaagctcagccatcagattcagcaagcacttttatagaccgacaaatagctgtcacagctctatcagtgtcctccaaaagcaacaactccgacttgaaaggtcagactccatacatctattccgagtcctgcctcgtaagaactttcgcattgcaattgataatgttgcgttgctaaaattgttcattatcattagcgatcttttgaatctgctgctgtcaacaagtggttggacgcacgcaacatctgtagtttatacgacgcccatgacgagatgtacggtgtaccaaaccccaagcaagtggctccaggtggaaacctcccatccaaccactccaaatatactaacaacttttagtctcacgattttatcctaaaatataacaattttcttaccaacattctcttccatatccaccattcacttttttcacttatcttcacaactcatctaataacaaatctccatcactcacttctacctactttcttaataatcatatccaattctaaaacttcttatattctaggacaaagaagtacttggggacctttgaaattataatgcaaatagtagcattggcctgctcatttgtgctcaacagtatctaatatatttttaaccttattttaaaattaatttagctttatttcacgttctaactttggctttagaagtatataagtttttccttaaaattgttttcgttagatgggatacgtgtctttgcttaaaaaccacagccccaaaataccttccaagcaggcccacagagtaccgagggtaatttgtacttcgcaaagtgcatcatatcggagctaaccactatttatggataaaaatatattatactccagccaaatatacatacttgctcccaaagtatcattggtgagtgattttatagtcggaaggaagattttttttaatatagaatctggtactctctgtagctcacgtatcacgacatatcaaaaattacttaaataaaaatgcggattgtctcacgtaactttacttgggattaggtaaaaatagaattaaatttggtatacaaatttcatacatctctatctctatctcttctctctactattataaaaattatgtttttgccggtattttagtacgtcatccgtatttgagtcggtttttatgtttgttcgcttttagaaatacaaatctgtatttaagtcagattttaaattcgtttgcttgtgaacatataaaagcattttaagttcggattttaatttcataaatattcaacaattaaaactagatttgatatacaactgtttgtttgttccctatatatatgattgtatttcctatacaatagttttgaaaagtatagttggttgtcatgtataactctcaacctctatttcacatacataaaattgtattctttatacaattactcaatcgatcagtgccttttacctttttcgattattaatacgaaaatttgtcagcactgttagttttcttcaggctggagtctgtgaatctgacgaaaaacagagaaaaacaagccaatgaaagaagaaaaactcctggactcgttgaccaaaacctaatacggagtggtactattaatctctctcccaatccttggcccgtgaggtcgtgacacgccacgtcacgcttgggaccacccgtcgtgacggagacaaattgttaatcccgcacgcctgcttccgcggcgctaaacggacagcacggattaacccctacctcccccccccccccccccgcgctaaactcagcggtttacgagtagtagtttattcgctcgtctcctcgggggagtccaaaccctaggctcttcctccccagcgatgcacccggcgggggcggtggtggcgccggcggcgggcgcgcccgctcgggcggcgccgcgggtggagaaggcgacaagccacctgctcatggggcccgactgggccgtcaacctcgaaatctgcgacatcatcaacgccgacgtctggtgatcacctgctgtctctctcacctcaactccgccgcgtcgttgctcccgattttgccctgttcggtgtacggcttcctgcgtgtgagattggatgtttagtggaaaaatttcggtattcgattagggtctattgggtgttccgacgggttaaattagttagttgattcattgtttggggcaaattttggtcgactttggtattcgggtaagacggccgtgtacgcatatttgaagtagagtcgagatggtttcaaggccctggtttcgcgattcgatgctttttgtggtgaataggatgccattcaacttagccttcaacgtgtgcgtggattttgccctctcccaactcccaggctacctgagagctcttttgataattacctgcacttgcaaaggggatggctttgactctaatctgaagaaagcaattggagtgagggaactcatatagggccatagataggtcgatagtatgaaataaactagcttatttttctactccaagtaattatctccttaacaagctaatatttgtgaattcttatcaggcaaacaaaggatgtggtaaaggcagtgaagaagcgactacagaacaaagacccaaaagttcagttctatgctttgacggtatgttcttttgttatgtaatgatggatgcagtgttttcttggctacataatttttcatctttgaacagaatacaaattttatttcacaaaaaagtaaaggagaaagttccctgaatactctcttacccaacaatctgaagttgttgtttgtctgatgtatttagtttgaaatttgttgcagctcttggagactatgatgaagaattgtggtgaatatgttcaacttgaagttgctgagcaacatgttctgcaagaaatggtgaaaatcatccagaagaaggtccctttactcccctcctcactactaattacttgctcttctgaattcctaattttgtgcacatggtgattttctcagttgtttttttaatcatatgcattcttaatggcattgcataatttgagatgacactgaatactgctagtgtttttggtataagacatttagagtttcgtgtgttacacgaaacccctgttcttttggctggttttacggtttgtctaattagcaatcaaactaatcttctaatgcgattggatggttattctgtagagagctaatatattaaaacaggataatataaatggttaaacccattttcttcacgggtggaaggatatttttcataataaacgctgattggttgtttgtagtagagtaatagggtaactagcctgcaaaggcacttgatgtcaccagcctatcattaatatcatggttacttgttcaatgccctgcttaaagtttgatattatgtggtagcacttacaataacccatatttacctttactgaatagtttgatattatgtggtaacacttacaataacccatatttacctttactgaattaatctttgcattcgattagtcctgacctgtgcactaagaaaatttgagcttaacaccaatttcttcacctatactaattttgtggttaagttgaatcatcgttgacagtgcaccttatcttcttttttctcagcacctgatgtttacacacatcagatttatttcctggaatatcaattctcatttggtatttgcatgttgttcaattcacatcaatgaggcaattactggacatgcccctactaaaattatgaatgttttctcttttgtaattttctttcagaatgatatgttagtaagggataaaatattattacttttggactcctggcaagaagcatttggtggacctggaagtaaatacccacaatatcactttgcgtatcttgaagtaaaggtatgtaacaaattccatgattgttccttaagaagtatagaagccttgtttcgtcatggtatgtggaacgatcatgattacaagaggcatgtcatgtactcatgtgttcaacatgcatggctcacgtgtttatgctgaaatattcatttcttttctttgaaaacatccctataatatctaaccatatttgcaacttgtcaattttgaattcagaggataggtgccgtgttcccaaggcgtcctatagatgcaccaccgatatttacacccccggcgacacatacttctcaaagctatggttcacccagatatgaggcaggaagtctgaatgagataatgtcttccgatgttgagacactaaggttgctttcttggcatatcggattcatttggtttggtcagctatcacccaactacttcaatttatgtttgtaacatttttttctctttttctattacagtttgggtgacctgaataacattcgaaatgtgacagaactactatgtgatatggtgcatgctttgaatccatctgatcacatggtagtgaaaaatgttcctgcctaaaaactgttacttttgaccatatggactaaatgccagcagattttgatctagctcttgacttgaacaacctccctttttttttaacccaggctgtcaaagatgaaattatcacagatcttgtgagccaatgtcgctcaaaccaacaaaagctcatgcagtttgtcagctcaacagggtaatgttatcaatatttgttgctgccccttgtattttgaattttgtaatgtagtgatttcagggttctcctttgtttctcttcatagcatttcataggcagagcaaagaagtttgcacaaaatgtgatatgatatctgaattcatttatctgttgtttaggaatgaacagttactgaagcaaggtttggagataaatgatcggctacaaaatattatttcaaaatatgacattatggcctccagtactcatttagcagttgaagcacctccggcagacaatgttgaggctcctaaagaggatccagcagaaaagccatctgcacctcctatcagcactcttgaggaggaggaggaggaggaggatgagttcactcgactagcacaaaggtatttataagtagccttgtaacatgcagcttcattttcatgcacagttaacttatgcttcattgtgcatctgcagaaaaaataagtctgtgatgactagtgatgattcattatctagcactggagaccttgcccttgtacccattgatatggaaagttcagaatcttcatcttctgttgcaagcaatgctttagttcctgttgacccagctcttgtcagtagcagtcctcaaacaaaagagcaggatatgatcgaccttttaagcctcaccttgtgcagtcctacacatgaagcttctacagattcttcaacgcagggtcctaatggacctcagcagcctgcagttactgatgggcagcacaacccatcgggtgtgccacagtatccttcaaaccaccagtcgcatccaataaatcaggaatatattcgacagaacagaaactatgttgcaccttgggcacaaagtggtcaatattatccagcaccaccatgggctgcacctccaagtgtcaattctaatcctttccagtcagctacttaccaagaacaacccccacctgttggttctgtttcctcaacctattcagctccctcagcatcatatacttccccttcaatggcatatgtgccaccttcagcctcattgccgatatggaatggttctactacaagtaatggactaagtgcaacacaagctcaaatgaatgggaatcaacaaccgccaggttcttcagcggcagcaagcaaaccttattacatacctgacaatttattcagtgatttgattgacttgaagggtctcagtggtggaaataagatgggcgtacccactagcatgggtagtgcaaatggtggtcaacctacgattggtggaaagaagtaggtttctctaattggttggtggtgccgtggtgaacgttaggaattctgatcactcagtttggtgtacatttcatgtatatctcccttgccccatttacatgtttggttacattggttcatttcatggctgctgactgttcagtcgagtagagatggtataccattattactgtacataaatgatgagttgcgcattgccttgtttttacttcgcgactcatattttgatatgtttggcttctcattattgagcacacgcatgaaatcgtgttcgtccaggatattaaatcctgttcgtgcgttgttattctccagcatattttatggttctgttgatctcaaggaaagttctcttatatagttattacttcctctagcccataatataagggattttagagcgatgatattttctaggactacgaatttggataggtcgtagtcctagaaagtgtcacatctctccaaaaatcttttatattataggacggagggagtagtaatttcggtgcgttggtaatgcccaggatttggtctcgttttggctttgttgtaattgtgggtttgtacgcctgcctccggtgcgaagggaaggcattccagcggttcatgatgaggcccagcatggggtgtaggctatgatgagcccgtgaactaagggccaggtcgtgacaattgtgcacgtaacaagtatagaactcaaatacactgggtctccgactgatggatcaaacaaaactacttaccattacttcactgtctattcctaaaaaaaattactttactgtcaactacctccattgtcaagtagatgtatagttaaaataagcttaaacttaaactttgcagttgatatgcacaggaacagaaggtatatttgtaccatggaaatgataatcttttagcgccgagttgacacacatttagtagatgtatagttaaaataagcttaaacttaaactttgcagttgatatgcacaggaacagaaggtatatttgtaccatggaaatgataatctcttagcgccgagttgacacacatttagtagatgtatagttaaaataagcttaaacttaaactttgcagttgatatgcacaggaacagaaggtatatttgtaccatggaaatgataatcttttagcgccgagttgacacacatttgagttgtttcgtcgttcttgtgtttgttggtacgcaggatctaaaagtcacgtttctttctcgtcgcgcgcggagcgcaaagcgacaactgcaaatctgcaatgccgccactccactttaattagtccactccatgaactggcaattaatgatcaaatctctgcaagcataaatgctgatgaggaggatatgtgcattaaaatgtgatattctttagtacagtttaatctttatgtagaaacaaggagaaaaaacacacttccacgtaaaaaaataaaccctcttttttaacataaaccatttttaaaaattattaaacttccatcaagctttatcaattacagaggaacaggtgtatattactcccacttttatacttgtacaccttctatcccaaaaaggataacttatagatataaatttgaaccaatgcttgtccaagtttatctttagaagttagttttttatcatacggatggctcctttagcaattgcatagtaacactgtttctttggttcatttcaggtagttctatttgactgtttcttgtcagtaataccattaattctcacagcctagtgaccatttataaacgctaatcctgccaaaatgattaatgtcaacagttaaatcatataccattccccaccgtgagtcttcacactctaaatacagagcaaatctgcgagagaaaacaaaccaaattgaacccattttctcttttccttctccaactcaaccccaaaaaagaaaaaacgaatttagaattctccaaccaccgcgacggccatggccatggccccccggtgcaccttgtccgtgctgctcccggttgcgctcctcctctgcgccgccatcgcgtcgccggatttccctctcggcaaaaacttcaccgtgcctttgtactaccagcagccggccgacctcgccgtgacgacgaccacggtgctcaacgcgtcgcacggcgcgccgctgcggcctggcgtcgccgccgccatcagcgtcgtggccggcacgggaggcctggaagggctgtccatgtgctccctcgtcgtcctcctgggcaacgtcacggtctgggcctcggaccacgacggcgggaggttcttggtgcggggcttctgccggctcgagctcacggtggacggcgatctgcggctgacggacgccgccgggaccgtcgggtggtcgtccgccacggcagggcgacgcgcaaaggtgatgcatgcatgactcctcctgtggatctacctagtttgcttttcaccattctgtctgcttgattattgcaatctttaccattgtttctgctcttattacaaactcgataggattgtaagctagatatgcgatgcgaggtacgcccagcgagccaacaatcaaggtatataatcgtacaatgttgttgaagatggaacagtgctagacttagtgcatcagcgttatgccgatatatatatgggtcggttgatatgaattatgatggagttatctgtccgaggatttgatgatttgtcctccctgttcttggataattggatagaggatttggcaaccttatgtctaggactggactagtatacatgccaaatactgacatgcgactgttaagtggacaatcctcgatttttccaagaactacctactagatcttatataccataaaaaatagtctatatataaaggttcatttctatgaggatttggttctgagcatttttttaggaaaaaaagggcttattttaagggctaccttgagtgttttaaaaaagcgcgcgaaaggcatggatcggatatcaacgtcataataacgacttttatcgataacctaattaataacgacacgtaagtcatagagggcaacaaataagtacaaacgacaaaaataaataaagcaacaaagtaaagctaccgttattatagttatcttttatgcaataaagtgtgactccctattgaaagtaaagcgcgtatagatttctggtggttttatgtttttgcactctttgcccaactaattgcctctcaattttgttacttattagtgtcaacctatttcatgggagatcacctttgagttatagcctgctaggaactttctataacgtattgctttttaatgtcgtgtggctgatgtcggttctctaacaagtgagcctatatgtcagccatatacgttagaggacgatacgttaaagaaagatcatctctctttctaggtcctctattcttagcaattcttttcacgtacgctttgttggttcaacctagagtaaccgattttacgttttctatcctctaaagtgattgggtcattttgaaatgaaaccaaaatgtgctatactaagttattgtcactttgaatattagtacttttggcaatgtttggtttgctaccaaaatatgctaaaatgtgacctccaacggttactttgacgtgataaccactgggcccactcaaaagtattgattgttaatagaaccaacgtctatgtccgacaacactcaaatgtgttgattgttattaacaaccagcacctttttcgcattataggtgtcagttcttccaaacaacacatcagatcagggacgtgtgctcgggcaaaaaaaaaaacactatatgttttagttgtatagacttctaataactataatgttatccctattttgcgtttatgtgttagtgataagtcaactagaaatttttaacttactaccaaaattttcctaggttttagcattacccgacattctgataaggtagcaaaacaaacaaacccttttaagtcagagctgagatactcacgttccccttatgtttcggcacaggttctgcgtctgacccggagtggcaacctccgtctcctggacgccaagaaccaatatgtatggcaaagtttcgacaaaccagccgacaaactgctacgcggccagcgcatcggggtgccctcctacctcaccgcgccggtgacaatgatcggctccgcgttcttctccttggagctcaaagagcgctcgatcactgccaacttcaacgttgggattaagaggtacacatactgggagctcactccgcgccataaccggagcgtggcatttgcggagatggacgtgctggggctgaggttgctggaccgtcaacggcgaccggtcgcgcagatctcgccggcgatcgaggcgcaggtcagcttcttggcgctcggagaagacggcaacctgggcatgtacttctacgacagccatgacatgaagttcgggccgtcgtacgaggcgctcgggttctgcgagcttcccctcgcctgcggcctccgcggggtctgctccgccgccggcgaatgcgacgacttctccacctacggtgtccatccggcgccggcggcgcaccgccacagtgcctgcaacgcgaccaccgtcgccgaccggcactacatggcggtgatggaaggcgtcaccacggcgatcaggcccgcctcgccgccgacggccaacgtgacgatgcggcagtgcgcggactcctgcctgcgcgactgctcctgcgccgccgcgctctacgtgctggcggccgtggccgaccacggcggcgcgtgctcgcgctacgagatgacggcgggggcccgggaggtgatcggcgggggccaccggcacaactacctgtacctggtgaaggctccaagaacgagagactctgagcacgagcacggagacgacgacggcgccgtgagccgcgtgctcaccaggatcctgatcggcttcggcacgctcgacgtgattggcctgtgcgcacttacatggctgtgtgcgtactactgcatctatctccgcgacatcccggtcctcgacgacaaggacgacgaggaggctgacgatgaaggaggggaagcagcccggcgaggagacgccgtgtcgcaaagtcctcctaccaacagtgaacctgtaatagaattgaactgataaatgaaaaattaagaaaaaagagaggatatactttttcttgggtgaagtgcaatgaagtacatgccacttggttcactgaagtgagcgagagccgaaccaggaacagagaactaactagcttggcaaaggggaagagacggtttgtctgtcttttaaagacccgcacgttagcccgctccaacacagcaaaacggtccagctcaacacaccaccgtggcaaaaccatcttaggtcttgcacggtttgaaagggattgatggaaaataattttacatcacaatagatgtagaataaatccctccaattcctccctcatagggattacactgtcttaagggttaagtacatggtatagaaaaatttaggagggtagaatacattgtttaaaaagtgaggggattaaatagttgacttgcaatagtttaggggtctgtgtagacttattccttggttgtttagtaccgctagcggttacagtttcacgcgctgcaatgattcttttatttagtttagtaggatgatttgggtctagtgggttgttcattaaatgatttgtttttttgccaaatcaactttttgggtagatggtttttatggaatgaatggtcttttggcctgtttggttgtggacttgtgaggaattgttaggagggaatgagagttcgaaggatggggattatcggaaaggaaaatttaagatcaaactcccacatttttaatatctagataggggcagataattgggatggaattccttttctaagtacacaagataaatgtcgaccatatatcatcacttaaaatttaattccacctgaacttcctatacttttcatcttacttaccaaacaagagacaaggagtaaaattgtaactctcatgaccaatccctcccccaattccctcctctaaactccccatctccattctcttgccaaacagtacgtttataaatagtagagaagagatttgcaattccaacttttttctccaacgagatgaatcagtcgaaacttccaagagcctattcagtttgttgttgctttcaaccttaccatattaaacacacttcaaccattgctaccttaccaaaatttggtatttctagaagcttcctctcttaaacatctaccaaaatttggtaaaggtatcaaaccaaataaagccaacactaataaaatttggtattaccaaaatgtaccaaatttagcattaccaacagttggtattgttgatatgggcaacaaatttaacaagccctagatccagctgttcagatgacaattctatatttctatgggccggcccatgtccacaattaggccgagtggtgaaagaatacgaagcccactaccaagaaacatgtctcatgttttgggccgagcccactcggaaatacagccgtttgcaccccgccggcctgacattaggcccaacgagacgttcacggtgtcttccgtctcactgacaacccggtccctacggcgtgcggcgcgattagcggcgaaagccaaccaaactaccaaccccaactgaacttggccgggcgatgcggacataccacaacaacccactgccgttggccgccggtcgccgggatcgatcgtccatgggcttccaccacttatcctctgcttgccggcagcggcgtttactgctcctcaccttgtccacagaggaggcagagattgccagattatcttggcattgttcaggtacacttgtacaagatctcttcctcctcattttgcgtagtttccagggttagattgggcagagagagttgttaggagttgcacgctctaaactctgaagttggggttactacctacttcggatttgcacatggatcctacctgggggattcaaccaacgtgaccgctgaacagtgcttgtaatgacgccgcaaccgaatatgcagttgcttttcacttggaaaaagaatatgtagccgctttaggagtgccaccatgtggtttgtgctctgatgatgttctccgatcctgttctgactgtgtcgactcaaagtctcgtcgagagcttcctggtgaacttttgacctctccattttctttttatcactataaacgacaaatgaaatattgcatcagatgagatcagcattcggtcagacattttagagatcagtggtttttcctgctaaaaggaaaaaggcgatgttggttaatctgaaacctgaagttcggttgatcgtctgaagctttaggaatccaggaaagcatgttgggcgtcagtatacgtttacatttgcaagtcctggccaccatgatgccaccatttaccgaacgagaatggcgattcaagtttctaacttatggtggtctgaactctgaattcagaagaaattaggtctcaggtatggtcaggcagtcaggctgaactccactccgtacaggagccacagaactcacgctctcctgtgccgtgcgtctgatctcaccatgaccttatgacaacggtaattcaattcagcttcaggctgaaggcggtctatagcatgaatgcgagtgctagattcagatgctgcagacatggctagaaatcattacacgatttcattgcctcggatcgcctctacgcggccgggattatcaccgtttcctttcccgcggggccatgttgatctggtcttcggtttttaatggcgtcgaggtgagctgaaagtaaccgcagcagcgagcgcggccagacacggaggagcagccggcgagggaggagttaactagccgtgacgtcactgctcccggcaaatggcagcggtggcgtggcgacaattcatggcgagagagcggcctgatcgtgaccgccggagggcggagggcggccggtgagtggtggtgaaccgtgcttgtgcagatccagagaacagtgacaccgttggttcaatgtattgaaagacatggcgcggaaattgaaccgaatggcgggaagagcttttagtcgacagctgactagctgagctgatcagatctgaattgtgtatgggaaatggtatctcttgctgcactgtcagaaagtgctgctgcaagctgaacatcagaaattgaatccgattaggattactatttgtaggatctctcttctgaagttaaatccgattaggagtactgctcagttcatgtttaagtgtttcatgcatattcggattaggacaccggaatgatcaggccaagaaaccttggcctatatatgcaaagcattcgaaagcattaccagttggggagctagcttgtaagatttgttgccgaatacttcagaaaacagtagggctagctaatctggccctaattatttgttgccgaataccaagtgtttgatttcgaattagcttgtaatgccgggcaaaatcacagtgacgtctacgagaggggcaggcaagtcagcaacggccagctccggtgagccctgcaattgatccgtcgtggctgcaaggtggccatgacaagctccgataattccggaccaggaattagatacagccattgatgccattcattgctccccggttaatagcaaacaatagcaacagatgtcatgatgtaccagtactgaatatcttgcaagcaacccgcagtctgaaatctcagcctccgtttctgaattctggtcacacctgctgagagttacgtcttgggccatagcacttgtgccctcagttgggctggttgctgtttaggctaaaacttatggcctaattgctgatctactaattagtccatactggctaacaacaaaccacataagctagctttgcagccacagtcatctccatcggacaatttattgccggttaattaaccgccggaattgcataaatacctagcagacagaggccattacagctcaagcaagtgcgcaccaccaccagcaacaatgtcttccccttcctcggcccattggctgagcttggtaggaagtatctggctccagaccatcaacggccccaactccgacttcccggtgtactcgtcgcagctcaaggagctcaagagcatcagccaggtgcagctcaacttcctcgccttcgcgtccgacgcgggcaagctcttcggatggttctccggggtggcggcgctgtacctgccactttgggtcgtcgcgttcgtcggcgccgcgttcgggctcgtcggctatggcatccagtacatgttcttggacagctccggcctccggtactggcatctcttcctgctcaccgcgctggccgggaatggcatctgctggatcaacaccgtctcctacctcctctgcatcaacaacttcgcgtcgaacagccgcgtcgcggtgagcctcgccaccagctacctcggcctcagcgccaaggtgtacaccagcctggccgagacgttcccggggctggccaactccaagacgaagacgtacctcctcctcaatgccgtcgtgccgctgttcgtcaccgtcatggtggcgccgtccctcagggtgttcgacctcaagagcgcggcggcgagctcggacgcggcattcctcgtcatgttcgcgatcacgctcgccacgggcgcctgcgcggtggtcggcagcatcggctcgacggcgaacgggctgtcctccaaggagcacatgatcagcctcggcgtgctgctggccaccccgatcctcatcccggtggggctcaagatccgcgagaccctgaccaagatacgggagacgcagcgggagaacaggatccatgacctcggcaccgacgagtcggagtccgtggagagcgtcgtcgtcatcgacgtcgccgccgacgcaaacgccgaggttgccaaggaggaggacgccgtggtgaagaagccccaagaggaggtcggcggcctccggctgctgaaaagcccggacttctggctctattttttcagctacatgttcagtggcaccctcggcttggtcttcctcaacaacctcggtcagatcgccgagtcgcgaggaatcgggcagacttccactctggtctcgctctcgtcttcgtttggattcttcggccgtcttctcccggcgttcatggactactactccgcgaagtaagcgatcattcctttcacacacttccatgattaaaaaaaaactccaagcagagtagcaaaatttgtcaaaacagagtattctttaactactacatgagtcctgagattttggagaccacgtacacttgttgttatcaaagattcatgcagtctttgtttgtttttcttttcaagtttcaaagacgacgtgctaactacttgttgctactgcctactataagtcgtagagttagatcttggctgtttgtgtcagagtgattcagtagctcgctggttttccagttccagaggctgattaattagggtgctaactgaaattttgttggtttgtgcagaagtggctactccatatcgaggacggggtccatggcgtcgctgatggcgcccatggcgggggccttcttcctgctgctcaaccagcgggacttctttctgtacctggccacggcggtgatcgggacgtgcacgggcgccatcacgtcggtggcggtgtcggcgacgcgcgagctgttcggcaccaagaacttcggcgtcaaccacaacgtcgtggtggccaacatccccgtcggctccctgtgcttcggctacttcgccgcgttcctctaccagcgggaggccggcgcccgcggcacgctcacctgctccggcgccggctgctaccgcgagacgttcgccatctggggcacgacgtgcgccgtcgggacgctgctctgcgccgcgctctacgcgcggtcccgcaattttgccgggaggctacctgtaaggataccgtcctgcctcgcccgcttagctaaccttgtgtagggtgctagaactttcttacacctctcagaggaggcctcttcttaatttaacgaccatacacgaaagcatcagccattaggcgatgtaattaattaggttttgtttctttccaccacctttttctttctttctttctttcctttggttttcttgactgattatcccacggggggatacagacaaaaggttggagcctgatcagtagatattgtgcaggctgatcaccttgttttctctgcatatattatatatgcaatcatatacgagtggttaaggggaattcaggtcttgatcatattggctaagttggccatgctactggtactagcatgttcatttttctttttgggtttcgatttattagctagtagtatttgatagcactgtagtgctactatgaggagtactacgtactgacgtacgtggagctggaaattcgcatttatgcgtgtgcaactacgggcaactactgccatttacatgagtggtccactgaagtctgtagcatgtagttccacgttattcaattgaaagccaggtatatgatagtactaacagtttcgaatacttgctgttcattccaccgtagcctgatagttgcagttatatggaacactcgtaggcagatagatttatacgtttacagacgaaattgtcaggtaccaaacctagtgcttgatcattaagtcaaaccagatccacgtcaataactgtccataacaattctgttagtatctcttcgtaccgtatatatagtcaattcgtagccgtaggtctaggacaaggcagggaaagcatgtaggcgttttaaacttttaatcctctcctggtgaaagttggacaaccgtgttaatcctcttctcagcaggcggtatcatcagacgtttaactgaaagttacactatggcccatacatgtgtgaaagatcaaatgaagaaatgttcaacactatcctggccacctttaatttctggatatgttcagatgcatcactgctactccctccgttccacaatgtaaatcattctcacatcgtggaacggaggaagtagtacttatctttcgctcatttgagaaccatccggctatcccgtccgacagtaacagcagtgatgcatccaggtccaatccacacacacaagctgaacagtgttatatagaagaattttaccatggttcatgtaagtactaagtactctgtatatacatatgcattgcatgatcatagatatatactccacgcattgcatgattatatggactcctatctgacaggcatgtgaggaagatgtaaccatttaaggatgggcagagtaggttgatccatggtggccatcggtctctcgtggtccactcacatgttgcatcatggcactgcgatgcaaagttcagttccatcttcccccgtgtacttggatggacaaatgctatttattcgccgaaagcttgcagagccatcaacagatcaactccctctagccccctggccggcaagaggcgtctccgccgtctagctccgtacgtacgtctccgatctttcagccggtgagctactaaaatcatttatgatctgcgtggttggttggcagtattgttgagactgcaacatcgacagagcgatctatcataagctcagcttaggctgtgttcgtttggacgttttcccagcgcgctacagtagcacggaaaacggaacggttcattaacacgtgattaattaagtattagctaatttttttttcaaaaatggattaatttgatttttttaagcaacttttgtatagaaactttttgcaaaaaagtacaccgtgtagtagtttgaaaagcgtgcgcgggggcaaaacactgtagcgcgctgggaaaacgtccaaacgaacacagccttagactcacttaaaaatctgtcaaagccttgaattacttccttatcatgatgcatgactactgctccatgttaattaatttgtagcgaaatctcttatagatagttgaaaaccacgtctaagctaaaccatcttaatgtcctgctacgatcgagttgatggagctagctagtgtggtacaggcccagattaagctccttttcatgcttctgcatgtctctgcctgctgcccggagatggtcagatggagggatgcgctcattgctcggtgcagcgtagttattgtggtggatgggtgcctgtgttggtggaggtaatggggggtggttgttgagaaggcaaaatttgtgaaggtcatatgacatgtgtcctgtgcacgcacatgcctggcacgaagcgaatccgcggacatggcagcagcaacaaaggagctatagctagcttagctaacgcggggaaaagcgggaagagaaaaaggttagggacgacgaagtgaaagcgtgcgctcttcactgtccatttgtaatacagatttgccactgatcgtgtgtagttagttggacatctttgtttgtggacgcaatgattacactcgtttcttgctgttgcattgctgatggccggattagactcggcaatgcgcatcctgccgctgctgaaagcatgtcgtcagcagaaagaaatatctcaggttattgcgagatgccgcccggggcactcgatcccatatttttgaatcaatcatgtacaaaccattaatgtgggtggaggatgggagtgttaaaatattttcattaccttaaatagagactgtgtcgatcttgtctaatactccctccgtcttataatataagagattttgaatttttacttatactgtttaaccactcgtcttattcaaaaatttttgaaattattatttataaatttttacttactttattatccaaagtactttaagcacaacttttcattttttatatttgcacaaattttttgaataagactgtcggtgatatgggcccgggggtatcacgtctagagggaggaggtcgccctcaaacccacgtggctccccgcgaggggggatcaagcccggggtggagcggtggctacccccacccagctagagggaggaggccgcccttaaacccacgtggctctccccgagggaggtcgagcccggggtgttgtggcggctgccccctcccagcttggggttgggccgcccccaaacccacgtggctccccccgaggggggtcgagcccggggtggcgcggcagctaccccctcccagctagagggaggaggccgccctcaaactcacgtggctctccccgaggggggtcgagcccggggtgttgcggcggctgccccctcccagcttggggttgggccgcccccaaacccacgtggctccccccgaggggggtcgagcccggggtggcgcggtggctgccccctccaagctagagggaggaggccaccctcgcttggggtcgagctgccccgaccccctccacatatcagcccacgtgtacagggttaggtgggcgcgcctaatgcccacctaactgcatttaaagcagtctatgcaaccgcgccaggccgcatttaatgcggcgtgctgcgcatctgaccggttgaatgaccgatgggatggcgactgtgtacccctgccctgtcagtgtgtcaggcggcgagcggcgtgctccatcccgtcccatcataatgatgaggggcttcacagcctcttaccccggtcagagctggtccaaccactctgaactgacccgggttcccgttttctggtgtgaacgagaacccgaaagtcctcatccattaaatggcgaatgacaagggcgctctgcattgatttgatgggccccgcgcagcaaccgcggatagcttctgggctaaggcacaagacatgtaattaatatagagaatattttcccttctccctaggtagcactcgcagcacatgtggtatccccttagagtataaaaggaggaccatgcctagcgaggaagggggatcggactgaggatccctgagccaaagcttgtctaaccctagcttgcataccagggattcagggactttctaagcacagaagaatcatacacacaggagtagggtattacgcttcatagcggcccgaacctatataaacctcttttgtctcatcgtcttggaggggcctccgagatcaagatcacacacagtttcgctcaccaaatcctcgaatctcacccgctgcccctggccgaactctcaaaggagggcctcacagcctcccgctagagagggtcacccctcaacaaagacgagtggtcaaacaatgcaaacaaaaactcaaaatcccttatattataggatggagggagtacgacagaaaggagtgattttgtttagtgccgtagaacaaaaatatttgaaaaaaatacataatcacaaatatcttgaattgcaaaagggcgtagctagaaattgtgatatgaatgatactttttaaaagaacttttcacatttattttatgaaagtttggtttgcgaggatcttatctatttatagctatattaattgagcacttcgagtgagctcttacatgaacttaaaaatatataccatttgataagtgaatatgtaaattacacattcagatttcgtgttaaatgaaacatattccatggattctttatatttagttgatttatctccgatgtttttctttggttcgacgccatttgccaacagtaatgtgagcggaattcgatcgacaaaagatctaccgttgattttagatttttttttctattttgaggaaggcaaggactacgtacaacttaatatcagttgataaaaacaatagttatggacagggcactatgaccaaccctagagggagatttgtcttttaagatggtttttcttattagtttctttgtaagaattggctttaacttctctgaaataaaatccagaatgaattccatcatcttaaaatagaaaaaaaatagttatgggcactatgaccaaccatagagggagatttgtctttaagatggtttttcttattagtttctttgtaagaattggctttaacttctctgaaataaaatccataatgaattccatcgtcttaaataaaaaaataccgtcttaatttgagagataccaagaggtgccaaattttacagtagaaaatgcagtacctccttgtacctccccaaggaccgtaaaatccctctcttaaaaatatctagttgttacaaaaattggaattaatagatatggagttgtttcatcgctttattaatttaatatgaatttgaaattgtcgacgtttgatgtcgcgattccggtatttgcatagtatggggatcgttagtactaggatatatgcgagattgtagtaaaagagatgagggcgaggatttttatacaggttcgggctcctgaattgtcaggtaatagccctacatcctgttggccgaagccggtcgttgctcttattcaccataatcacaccagtacaatatttagggtagcctatctaacggttgtcgacatggcggtctgaaggtctgactcgtagtcgacgacagggtagtcttcctcctcgaatccgtgcccgatgagatcagagacaacgctatgtctctcctgacagtatccggagacaccgtaggggattagccatgcctatctctgaagtcgatatccggcttcttgtcttggcgcatgttggcttgtatgtggatcttgtgtcttgatctattgtttcgtgtcccctctcctcctagggggccttgtatttatacccatatgtccccttgtccaagtaggactagggaaaccaatatggatacaatccgagtagtccttgtcgtttccatgtaaaactctattcatccttccttatgcagaactccttctatatctgaaagttgtttccgtataggacatggtatgtggtgggtcctgccgagatttagtcaactattattaggtatgtggtatccataaccttgacagaaaccaataattatcaagttgtaactgaaacaaactcttctttttaaactaatatgctaaaattaacaaacaaatttagaaataaaatgtagatggactcacaatttagctattttaaatataattataaaattcaaagttaacaattagccagttgtaactgacacggtttcttttaatttaatatgctataattctaaaaacattcaacaacaattttagtgtatgatcaaaatttaaaatatatataaaaaatagcaatagccaatgtaacacatgggtgtgacatcccgacctaggggttaataggattaatagaatactcatatcaacaggttacaacttcttttccggaagccgatctccaaagaacaagttgcaacttcttttccggaagctgatctccaaagaactccagggttaagcatgcttggcctggagcaatttgggatgggtgaccgaccgagaaattcttatcaacaagttgcaacttcttttccggaagccgatctgcaaagaactccagggttaagcgtgcttggcctggagcaatttgggatgggtgaccgaccgagaaattcttatcaacaagttgcaacttcttttccggaagccgatctgcaaagaattcttcccgggtacgcacgagttcacagagggacagtctatgacctatgaaaactatcagatgtaagcgggcccggcctgggaagaggcgagacgttacaatgggttaatgactaagtggtatattaattcacgccatgggacagtctatgacctatgaaagctattagatgtaagcgggcccggcctggggagagacgggacgttacaatgggctatcagatgtaagcgggcccggcctggggagagacgggacgttacaatgggttaatgactaagtggtatatcaattcatgccatgttttattagcatggctgtgaacaaatgatattttgctcaagtaaaaaggagtgtgagtagtactaattagttttaagccatgggacaggctatgacctatgaaagctatcaaatgtaagcgggcccggcctggggagaggcgggatgttacaatgggttaatgactaagtggtatattaattcacgccatgttttattagcatggctgtgaacaaatgatattttgctcaagtaaaaaggagtgtgagtagtactaattagttttaaaatttcttgatacagtgttacttcctcatattcataatatagtgatttttaggattcaaattttgtatcacaatataagtattcatataatgattcctatagttcccattattccaactataggggattgcccctattcagttttgcgctgaggtaggtgacggagctcgtggctcctcaccgggagaccgcgcaggcccccctttgccagttcggccgggggcttagggtgaaatctcaagctctcgctctctctgtatgtggaaatatcgtctgccagccagaaaacacgagacaccggcgatctatacaggttcgggccgctcagaagcgtaataccctactcctgtgttttggtggatctgtgtatgaatgagctacaagtgtgagctgtcttctcccccgttctaagctcctaatctgggaaagaaccaaaaaaatccccccacctctatgggcaaggtcctccttttatacttcaaggggataccacatgcacccttctctttccaaactggactgttctttttctcttgaacgggcggagatcagcacggttgctgtccgaatgacgctccgatgggacagcccacacctacctccacttccgccgggggtgagcgcgtcgtgggaacatggctgtgcgctgacgatatgatcagtgtcagaccgatcacaaatcggtcattcttgtccaccgcgtgtaatcttggcaacgtgcatgtttgcccttcttcacacaacatcttgcctgtaatggttaggatgaagcctggcatatatcgaccgggtctaacgtgtcatctctaagagataacacgcttaacgccggcttgagacgagtgcctagaggctttcgtcttgacgggatggggcatggcgtgcgtcagaccgccagtcgccacctaacccgtgatctgaccggtctgtgactggtcacagaccggataaagggacgcgccgtgctgcactgcatgcagcgcgacacgcttgaccagactgcaataaatgctgttaggtgagcacagctgtgctcacttatcccatatacgtggcgcagacttcctaaagggggtcggggtgcctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttgtgccagagcaatttcccttcccaagggaagcggtcaggtgtgacgccactcctaaagcctggtgacaggtgggaccggtctccgtaattgggcaaaatacccaacggtctcaatccatgcacatcggtattgataactttggttgtccataatgggcggtctattcagactgccacaccacttgagcagcgcgcgaatctgggtgagcagatttgtctcgctcggagatacggtaacgccgcttcggtcggcgagcgtaattaacgcgcgcacgatacaatccgtttcgattgccacaaccgcatatccacttcaagcgccgtaagcgggcgaatgggattagtggaagcgtgggcacgggaaacgggggagcgagatagcgagatacgagggagcgaggtagtgggcacgagaaacgaggagccaggcccagcgatggcaagggtataaaagcatcgagaaaaggatttgctcccttcctttcgccattgttcctcttgccttcgctgcctgagctctaactctttctctgctacgccctactttcgccacacgcgctcgttcccaatcatctcttcctccaccgccatggcacggggctctgctctgctcgacggcagtgtactgccgccttcccgcatcgtgaatgagaggcacgccggactgccgcgccgcttcatgccggagtccgccaccggtcgggagattgtgatgctgggcgaggggcgcccggcaccagactacccggggcggtccatcttcttcctccccttcgcgatggctgggctggccccgccattttctcatttcttcatggacgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgctgaaccgctatatcccctgcgtcctccgcaagaagtgggacgactggaagagcgactggttctacaccccccttgccgacgaagcgcgcctccgacttccgagccagcccccggcgcaggtctccagctggcgggcgccggtagatctgggggaggagtacgacgccgtcctcgaccgcctggcgggcctgcgatcccaggggctcaccggggccatggtattcggcgattacctccgtcgccggattgcgccgctccaacggcgcgcccggagcgcctgggagtacactgggcctgaagactacatgcggacccatcagggagccagatgggattgggctcccgaggacttcaagatcgtggtccaaagggtgctgaaccttagctccgcggaggcgtctcaccttcctcaggagatcctccccctctgcatcgatcccgaccgtgtctccattctatccattatgctgggggtcggggcctcagaggagagagcccctaagggcaacgacggcgcgggcgagcgccgccgggggaaacaatctgccccgggagggggtcgtgcttctgggccccgcgtcgggggctcggggagcagccgccctgccgacgccccggggaagaggaagctgggaggaacacctcccccatctcccccccgagggggcggggcggtgcgtaccagcggccggcgcccggagggggccgcgccgacgtctcagcccgagggggagcgcaagaagaagcggctccgcaagatgggggagacggaaccagcccggggaaacctaatttcccccccaaggtggtcattcaaccgaccccctcgcaggttcgtcttactctcattgcaaccatctttctccaaaaagaagttttttcttgctcactttgttcgtcttctggctttttcttctgcttcagagacgtcccgtcgcattcctcccgccaccccaagtccggccagttcgaggccgaagatccagcggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccaggaggaggccgcccgggctcgccaggctgaggcggcagctgctgctggcgcgtcactcgggcccactccctcgggcggccctcaggcgacatcctccgaggcggctcgcgacgaggccgcgggcgcgtcgcctgggcctacctcaccgggcgacgcccaggaccaaacgggcccgggggacatccccgagctcagcgtatcctccggggggccaagccgcgtcgctttttctccaaggcggcttttctcctcctcttccatcgccccggtgagcgccgagcccattatgcaggccttggccgccgcaaacaccgcggtactagacggatttagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagctcgaagcccgcaaggcggcgctggcggagatcgcccgggaggtggaggaggagcgagaggccgccctcgtcgccaccaccgcgatggtcgaggcgcaagacaccctccgtcttcagcacgcaagctgggaggcggagctgaagagcaagctcgacgccgcccaaggggttctcgactccgctgccgcccgagagcggcgggcaacggaagccgaagcggcgtcccggcggcgcgaggaggcccttgaggcccgtgccatggcgctggaagaacatgccggcgccgtggagaggggcttgatggaccgtgaggccgccactgctctccgggaggcgacgctggcggcgcacgaggccgcctgcgccgaggaggagtccgcgctccgccttcgcgaggatgcactcgccgagcgggagcgggctctcgaggaggccgaggccacgacgcgacggctggcggacagcctctccctccgcgaggcggcgcaagaggagcaggcgcgccgcaaccttgaaagcgtccgcgccgagagaaccgcgctggagcagcgggctgccaacctcgaggcacgggagaaagagctggccgcgggggcgcgcatcggtggggcggctgcgggcgaaagcgacttagccgctcgcctcgcggctgccgaacacaccgtcgccgacatgcagcgcgcgctggactcttccaccggggaggtcgaggcccttcgcttggcgggcgagattgggcccggcatgctttgggacgcggtctcccgcatgaagcgcgccggtcggcaagcaggcctctggggaggccagacgacggtgccccccaccaatctggaaggcctcgctccgcacctcaacaggatggcttgggttctcgagcgactccccgaggagctcgagaagaccattaaggcatcctcgagggacctcgcccggggggcggtcgaactcgtgctggcgagttaccaggcccgggatcccaacttctccccatggatggcgctggaggagttccctcccgggaccgaggacgaggcgcgcgcgcgggtcggggatgctgctgaccacatcgtcaacggcttcgagggctcagcccctcggctcgcgttcgcccccagctccgacgaggaaggcgacaccagcagcgaggacggcggtggcgacgaggccggcgacccgggcgcatatgaatgagcccccaggcccccgccactcttaacttttttttcttgttctttcttctaaggccttcatgcctcttttttgtacaatctgacttaatctgcaatgagaaatgatgaaaaatttttgtgttaattttattttgctatatatatgagttgaggatgatctgtgccatggtccttttgcgccttagcttgaaataagggctcacgcccaagtcccggtcctcgaatggctcgggtcggggctagtgcctggggagatccgcatgtcgagactggccaggccgggaacgtggtgaccgaggggtatgggtgacccgattgtgggtttttgccgatccccccccggagttcaccacgccccggggcacggctcggttctgggccccgtttggcgattttagctgaccgaaccgagcccccgaggacaaggttgagcacgagtgacattatttcaagtcaagattcttcaaaaggaaaaaacggcacagacacaacctttaggaaattgaaactgcttctattgaaatgctgaaaggaatatatgtgcatgtgtggtagcccccggctaaccctgcacacccgaggggggggtgcggggttagcccgagccaaaacctgacacccgaccccccccttcaggggtagaagcgacgaaggtgttcgatgttccacgggtttggcagctccgtgccgtcgcccgtggccagccgtaccgagcccggccgggggacaccgatcactcgatacggaccctcccacatcggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagctcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtgcgcgaggcagaatgggctccgcactcgccctcatggatgtcagcaagaagctcaacgccttgttcctgtggaatgcacttcaggaggattccattagccgcgcgccgatagagggtgtcacgaccggaaatcacccaacaggcgttcctgacgtgcgtgtattattccttgtcccaggaggcaaggtacaccaaaagttgatacaattcagagtttaacaagcggaagcgtaaatataattattacatgggcaacgaaggcccagcacactcaaagacaacgaaaaacagcggaagactagggcgacgaccacaggcacttgacggcaggcacgagctagacaccgaagccttcatcttcagggaactcctcatctgggcttgggaaaattaagcaagactgagtacaaccaccgtactcaacaagacacacccacaaatgcaaaataaatgcaagggagtacaagggaattataacataaggggttagagttgcagtaaacagcatttaaaggaatttagttgctcaaagctagttgtaaacacgatcctagaactaaacaatgttattaatcaaggccgtgaacccacacgaacctgccttaacccaaggcctatgatgattcagaccgaactggcaacccgaccctgggtcccagctcgtcctaagccaacccaggccaaccattccacattttagttgttgagcaaattttaagaattataacactgacttgggtacattgctaggcttgcccatatccgagggctcggctattcgaatagatttactctgatcagaggtgtacatctttacccacaagacacatcttcctcacgtgtaaccacgtgccacataccaccacggtatacagacgaaagacgtgacatagtttccaacccatcctagccttagacaagagtaccgacccaattccgcctacggccgggacccccgggacaggcagacggaactgagcccctggcattgggcaccaaccctccgccgtatgacatctcgactaccgggccgcagctcgtgtagccttcatttgccctggagaatgtccatcgacccccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccatggtgtccaaatgatatgagaatttcccaagtctagagttgtaaaaccacctaatgttgcctaattaacttgcgaagcatctacctagaattatactagtggtactatgagtagagagtgtccactagttggggttttgtttgtctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttcaacgaagagcggatcttccgaagctgcagcgtctacacgaccgacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcatgtttattgcgtcagccgaggggcgggcgcgcggaccgggtccacgggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcaccagcgccccgatggtcgccgccggcgaccaacggcgcggcggagtggcacccgagagagaggagggaagggggaaggcgaacggcggtcttcggctcaccccgagacaacggcgacgacgagaacggcggacggagaggaagaaggtggcggcgcggctcgggatgacgacgacgacggtgctccggcggtcggcggacgaagcggagcggcggacggggtcggcggcgatgcggcgatgccgaaggaggggtcgccgagccgggaggaagagcggagcgacggcggcggcgaaccgacggtcgacggcgacggcggagagagaggagcacggcgctagcacgattccgacggcgagagcgagcggcgaacggcggaaacggaggaggagagcacgggcaacgtttttatagcgacgagagggggagagcgcggccggggagagaggaaacggcgcgcggaaatctcggccgccatagatgcgccggcgaacttcgcgggattgattcgaacgaatccgagggagagagagaggggaaagagggggaaacgggggaggagatcgcggggagtaaatcccccctcttgattgcacgcggagtggacgggagcggcgggattcgcggcggcggcggcgctagggcacggacgcggcggcgggcgcggcgcggggttggggatgacaggtgggacccacccgtcagcgagagtggcgggcgggcccgcctgtcagcggcgcgcgcgcgcgcggggagccgatgggccggggggagagagagagagagagggagggaatgggccgagccggcccaagagggaaaaggggggggggaacagacttctttttagggtttttctttttataaacctttttaactttgtttatttcttttcaattattatttgtgctctgaaaattccactaaaatttatttaagcattttaggcttttaggaaatatacaaaaatcctccaagcctcatttgacttttatctttgcacattttaattgttggaggctttcacattgaattttacttattcttttgcacaattttgaggatagattttagagtcgatttgggacgcgacagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggaacgctctcttcgggtcccgaggcctggactccgacgggcctcgggtgccggtcaggcgcatccgtctcccctgaggggtcgggtcgcgccgacggctgggtaagcctttcttcaaaggcgcccggtggggtctgggctcgcgaggacgcgagccttgagagttcgtcggctatcatgttgtcccttctgggtacatgccgaagctctatcccgtcgaaatggcgctccatacgccgcacttggcgtacgtaggcgtccatctgtgggtcagagcaccggtactccttgcagacctggttaacgactagctgggagtcgcctaataccaagaggcggcggatccccagtccagccgccactctgagtccggcaaggagtccctcgtactctgccatattgttagtcgctcggaagtcgagacggaccaaatatctgaggacgtctccgttcggagagatcaacgtgacccctgcaccggcgccctgaagagacagagaaccgtcgaactgcatcacccagtgggcggtttgaggcagctgtgaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgttgcacctttcggcggggccgatcctcctcgctaggggccgtacccccggggcgttcttcgtccaagtggcccctcggggcacactcgtcttccgcgctgatgacctcggggtcggaggatgacaggagcggccctcccacagtggcctcggggccgtcctgggggtcggggactcctggcatcgtcggacaagcgggcaaagggccaactccggtcgtcaggggcctctggcctccgttcggctcgggggcctcttctccctgctctttcccgggtcgagtcagcacagggttagcctcggggccaaagggctttaagtgcagccttccctcagtggcctcggggccttcctgagggtcgggggcacccagcaccgtttgacaagcgggtggagggccgactccggtcgtcgggggccttaggccaccgttcgactcgggggcctctcctccctgcctgctcccgggccaagtcggcacagagcgggggtgcgcagaatgaggattgtcctcatcgcgctccacaaccaacgctgcactaactacttggggggtcgccgctaagtaaagtagcagggactcatttggctccggggcgactagaaccggaggagagctgagatacgccttcaactgggcgagggcattttcagcttcctccgtccaagtgaacggccccgagcgcttgaggagcttaaacaagggtagcgccttctctcccagccttgatatgaaacgacttagggcggccatgcaaccggtgacgcattgcacgtccctaagtttgctgggggggcgcatccgctcgatagcttgaattttctcggggttggcctcaatgcctcgggcagagaccaagaacccgagaagcttgcccgcaggtacaccaaacacacacttatcggggttcagttttatgcgggcggagcggagattctcaaaagtttccgctagatctgaaagtaaggtctcttggttgcgcgtttttacaaccaagtcatcgacatacgcctcaacattacgtcctatttgactacccaaagaaattcgagtagtacgctgaaaagtaggacctgcattttttaacccgaaaggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaggcttgacgttccggggcttgccgccgcactttctgccggaccggccttgcgcccggccgcacggcgagacggtgctcaatcacctccctggggaccccgggcatgtcagctggtctccatgcgaagacgtcagcgtttgcccgcaggaaggagacgagcgcgtcttcctatttgccatccagaagaccaccgatccgtgtggtcctggatgggccgtcgcccaaggcaacctccttgaccggggcctcgtcgcaagtggccatccgctgcctcggggcggtgggggcagaggggccaagcctctcgtcaccaccctcgggcttggacgcagcagcgaggcggtccgcgcgctgctcaatgcaagcaagcgcgactttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcaatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcatgttgcagatggtgggggaaaccaccatcgcaacctgccctccccgggcaatgcacggtgggtggtcagtctggtcgaaagtgagagcgacctccgaccaccgcgcccgacgcatcgcctcatgggtaggggccatggccagaagctctcgtttcatagccttgaagctccggcgagagacgtgagcacacgctcctccatcgacggtggcaatggtggccccaggttcttggaaacctaggtcatcatcaccatcattgatgtcaacagcgggggccttctgcttggcctcacctcgccgtttgccggatggaaccaccggggacttgccctcacggcgttcctgcctcttgtcctcctcccacttcctcgttcgctcagccaggtttttgactgcacgacagtccgcgagatcgtggagggaggtgttgtggacggagcaccacctgccggcggagcgctccctgccgggagttccggcctctttctttttgtcgctcgcaggcctcccctttcgggtggcccgcggagcgccctcgacggcgaggacatgaccctcgtcgccggaacggtccgacctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtgttgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccatgtcgaggtgacactctggacgaggaggctccctccgttgcacggggagtacgccggctattacgccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtactgccgtcgccgtagacgaggaggcgatgctccccgtctcgccgttctcctgcatcacctgcggccggtgacgccgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctcagaaagcacacgctgagccccctacctggcgcgccagatgacggagctcgtggctcctcaccgggagaccgcgcaggcccccctttgccagttcggccgggggcttagggtgaaatctcaagctctcgctctctctgtatgtggaaatatcgtctgccagccagaaaacacgagacaccggcgatctatacaggttcgggccgctcagaagcgtaataccctactcctgtgttttggtggatctgtgtatgaatgagctacaagtgtgagctgtcttctcccccgttctaagctcctaatctgggaaagaaccaaaaaaatccccccacctctatgggcaaggtcctccttttatacttcaaggggataccacatgcacccttctctttccaaactggactgttctttttctcttgaacgggcggagatcagcacggttgctgtccgaatgacgctccgatgggacagcccacacctacctccacttccgccgggggtgagcgcgtcgtgggaacatggctgtgcgctgacgatatgatcagtgtcagaccgatcacaaatcggtcattcttgtccaccgcgtgtaatcttggcaacgtgcatgtttgcccttcttcacacaacatcttgcctgtaatggttaggatgaagcctggcatatatcgaccgggtctaacgtgtcatctctaagagataacacgcttaacgccggcttgagacgagtgcctagaggctttcgtcttgacgggatggggcatggcgtgcgtcagaccgccagtcgccacctaacccgtgatctgaccggtctgtgactggtcacagaccggataaagggacgcgccgtgctgcactgcatgcagcgcgacacgcttgaccagactgcaataaatgctgttaggtgagcacagctgtgctcacttatcccatatacgtggcgcagacttcctaaagggggtcggggtgcctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacactaggtaattaacgtggagttagatttaatatacaatgctgatattttatttctataggtaccatagaaatgtagaagtatatttggattttatatacgactcttaacttttgtttttataaggtctaaatttcatagacaactcttacattttatttatacataagtattattatatgtagaagtatatttgaattttatatacaattcttaggttctatttctataacataaatttcatatataactcttagactttattcatatagacttatatttcatatacaactcttaacttctatttatatttatatatataattatattttcatacaactatatcaataaatctataccattataatccggacccaccatagtctaacggttattttttctttttctctaattaatttggaacttctaacctatagagcgagcatggtggctcttttttcgagctatcttaataatataataggtagatgattccagtgctgattaaatgcttggaaagggaatttaagcaattcaaaattttagaaattgataattgaagtgactaaaaataaatcttttgttctaaccttagtattttcaatataacctagaaattcttatgtttttaaaatgagggagtattttctatactaattcagttatattaattgttatccaatgcgtcataaagaggcttcacagatagataaagaactactaaaaagcaaatgttttgttgaacttagcttaaaatgaccgaacagttataatgaatttaaccttcggtccatttcaaataaataaataattcaaaaagttaatagtgattttgaaatgtgtacacactggccatcacatgacaatgggacatgtaaacggatttctgattcgtgacgaaatcatcttgtgtgaattatttctctggacatgaaaaagacaattggcgatggatggactaatctgacctcagcattcccaaagctagccatgtactattactacattcaatatctcaagaatgaacaatgtatcacaactttcccatgtaccagacagcatgctcgtgttggccacggccgaagcctcacacgatcacatcagctgatgcaaaataatcgtccgctcgttttcactcgagccccatcgatcaatcgatccctttcgggccccatcagctgatgcaaaattttgcggctggatgaatccgagacgtcactttggagaagaaatttgaatcaggttttgctaccagcgacgtccggatctctcggcgtggtgagatagctaggctatttcttccttctcgggttgaatttgtcgtgacaggaaattatttaacagggtcccgaaatataacgaaaatcaagatcacggccctctacaattacagcatcgagaccgaaggcacagagagtacggatagttttacgtagtcgtagatgctttggcgactaaactcactgttctattccctccgtctaaaaaaaactcaacttctaaaatttgaattttgtcccacaaaagatcaacttctaccatcgtatctactatcaacacataaaatgataagttttattccttcaatactatttatctatctatcaccattactcaataatagaggtattttggttattttttttctactatttttatcttagaatgttaggattggcttttatatgtgagacaagggagcaggagtaacgttcagccaggtactcatgaaggcaagacttgcatgtccttgaaccgagagatagaagtaggctgtgtttagtttcgtgcaaagtttagattttgattgaaattaaagatgatgtgactgaaaagttatgtgtgtatgacaggttgatgtgatgaaaaaggactaaagtttagatccaaactgccgtagtagtaatagtggtagttgcatcaccggtgcttggacgatgccggcctggcaactgcgtgtctgcattgtaggagtacgtgtggagcagagcagcatggggctagaaaatcttcgcatgggcagcgttagctgcgtttactgtcctaatcactctgagctagctgtagcaacagctctgccgagcgcaggattgcaggccggtgtcatgggcacgacactggccgcgtcttgtcgactgtggtgccggcctgcatcgcacgtactaaaacgatgggatccaacggaatcggtacacctggatgtatacggcagggaccctcggcgtgtacgacatgcacggcgcatgcagtctcgttgatgatctcacctcgatctcgcgcatgttcgattcatccatccatcctctgccgtcgtgtggcatagcccttcaatcttttctctcacaacggctcgatcacagaggtcggccgaggtggtccaccggctctctccctgatcgatccaaagtacatcagagaagaaaagccaaaggcacggcacgccgaggaggggagcctggcatccgtcggtggtacgagggggaaagggacggcacggcacgggtggcgcctaagttagtacctgaccacacacgcttcgctttattagccttagccagttagttaatgttgtttgtgttagcggatgatgagcgattgagtgaacgcttcaaccatttacagtgtaggataggccgcctagctacgtacctaaggtttgcgaattgtgatcgtggatcggtcgttgatcgatcttctcccgtttctctctttatccagcacgcacgtagaataattcactaatctgaattctgaagtgatcgacgacgactggcttttcatgcgagattgtatggatgaaacggcctggctgtggcggtgcatgcgcgctcgcgctttatgtttaccggccggtaaagaatcctatatgaaaaggagtcgatcaggagagcttgagagtactacaactgcatatgcaacggaagacatagcgtagtggctggatacatcaatggaaatgctatgcccctttcgctaaccgcatgtgcgcgtgaagaggggaaagagacgtgcatgagtacatgccaaggaaagctggtatgaactccgatcacctacgggacaaaaagggaaagcgaaagcaacgaccaacgaagaggaaacgaagcgacacgggcagatacatggagctcgatcgctcgcgagcactcaccatctccgatctcgcgaggcactacctgcaagaagtgcaacaccgaccgtacgcgagcgagcgagcccgccccggccgtgataatgcgcgatacagtgcggggccgatcgatcgggacgacgcgcgggggcggacgaaagcaacgcccgcgacgcgaaagaccactttaaccggcccatccgatatatatccgcgcgacaggagcaaaacggcaaaacgcgccgcaattattgtgtttctgccgtcacccagccaccccatgcgccgcccggccggcgctgcacgctggggagggcacgcggtcgcgcggctctggccgtcctcttggacggccgcgcgggccggggggtcgtcatattagtgcgtagataagtagattagccgtgcgacctagccgtgccgttggtggcaaagcatcggtaccctgctagtaggctggtagtacgtacagtatccttggttggtgcctcggtggagttcggggaggccgaacgtacaaggaatttttggttggtggttaccacatatacgttcgatctgcagtggaaggcatgaagaaaagctaatttttggctggtggtcatcacatatacgttctattgatctgtagcggaaggcacgggaaagcttaccaacaaatgagcaaactgcgatcttccccgtcgtccgactccggtacgaaccgcagcagcaaaggcacagctaggaggagagaataattagttcgcaaaggcgacggagtttcgtgacggcgatgggcaatcaaggccatcgcacagtgcaatctgctggtacgtgtgccgctggctccttggctgtcaccgggtcaagcatttaggcgaaacactgaatgccgaataaatcggatgcggacgtgctccgacagtggtcgtgcaggctgacgctactctcacgtcatcgttacgtcatgcattgctagtaaatcatttgggaagaaaaaaaaacaagcaaaataaaacggggagaaagcgatcgagagatctatcacaagctgctagccatactgacaagtcacaagagaacagggctcgcacagtggcgggcgtactagctaatggagtgttcacgtgtgcgcgtcttcactcacttcgatcttaactgatctggcagctagctagcgtgccggagcgcgcgttggcccagttgagagcacatcaacgagctgagcagtcgaagcagacgttcctaaacaaggccttgattgcagccatcctggatgccatatatgcagccgtgtactcatgttgcttcctgcaaccgtgaaccagctttgcttgggtatcaatggacagaggtcatacatgtatacagtaccttatccctccttctcacaaaagtgtaaagagaacaagaagctcatatattctacgtgtcgaaacttagaagttaaaatcatacagattttcaacaactatagatggagattcacaaatatacttcaataatagtttacttcttatgtgttggctttattatttaagttatttttttgcttaattaagtgtttgcctttttgagagaatattataataattggttatagcttcgttgtagcaaaagccggctttagtcccattatctaaaaagaaatccctctttttcaaaatatgatcactactaacatttaaaatttgtatctaaatataaacaattttagcactattcatattactacttatccatttaattaccctatttaaatttatttccattttacatcaaacaccatctcatcccaaccattcttggatattcccttttgggtcttaatctttgctaaataagttagctaggtgactgatccagctggaagaggtcatgattatgttacttatgtatgcatcacgctgatgcttgtgtgatgcagtgtgctgatatatcagtgtttttactttaacgaaataaaaattgatggtggtggtcattttttaagatccaagtgctgtctccacaaaattatcggcagggttgcatttgactctcctttcccagtcatagactgtaactggctaaactcctctgctgcacctctgtgagagtactagtaataagcctacttggctccaccatgaaaccttaagtggaagagacatagtgctaatgataagatatagagtactcttctagaagaccaaaaaggcatatactattttctttttcattctcagcagtagtataatactacgaccgtacatagacagtctacgtcatccattcgttcacattatccgtcgagctagcgacgacaccacttgtagagcatgcagagcgccaagacctctcggccaatgcacatgacttcaccgagacgatgcgaattttgtacgcgagacattgtggagtatatctcaaagctgttggcagtgtagtggcaagtacggagtatatcctagccgctatatgcgtatttacgtataacagatttctgaaaaaataaaggttgtttttttctgaaagagattggagcacagagggcaatgtgctgatcatacagatagtgatgagattgtccagatatttgagaaaagggattagtgagagctgatacacttgtggaaagaaaagagaatgcactaagcaaaccttatccgttccagtatatctccaaaactggcgatctcgattcaagaatgaaacacagtgctagctagacaggatacagcgcagcagccagcaggctagctgcttctggtcagagaaaacaggtctcatactttctgaagcgtttagttgcatgctatcttttgatcatggcttgatgtgcttaggatctccgggtgaggtgacaggagattttttgctctcttatattaatttgtttctttttgacacgagagagttttctttctttaatgaacgtggatttgtaggtcgcctcggaccattaatttgctaatgcgaagtagacacctgtcgctggagacaaaaatcttgccccgttactatttgggctgttttttttgggtccaacagacagctaattaagctaagccatggtccagtgtagccgattggttagaaggccccagtatggagaggaaatactgaatcctttgttgaagtgccaaattaggggcacgaacgtctgtacctcaatgtgtgcaagtgtgcaacatatgctctgccttcaaatgcttatcactggatattatttatctttatttttttattactcatcttttttacagaaaatatataaatatttaaagtatttcatattaatgaagtgtgttgtaagctaaatatagtaatgaaactttcgtatatcaccgatctaatcatttaaatagatcaatttaaaatttattgatggttaaaacaaaaattatacttgtcggcaatgacacagtttgagactggagacaatactagggtggagaggaggctatagactcatgatataggtaattttgtagcggtccaagatttttcatttttattttttcttatcaaaccattttcagaaaatcatgcaaagactgatgatggttgtatcttccttattactaaatgaagtagttacccatttcatattataagccactttgacttttttttcctgtagatcaagtttaaaaaatttaaaaacatcaataagactaaattagtttcattaaatataacattgaatatagttttgatagtatgtttgttttgggttaaaaacgttactacattttctataaatttagtcaaacttaaagtttaattagaaaaaagtcaaataacttaaatataaaacttaagtactaaattacttacataccctaaatacttacatgctgtcctgtgttatcctgcttgacaattcagtgaacgtgcacttctcttttttcttttcttgtataatggagagtatataaagatttccctcgacatgccttaccacgcttggcccaccttgcactttagcccacttgtccccacacgcggccttacaggcccacggcgatgtgtgggccgaatatcactaacatctcgctatgcgactattataaagtttgacaactctcctgtggtcacttgttgagatggccgagttggtctaaggcgccagattaaggttctggtccgaaagggcgtgggttcaaatcccactctcaacatatattttttaaaaatattcggaaggccgagctgatgcaatgcagcggcagcaacgccacgatgtttcccctgttttttttttctcttcattcgcgtaattcctgtcgtcccaggctcccagcttcagccccagttcaattcgcgcgtaccattctgccagaactgacgaggctaaccgagcagtagcactgatgccccttcggggacctcatgtgatcatgtccttcgtacctcccggggctggcccatgaaaaaaattttgttaaaatgaaaaagaaggccaaaaccgtgtggcccgataaaggaatgggttaactgttaactgaccgcgcggatcgatctgacgttttcgggtttggcttaggggcctgtttgtttctcatcgtataagattattataatacagattatttagccagatttataaactgaattataataagctatgagtttgtttcaatggattatagtagaatagaggcagtgactctttagccacccaataatatgaaaaatatatgtttagaacagattaccaattatactaatctggcttacagattacaataatctatcataataatttacctatttattttttattattactaataatctagattataataatcctaagcgaaaacaaatagagcgttagtatggtttggtctctgatcatgaccgaagttaggagatcacaaaataaaagaaattacaataaaattttggcaacccaataatatgatacatgttttagcaattaaatagcgaaaagcctaatggacgatcgatcgctccaagcaatcaccccttctccacgtggtttctttttttttaccgcattactttcctgttttagtaaattcatgcacctaaagtttgtacaccccaaatttacacatctaaagtttatacacctaaagtttagagacccaaagtttatataaccgattcaattttgaatttgaattcaaatatttttttaatacatggtatttctatatatttaaagtttatagacccaaagtttatataaccgattcaattttaaatttaaattcaaattatatatatatatatataggtatttctatacataaatttttctaatttttaaaattttatggtgtagtaggaagagaagaaggggaggagaaaggggggagaggagcatgttaggagggggattggggg

SEQ ID NO: 78200 - DNA, 14242 bp, Oryza sativa
cttctcccaatgcataaagcaataacaaacatattactttattccttaatatcatatttgcatgcacattgcggatgccctaacatggagtatgaaattatattccttttaggggcatagaagtttacataagatgcattcttgtagtacgtaagaagaaacttacaactcttcatacatgcatatattccaccatgcatcacatcaagccaggcatatacttcctccgtttcacaatgtaagaatttctagcattacctacatttatatagatgttatgtgaaacggagggagtagctaataaggcattccttaccaccatatctgaatcactaccgccgttgccgttgtataggctgtatgttcatctgtttgtttggttttccctttcacttgtttaattcattcttagcacaaagaaccaacaaaaaaaaataagaagctctcttatcattgtcctgttggatatatcatctcagaatttgacgcagatgagatcacagctagtctatttgcatatagcccaagaagcagacagaacaatctttttcctgctcctcgaattagctgtgctccagaatccgattcttttttttgtttgtttttggtatgcagattccgattcggactatgctatgttacgttccgttaataaatatatgtgcactatgcaatctcgagttaagcatcatttgtttgtgtgtttgctgcatgtaggacgacaccatgaacatgaagaagaggaagaggacggtaggaccagctgcagcagcagctacttttcctgagctgccggaggagattgtgatggagattctggctcgtctgcccgtcaaatccctgctacgcttcaagtccgtctgcagagggtggcgtgcaatcatctccgagccctccttcatcccaggggcggagctacagtgatgcctatgtattcccaggaatacccaactttttttatcaaaaaacaactatacttcaatatatacacataacacatatacacatattagttgtccccactcctccagagtccctcgctcggctcacgcctcaccctcacgcgcaaatgcgctgctcgcccgctccccaattccccatttgattccaaaccctaggtggcggcgttcggcggcggcgcggcggcgcggcgaccggcggaagcggcaaggcgtccggcgaccggcgacgggagcagggagctagaccagcggtggcgcggcgaggcattcggcagcggcgcgacgccgtggcgaggcattcggcggcggcgcggcgaggccgcgagacggcaaccgacgggcgaccggtgacggcgggagcgaggccacgaggccgaggggcaggggcgcggcggcggccggccaacagctgcagctcagcgggacagcgcccagcggcactgcggcaggcacaatttcaggtgacaaatcaagagttcaagattcaatcagtcctaaatccactcactatgtgtccatgtctgatgtttttttaccttagtctctgagtagtttctttttcctgtacttttgtagttctgtagattgaagaactctcaaaatgaagaagaaatcgattgatttgaagactttgtgggatagacattcaaagtctaggaaggtaggggtaggttctggttctggatcaacaacacagccagttagaattgacagtgaagttgctgttccttctgttcagccgattacagatgcaaatgagagtccagttcagattcagattactgcagttgaggttgtgcctgaggtagcagccagtgatgcagcaagagatgtgacagaacctgaaacagaggtagctagcaatgatccagacatagcaacagcagtgacacagcaggagcaaccttccacttggtctcctatcagagattggtctcccatcagagatggtgatgatgaagagacagagtatgactcaagtgatgaagctatttatgacattgatttactttgtcatgatcctggaaggcgaattgcaatcaaaaattatgatgtcaatgaacggaattctgtgataaggggatatattgcattagggccatgccaaccacgcagccacagttttcctataaggaaaattggaggtaagcctcggcgcttccttcctagttggtatgacgaatttaaatggcttgaatatagtgtggaacaagatgctgcattctgttttatttgttacttattcaagcataaaattaataattctggtggagatgcatttgtaaataggggatttaggaattggcacatgagaaaaaggattgcaaaacatgttggtggtatgactagctttcacaatgtggcacaagataaatacaatcacttccttgcacctaaaacaaatattgttgagagctttgctgccaccaatgaacaagacaaggctagatatatggctcgtttaaactattcaatgaagtgcttgaagtttcttttaaggcaaggtttggctgcccgtggacattatgaaagtgaaaagtcacttaataaaggaaatttccttgagatgttgagtatgctagcagaaaactttgaagaagttggtaaggtggttttgaataatgctccaaagaattgtaagttgactgctcccgaaatacaaaaacagatagctaattgttgtgccaaagaaactactaagcttatcatggaagaccttggtgatgaatattttgcaatacttgccgatgaatctagtgatgtgtaccaaaaagaacagttggctctttgtttgagatatgttgataaaaaaggaagggtagttgagaggttccttggtgttgttcatgttgaaaatactacttccttgacacttaaagctgcaattgaatcattgcttatggagcattccttgagcttgtctaaggtccgtgggcaaggctatgacggtgctagtaacatgaagggtcatgctaatggactaaagaaattgattatggatgagtgcccttctgcctattatgtccattgctttgcacatcaactccaattaacacttgtggctgttgctaaggaaaacccagattgtgtgtggttctttgagcaacttagatttttgttaaatcttcttgggaattcttgtaagaagacagaaatgcttagagttgcacaagctcaaagaattgtagaagaactagatttgggtgacattgaaactggaaagggtttgaatcaagaaatgggtttgggcaggccagcagatactcgttggggatctcactataaaactgttatgcatgtcctatctttgtatccttcaattcaaaaagttcttataatggttggcaaggatcgctcttttggtgcagaatgtgcaaatgcacaaacagtgttgacaatattccaatcatttgagtttgtttttatggcacacttgatgcaaacagtacttgggttcacatctgacttgaatcatgctttgcagaagagggatcaagacattgttaatgcagtaggactgattttattgacaaagtttcaattgcagcaattacgcgaggatcctggatgggatgattttcttcaagaagtgcaatctttttgtgtgaagcataagatcaagatccctgatatggactctttctatcggccggttggaagagataggaggttctttattaaaatcaagaatatgcatcgcttccatgttgacatgtttctaagtgtcattgatagacaactacaagagcttaatgaacggtttgatgaggtaaacacagatttgctcctttgtatggctgcatttagtcctatagataactttgctagttgggacaaagataagttgattaagcttgcacggttttatcctaatgatttctcaagcacagagatgaaccatcttccatcagcattgaaactcttcctcactgagatgcgtatagatgaaaggtttagaaaagtaaaaaatcttgctaatctttccattatgattgttgaaacaaaattgcacaatagacatgagattgtttacaagcttctcaaattggttctggtacttccagtagcaacagctagtgttgaaagaatattttctgccatgaattatgtgaagaataaattgagaaacaggatgggggatcaatacttgaatgattgcttggtcacatttattgagcgtgagatgtttttgaaagtcaaggagtgtgatattataaaccgctttcaagccatgaaggaacgcagaattaaagctactcttccaagccacgaaggaaccgaaatagaaaattagaggtaccatgtaataatttgtaattttatttcttagattatcggtattgacatactgtgaaccattgattttttttactatgaatttttttgttagacgggaatacccaactttcaaatcctggctccgccactgcttcatccgaacccaactccagtgctcggcttccagacggcagcaggagccatccatcctcatcagcccccacttccgccatgaccggccgaccaaattctccacccacatcagcttctaccagtgggagcaaggtgcctcctcccttgcgaggatcatggatgccaaggacttccctgtcggccacaagttccgcttaatcagccactacacccactgtgatggcctagtgctcgccccgactatcaccaagctctacctcttcaacccggcaacaagagaagccatcacgttgcctgacggccatggccacagccacaccgcagggctggggctggatcctggtaccggcaggtacaaggtggttcggtccttctaccgctccccctccatggatcctcccgtctccatggggatggaggtgctcaccgtcggcgagcccggcgcgcggtggagggagaccgccgttgatcctccacaccccatcacccgatggcggaccgcccttgccgtcaatggtggctacctgttctggtacatggacaggcgccgctaccccgacgatgctccccggggactcctccggttcagcctgcgagacgaggcgttcgccgtaacccgtctcccggaatcgatggacccgacgctcgacgagaacgtcttgcccgacgtgctgcacggggagctgtgcgtcgtgcaagctctgcccgacaaggctggggtgcttatctggacaatgtcgtcgtcgtccatggacaacgacgatgtccacctcgacgacgggccatgggaactgcgatattgcatctgtgtcaacgccctttgccatccgttgggggttcttcctgatggaggaggaatcttgttgtgggcgaatcgcagcgtccatcgctacgacttctcggctaggaagctcgctggtgtggtgtgtaacctggatcgcatcaggtatcagggtggtaggccagcgagatggaagagtgtcgtcgacttcaccttgatgccctacaccgagtctctcgttagaattaccgctgcttagcttcttcggtcttgctactttttatcccatgagaatcagtttgtatgcactgcttgtatttccccccctctgtttatcactacaagtactcctgcaaatgacaaggctatttatttgaatgctctattattaatttattttactcccttcgtttcataatgcggggcaattttttactttgcattgttttagtttgatcactcctattttgtcaacttaacagaaccagataaatgtgaatggagtgctgcggaaagatcatcctgggactgcctatttatatgcaggggcaagttgttgtcgttcaccagatgtgatatcataagattacctacagtataacacctttttcggcttagcgattcacatttctttcttacttcctacttattttaattttaatgtatgacgccgttgactttttatcaacgtttgaccattcgtctaatttaattttttttgtgcaaatataaaaatatttatgtcatgcttaaagaacatttgatgataaatcaagtcacaataaaataaataataattacattttttttataagatgaatggtcaaacgttagtaaaaaaaatcaacatcgccatacattaaaatatggagggaatagtaccgtgtagtatggacaattcagtagagaacaaccactagagaacaatatcaattattgaatcaaaactaaggcccaactgaccgtacatacagaacgattaagtcattagaaaactttgtttcaggcaagacaatgcttcctcatgttaaaattgagtgggaagtaaaactgaaactatatgcagtattttcatttcttttgttgcatggtgactgatcactgagacttctataataagtacagaacactatattctgctgacaaaagagtaagaatgtctatactaattctacacataaagaaggagaacatgcagacaaagaaaggaagaactgcggcagtaagtatatctgtatatgaagcatctctctacaaaataaaagtgcacaataagcatttcaaggagggtattgccttacagggaaccttgatgcaccgatcttgtcacacttgcatgagtgttcggtacaatattgccagaacttgcctctacacgatgcattagcagtcaggtactcttttggagtttggaccagtttttcccctttcaggtcatctgttcatcaagtcctgtaaatccaaaatgctttaggagatggctcatcttaaaacaagccaaataggcatatgctcgctgcaatgcatcatcattcatcagcaaaacagacgaacaggttgagaagtgtcatattctggtgatggaattgcacaaaaagccttcaagtgagaacatgacaaatataacaaatataagaagattgatcgtctcaggcgtgctttcctttggaagggagacgaccttgaaaatgtgagttcaggcagcagtctttgtcaattggcagaacgtttacaaactcaaatctttaggttggcttggtattcttaacttggaaaagttctcatgtgcattgtgtctgcgctggttatggttcggttggaaggatgaaaacaggccttggcaagagatggaacttccttgtaatgaattggaccgagtgttgtttagagctggatcagtgattactctgggggatggaagaaaatgctctttttggtctgataactggcttctcgaaaataatcattagtttgctattctaaaccccatcacctctttagaggagatcgatgctttggtgcgacttggaagttatttacgggcttgttcagattatagccaaaataaaccttaccaaattttggccaaaattttggcatgatttcttatgtatttaacaaatttgcaacaaactaaacgtagacattttttaggcaactttgtcaaaaaaaaaaaaatggtatggttgaaaatggcatcaatgacaaccctacaagaaattacactcatagagctttcaaaacaggctaatggctaattcttcgctaagtcttcccagtcgtctttcttttattctgtaattgacgatctgaacggcttactccctctagacgttgtttttacttttgctcgctgattgtaacggttggtgacctttattccttctaatatatccggcagagctcctgccatttaatgtttttttaaaaaacaaatataacaaaatgcgaaaaaatgtggtgagctggtgcaactgcaacaggaactaaagcaagcacacattataaaatgagatggcaaatataaataagcgcgtaagcacatcttcataaattaattacttggggggtacagatgctgtttcatcgcaaggaacaacgatacaagtgatgccaaagcaaaggatgcaaggttcagattgccaccgaacgaccaccggatgatccgcgagcttaggcaagatgatcgcctattccctggatgcagtgggagaggcagttgacgaagctgtatggctgctgcaacatctgaagaaagatgcagtcgaggtggcatggctcgctgcttccatctgcaacactgtaaccgtcctgctgcgacatctcacggaagatggagtcgaggtggcatggctcgctactcccatctgcaacattgtaaccgtcgatttcgttcatctgagtcttttcacgacaatcgaatcccaggtagagagtgtcagctgcgagcctctgcaggtagtagagtgacggagcggcacaggcccaagaacacagctcgcccgcccaaccccttgaccgggatcaagtccccggcgtcgaaatccaccctgtaaacatcatacttcatctcgtatttcgcagcaccttgccgcgattcatcatcaacattgctctggcggatcttacggtacaccagcatcaaactccccaccattgtccacaaggtgaatagttcctgacatccgggagaaatgcaagggcttgctcggctgagcggtggtgaccagccgcggccgccctctatgatctgatctgaagaaggagagctgtccagcaccatgacactgccgccgatggcgcagtagaagcgccctgcgaagggcaaagccgagtcaatgtaggggcggttcttgtcggcgacgacgacggcccagcactcatcgccgggtttagcgacggcgatcaacttggggcggcagaggaagagagccactgtggttgcggatgcaagaccgacgccacgcgccaatagcggatcgtcttctaaccccccatccgaatgccaagatcgcagttgctccggcgtgagcagcgcggtgaccggcgggaggtcggtgaggtggcgggtgagggggttgagcaggcggaggaggagggtgcgctggtggagcagcagcaggaggccctccggggcgagcgcgaccagggtgtggctctcgagctccgggagatccgtacggatgcactcgccggtggagaggtagaggaagcggcggcagcgggggggcgccgccttgtcgagcatgatccaccgccgggggaggaagcggcagtccagggcgcgggagaggggatccaccgagcgcagccgccacagccggcacacggcgcggaagcggatgtagtcggcgtcgtcgttggcgagcacgcgctcggcgatgaggccggccggcccctccccgccaaggttcgaccagtccatcctccacctcctccttccccgcacgctccgccgccgccacttgagcagggggtcacggagatgccgccaccgatggcgatggggaactcggctcgccgccgccgccgccgccggtgggagttggagacttggagtcggagtcggccggtggccttctgatgggccaagttgccaaccctacccatttcggcccatcgagacctatgtccgggtaggcccacgaagccgtgatccgcccatcgaagctcgccgccaccgccactagctgtgcgttgcttacttggaataagttcactttaggtcccccacggcctaaggccgaagcccaagagagtttgattaattttttcctgacattttatctgttgtcgatatcaaataatcatcaccatcattatgtgaattcatttgcatgattgaaatgagaacgaaactccatttatcatttggtaccggaaaccggaaatctgaaaatataaggagtacacctcttttcatgtgtatatatacttataaaatacacacataaataaaaaaagtgaaaaacttataacatccaatcatccataattttctcaaaagcatgttggtgtacaaagtaggtgaggttaggaccgaagaatggaaaaaaaaaaacagcccatgcaacctatattacagaactaaacctcaacaactggcgactggcgtacattgagtacacaatgcaacccaagacctgtagtgcaatatagtagtatactacacctctgtatatcatgtgaagtgtacataatttttttttataatagaatgaaacatttcggattttgctaagagctacagctaattattaaaaggttcatatagaagcaaactcacacagtgaagtgtatagctgcagctaaacatgtacgtatacgtgtgcctgacgacgacggctcagagtttagcgtgtttgacgttttggtcggacagaatgccctcgatggcattcttccagaccttgcagtgcatctgactgtccaacagcagctgtaccacaccagcggccgttctgagcaccagcgggaacaacaccatgccgtccaccaccacatcgccgccgttgctggagacgtcaagcacctcatctgaacagggcgcaggcagagccagcggccgacaaaaaatgaagccagtgatcaatacaaccaggttgagccaaatcacaacagttagcatatatgcagcgatgcaaacaaatgtgatatgaccagaccattgtgtggctaagcatgcaagatcatcaaaggggccaggagacaagcgtaacgaagcaaaaaggcagacacttcaggtgacatgatgcagtaccggactgcaagatcatcaaaggggccaggagacaagcgtaacgaagcaaaaaggcagacacttcaggtgacatgatgcagtaccggacttccggtggtactgtctgtggcacgatcgatcgagacaaacagtgtactcatgcaagtagagcagaagaatgttactgtgtatgataacttttttcatttcgttagactgtgataatctcgataattgtaactattttcaggtgttgcgccccaaaaaactacttttagatttactgtgtcggaagcaataattttactacgttgtgaatatgtaaaacaaattataacctcttaattttttgtttatatagtgacataaaaagagcaaaacaaccacagattgagcgcaagtatattgtgcctacgagttgggcgtgcttcttacaatttttgtaggttgagaatgccccgtgcagatgtttcttccccagcctcagtactactctgtcgcactgtggaaagacagccaccttcctcagtcgcacgctccctgcatgacaccaaaacaccaatattgtcattggtgcactctgctcagtgatagatatttgtgttatcttaatactcctcgtattgattatttgatttgatcactcaccacaaggcagcctaaccctgagagttgtgtctttgtggatgctagtagtgctggtgccaactgagttgttgttgctaccgattcccctgacgtctgccctcagtttcagtgctgcagctcctctcagacctgatgagagtgcaaaaccagaacagaaagaaccattaacaccggttcaagtgatttttccttctttacctataatttgcaggattacatgtagcagcagtggccgtgagggtgagcagttcagcagaggagcagctctcgactccagttttcacggcggaagtcacgccggacctgttggtcccagcgagctctgcagcctctgcgcagacggtggccaccagcgcagcagcggaagcaagcactgtgcccatcttcttgctgtcagcagcctcgacatacttcaggttgtccggcctcagttcgcacaccgacacgaatgcctgcgattgctgcggcgagctgagcaaccgagacagccgcgcgggcctgtgctgcgtgcagcctgagctcttctttcctcttctttcgctggcgtccagtgaccgaaacagcactcaagaaatgacctcgaagaattgctttcatgtagccagcgttgagttgctaatatccaaggaaaacaaagcattcattagcaaatctgacaagataccaactacttcctccgtttcacaatgcaagactttctagcattgcccacatttatttagatgttaataaatctagacatatgtatgtgtttagattctttaacatctatatgtatgtgggcaatgctagaaagtcttacattgtgaaacagagggagtatactatactgcagttactgtgtaatttgtactatcctgtggatgtgccatgttattgttgttatactgcttgtgtcgtgtccttacccaagttggttgcttttagcttatgcttgcgcttatggggctaggcatctcactagctagaacacgctgttagacaagcaagaattgaacatatataggaaggcaactcctgtgttggccgagagttaagagttaagagagtctgagaccattcactggcatacccatgtctggttgaagaattggcttttgcctccactgaaattgaccgtggacagatgtctctcttcatctttttcttcatttccctcttcgtctttgattgccttctccggctgacggtgttcagatgatgttctaagggtctgtgtgcataaaaacaaaacataaaatatctccatgcttaatgattaagcttacgaaagcacttttgtgcatgtgagctctaaaatactccctccatttttttttaaaaaaatgacgttggctaattcaatctcgattttcaaactaaccacggatacatagaaagatatggagataataatagagtaactctacaatttagtaaatgctgacaccgcgttggtaaacggaactgaaactgagtgagaatacttggaagaaatctgatgatgaggggctccatgttcgagagaggaactccattgcctgctcaggaatgatcggcatatctgcaggatggcagcattttgagcaccgtgattcctctttacactggatcactgccttccgcacatcaatctgtgggcgctctgcctgtttgaaaattaagtaatttatcacggtcacagcacaaaattaagtattcaacacagaaggggcgtaaaaccatgttaaaagagagatgcaacgtcatgatgcagaaatttataggcacctggccctgataacgacaaaatcaaacctttctcagaatttgtcagaatctctaaccatgctaaacacaataagtaatacaaaaacttcagttgaatatggttatagtagccttagccaaaactatgcctcgtttcctgcttctgttctataaatcaaagaggagtatgaatatgcagaagcatcaccatttgacatgacagtgaatggcatctttggatggaaggcatcccgagcaccactcctcttgtgaaatgctccataaccaccaacttaatcaggttacgttgagagatatataacagaaccagataaatgaatggagtgctgcggaaagatcatcctgggactgcctatttatatgcaaagtcaagttgttgtcgtccaccagatgtggtatcataagactacctatagtataatacctttttctgtttagcgattcgcatttcttactatggacaattcagtagaaaacaaccactagagaacaatatcaattattgaatcaaaactaaggcccaactgactgtacatacagagtgattaagtaattagaaaactttgtttcaggcaagacaatgcttcctcatgttaaaatcgagtgggaagtaaaactgaaactatatgcagtatttctatttcttttgttgcatggtgactgatcactgagacttctataataagtacagaacactatattctgctgacaaaagagtaagaatgtctatactaattctacacataaagaagaaggagaagatgcagacaaagaaaggaagtactgcagcagtaagtatatctgtatatgaagcctctctctctacaaaaataaaagtgcacaataagcatttcaaggaggatcttgcttgacaggtaaccttgatgcactgatcttgtcacacttgcatgagtgttcggtacaatattgccagaacttgcctccacacgatgcattagcagtcaggtaactctttttggagtttggaccagtttttcccctttcaggtcatgtgttcatcaagtcctgtaaatccaaaatgctttaggagatgactcatcttaaaacaagccaaataggtatatgttgttgcattcaaggtcaaggaggtggcttttatgattgccacacctcaaccggaatatatgctgcaatttgcatgtacggaaaaagaaaaaggtgtatgtgatcatatgatagatggcaattcgtccactagcatgaacaaataaaatttacatggctggagaattatcctgataccagaagaaaagattggaactgattaatgacatgtttgaatggttaggcaaaacaagataagagcaaaccacagggaagggataaattgaaagcttaactagcactactttccagcatgctacatgcatggatcaccaacaccaagtgggcaaatgtagggtcaagctt

SEQ ID NO: 78201 - DNA, 1424 bp, Oryza sativa
tgattgctggcacaagccaccgcgtcatggttgcttgttgccccagccacgctgagctgaggaaacaataactatgccaaggtaccaagccgctcgctgcaatgtatcatcattcatcagcaaaacagacgaacaggttgaggagtgtcatattctggtgatggaagcggaagcagccgacggcttggggcgccgccttgtcaagcatcatccaccgccgggggaggaagcggccgtccatggcgccgctctgcgagcagcggggatccaccgagcacagccgccacggtcggcacacggcgcggaagcggatgtagtcggcgacgtcgttggcgaggacgcgctcggcgatcaacccggcggcccctccccaccaaggttcgaccagtccatcctcctcctcctgcttccccgcacgctccgccgccaccaccgatggggaactcggctcgccgccgtcgccgccggtgggagtgggagttagagtcggccggtggccttctgatgggccaagttgccacccctacctatctcggcccatctaggcctctgtccacgaagcctctgatgggcccatctagccttctgatgggcccatgaagcgtttttttttttcctcctcggctcctcgcgccgccgcctaatggattccccaactccgatgcttctagaaccttccgagcctcgcgcgcgccgccgccgccgcggccatggtgctggcctccgacgagttcggctggtcgatctcgttcaccatcctcgaggaggaggaggaagaaggagtagaagacgcgtcacgcgactgtgggggctcgactcgacgcgcagaaggcgggccaatgtcgccgccggcgaggccgtggcggcgcgcatcctccgcgcctacctcgacaccaagggagatggtccagttcccctgacggcgaagccaccattagtaaccacctgctaacctcctctcctgtcttccctgtttggcttgcttcctgtttgttgggtgagttgcttgcttccatgggatctggagttctggacattgcaagccggtttgcttttgaagcttagtgcctttcccttagatcaacatgcttgtttgattgttgattccactggagtgttctgtgcgaggtgttaagtgtagcccgtcgtttctgcagttgggttaattgccgccctagtgagggaatgtgcaccctaaagattaagatctgtttgatggatcagttcttgtcatacatgtgtctttgtggggatctgggtttgtggttttagcagttgatcgtggggttatgcatataggttacttatctgaattggtgtttcttcgtacagttgttgacccatttactgattgaacacctttacctatgaattgcagcaaatgctggagcaatgatgctggtcagctgtaggcctggagcaaa

SEQ ID NO: 78202 - DNA, 9340 bp, Oryza sativa
gcaaattgcctcttagatcaggagttttatagtgtagagacattttatagaggcattttaaaaaatgtctagaaaacttttactctacagacactttagaaatattttcagcatattttattagattttatattgtagaggtattctttcggcactttaaactgtgcctgatatataaaggcattttcttaagactttgtaaggcacttcttagaataaaagtatgtaataaatgattaaatataagtaactcaagacaacaacatataagtaatgacttggggttgagttggttagtgccttgaagataagaatgaattgtgcaattgatcatgagttcaaggattgtcgaaaaacaagggaaaatattttatttttttacattggtttcatatggttgtgacacaatttaatgtctctataaaatgcctctaccatcttatagacattttgtaaaatgcctcttcgtttgtagagacaattcaccgtaagacacttattatgcattttttaaaatgcctctatagtattataaaggcatttgaaaagtatctctatagtactagaaaaatgcttcgtagaggcatttttgttgtagtgatatactttaatatatacatatagttttacatatttcacaaaaatttttgaataagacgaacggtcaaacatatttaaaaaagttaatggcgtcaaacatataagtaaggagggagtagctattagttagctctactattaaatatatgctccaatgagtcgacatttaaagcatccgcagccactcagttaatgacagagctatatatgtgatgatgtctactttcgatgtttacttccttcattttaaaataaactaatctattacaggttttcttttgataagatttagtataatattaaaatatatcataaattatattaaatttatttattgcggaaaagagagcctatatgactggaggatagacggagagacaagagctagccagcgcacaagtagtcgacggccaactttatctcgccaaaaagatggacagagggagtattaaatatatacttcaatgagtcaacatttagagcatccatagtataataggtcagtcagctaaggacagagctatcaactatgtctacttccgatgatgtttactttctccatttttaaatgaactaacctagtattacatatattaattgtctcgatcagatttagtataatattaagatgtgtcacaaattatattaaatttgtttattttggaacagagagcctctgcgactaggatggacacagaggagctagccggcgcacatgcagtcgacggccaactacatctcggcaaaaaatctaatacaacactttaattatgttggctaacagaattgcccatgtccgtgggcctcctgatgtctcgtgcatctcttccttccacgattcttgaaaaaccagaggtcccagatgattatgattcatgatctgtgacaaaccgagtgttggcaataccaccgaatgactaaaagtggcttttgctagtagaattaagtaggtcgtgctttccgttttttcagatgatcaaaatccctttttacatgtggccaggtatatgcgaaaatcacatttttctacgtggctagtgcaaccgcgggcaaaaacatgcagtcacaaatgccgaccacctcaaaaaaaaaatgaaaaatgaaaataaaaatattccacaaaaccaaatcagccgaaacccccagcgcagcctaccgccagctgaaaccctaactctccaagccgacatcgtcgtcgccactaccaccaccaccgtcattgctgtcatcgtgttcaccgtagtccgccatcatcgtcactgcagcggtcaatgcctcttctgaggccaatggcaataaatctgtagcacccaagtccggcaccgcccgatacaccgtcgtcatcaccgtaattgtagttgtagtcgatagatccatccgtcccgttgtcattggggacagatctggacgccgcaaggtcgctagtggtggatccgcccgccccacggtcacaggcaatagatccacccaacctgcccaagccatgattgtcgtcgtggtcaccgtagtccagcatcgttgttaccgcagctgtcaacgcgccgatggcgacagatccaccactcccgagtccagcgctgccggatccaccgtcaccgtcgtcgatggatccaccagtctcgcagtcgtcggggatggatctagatgccacaaggtcactggcggtggatccgccagcctcgcggtcgctagtgactgatccacccatcccgaggtcgtcggtgatgatccgggcgtcgcgagtcgccgacgccagcactggacgcaggcagtgcatccggctaccccgctcccgtgcccgtgttgaagccgctatcgccactccctttctctcgtgagggaaccattgacgccgctgcctccatgcttgcgtgatggagccgtcgacgcaaccgccgcctttgtcacctcccggagcgcttgcctttgcgggccacgaagtggatcggaggagaggattggtggagtaggaagaggagaggatgagggaggagaggaaaaaaaaaaggataggataagtagaggatgtttttttaaaggtgaagagagtgaggcgtgcgattggctggtggactggtggcaagatggcctcttaacaggctcacatgcgaaaataggtttattttcgcaggtgattcttgaaccttccttggaagccgaatttttgcatacggggacggttatggctcgcctacaccctatattatgtctcgtccagaaaataaattatgtagtagtggaagaaattcagggaaaaaaaggagaaaaatgtgaaaataacttcaacataatcgatttttcaagacgagaaatcctcaaggttggcagaccataattgcccttgtatgcaaaaatcgctcccctaaggacggtttaaggactacatgtgaaaatttcatatttttcggagatgggccttttaacaggcccgcctatggaaataaacctattttcacaagtgggcctgttaagaggcccactgttcagtagccctctaagtcgagctcatccttaaaatatctaagtcctctctctctcctcatcctcatcctctccactccacccctcctttcccccacttcctcttctctccaccttatctccctcaccttatcctagtccctctttctcggtagaagcttgacgtcaatgatagtttaatgtgcggaggcaggtccggtggtgtggcgcacgtcgaagacaagaacgggggcggcaccggcctcggcagttctgccaccaatggtgacaggagggatggatccacctttgttggacttgggagcaactggcctccctctcgcctctcccactccatcatcaacccagcggtggcatcctcaagaggtgtggctcctccgccgtcggactcggaagcagtcgaactctcttgcctcttcctccccgtcgtcaatccggcagcagtgggggcggccttgagaggagaggatccacaaccaccagactcaggagtggctggcctctcttgcctttccttctttatcgtcgatttggcggcaatagcagtagaagggctagatccaccgtcgcgggactcgggagcggcaacgggggctcaggctgggcgtgatgaggacatcactagctcggatatgaccatggttatcttatgtattcatcaagcaaaggtgcatgctttctaggtgggatttacgtgttatatattggaacaaacattattgtattatgagttccgtgtgttctcatttgtagaggtgcttgcttggtgaaagggaaagataccgagaacaaggaatacatggatgatctaagaagttgattgaggaagaaaccaaaaccttcctcaagtctactccaacattaccatgttatttttggttcataaaaggcaagagatgaagttctgcacgttttggattcaaattcgggcctcctgacaatattaactttaaacaaacctagccactgatccagaaggaccctaggggtccatgagttctttttggaaagattatagagtctgctttcagatggttttagtcccacatcaaaattcctattgagctatagggaatatgcaaaacaagtcatgtacctcatacaatcttagtctgatttgggcgttgggacttgtacttgtcgtgggctaagcccaaggggtggaaaaaccctaggatgtctctaatcatatttattccatagccgtcataatttagagtcgggttttgcttgaattatttctggtactatagtttcgatgttcattggtttgtggaacccaaatttcgagttcttaatcattcatctgcatttctattgcaatattttttgttcttgcttgtgtctttgattcacacaccgtgattagccttctcgatgaagtcaattgggtttcggcatggttgataaccagaggaggcgtggtgctaaaattgcatggttcagatcgtattgattggaagccaaatcgtgtgtgtcaagtttccgccaaattaagagttatcaatacctatcagaagattgagacctaattagttaacgggaatccactgccagcgcccacaggagcgacagatccggcccagtcccattggggacaccgggaaaggtggtggcaattttgactgcgacgatgacggccaacaacacgttattgggcagcaaagactagtccctccactccgacgagggaggcagaggagcttgcttgagtctatggcaatattcatggtgacgacgacggcaagagtacagcggcggcatggttggattgggtaggctttctggattttggtttttttgaaattcttattttagttttgccatttttttccatgcagttggcataaggagccacattttcacatgtggttcagctggccgcctggaaaattactctctttcgcagactcctactggtaggcgtgcactttgtcacaccctgaagttcttctcccaagcctaaatcatatttataaatgacctcgagaatttatctgtgtaacagcaaaagagaaaccctaatttaataaatgcaaataataatcagaattggcctgtggaatttttcttggtttctacatgtcaaaataagctaacatgatttttagtggaattttcagagctctataaataattttaaccaattaaaaatgagcataagcaattattaaatccctggaaaatcccttttctttttttcctttttccctttttcttcgaatgagcagtcggcccattctccccttccctccccgtgcgctagctgggccgctgcccgtgccccctcccctctctgggtcaccgacaggtggggcccacctgtcgggcccgtcccctacctccggccggcaccgcccgcgcccgcaaccgtcgccgcccgcctctcccgtgcgcctcgcgcacgtcgtccgctccccgcgccctctcccgtacatcccgcaaccgccgtcccacttctcccgcgcgttcacaccaagaaacggctgggattctaatttcgaatcccgccggccccctctctttccaccttccccacttcgccggcaaatccatgccactcccagccacctctcacctccccagccctatataaagcacaccctcccccttctccacatttttccctctttcgccatctgctccccagctctcctctgccctagcgccgcgcaccacttgccgccgccgctttagccacctccggcccccgctcgccgctgttagagccgccgccgtccggttcacaagcctgagggccacgccgtccaccccttccccgtccaatttcgccactggagcccgccgtcctcacgcgccggtgagcccctccattgccgccgccttcggcaggcatctccgcccgttttgctccccctctccctctctaatccctctcgtttgtttccttaggtcgtcccggagctcgtcccgccgtcgccatcgccctccaccgctcgctgtcgtcgaccgtcgtcggtaaggcctcccctttttccccctctctctctcgcgtcgccgcttagccgcctagctctcgcgccaccgcctagccgcgtcgccgccgctcgtcgcctcgcgctgccgccgcgcgctaggtccgctgggccggcttaagccgcccgcgcgtccgcccggccgcgcgccgcctccgccgtcctatctaccctcgggtagatcggggccgtccgttgctgcctgcgtggcagcccatgtggccgccacatcggcgccacgtgtgcaccacgtggcgctccccttccccggtcccgtggactcggtccaccgtggagcagcggcattgagccgatgagaggtggggcccgcatgtcagcgccgccccccggctgacgtcaccaggattaattggtacatcaccgtctttgggcccgttgggccgtgtatcatattggagtccaatagagatacgtccaggggtccaagattgaccctagaacatatatattcaatagtttcatcactagatcggtttgtggaaccccaagtttgagttcttgattaatcattcatctgcaattgagttgtttgtctttcttgttcttgattgtgttctttgcttcacacgcagggattagccttcttggcaaaatctgtcgagtttcggcacggttgataaccagaggagacgtggtgctgcgattgcagggttcggatcgtgtgtatcatgtttcggccaaatcgatagttatcttcacctaatgaaagattgggcatcccatttccatcaaattcttcatgtggtgatgccgtggcttgatctgatgcgtccagatttgatccaatagctatggagagtctaagtaagggtcaagtttcaagggctctttggggattccgcaagaggtgattcccaaccatttggagcctataaatagggaggtagaggctaaagtttgggtgcccctttgagagagtcacttgtgcctctttgtgagaattttttttggagttttgcatttaggtcttttgaagtgtttaaattcaaacacatgtgaaggtgtatgtttgcttgtctttgagtgttttctttcaacacttctgtaatgaatattttctaagtttgtggaatttaattttagttcttgcctttcgcaatttgaaattttccaatttaaattacgcgatttggatgttttgcccattagctgcattaactaatttctatccacccaaagctaatccataatgaagtccagtctattaaatccatatgtatttaatgcattagcaagcctaattaattattgtagaagattaacatataagtctttaagtattgataaagtcatttaaaaaaatgattgctagataggacatatagatagttgcttattattatgtacattagtaagatatactaatttatacctctcatattcttttaatcgatgtgtatagggaattgggcgacgatatacgcattgattagagtaagtttaatagtaaattaaacttactcttatttatacataaataagagtagaagtcactatcagctattagtcatcttaaaaccaacatatatatataatagattaggtataaggttggcttcaatttttctttccctctctctttctcttatttatacatttaatgtactagcaaaaatgcccgtgcgttgcaacaggtcaaaaatttctaatgataatatacgtttttcatgaataatcatgtcaatgataatgtttgtattttaatgagcggctttttttttataaactgtgtttttttcttacgcgattttctcaaactatttagaaatgacgcttttctttctaaaagttttttagcattttttttgcttttttacttataacgaaaaccatattttctcccctttttccttttttttctcgtgtgtttttttgccgtttttttataattattttctcacgcgtttttttgcttgttttttcttcaaatgtttttttttgcttttttccaatacaggacataggggaaacagaacttttgttgttgctgtttttctttttatgcacctttctgcttttgttctctcttttattattatttttatcaaaaacgacctcaagtactttattataagattatagggactccaatgtaaatataaaaattacagggactcaaatacaaaagtacaaacccaaaaattaaaataatataaaaatggaatgctttcgacatgtaggttctgtttttgtaaacagatcttcaatccggcacatcattttgtttcaccaagatgtgtgatatattatggtacagattgaaaccgagaggagtatggtatctcggactcaaaaggagtggcgccttttatttttcgggggaattgtttatcggatttttttcgccctttttttatcggacaattacggttttttcgcccgttttcttctcgctcgcctggttatttggccagttttgttgacagacgatggaagcatctcttattttcagtagttgagatttgttttggagcctgtgttgttacctctccattccacataaaacattattcattttttgttacctcttccgtccacatataagatccttttactggaaataaaatgtcatatcctataaatagtttgttacctgacattttaactatacggttggtaatctaatccacgttatacttaaacagactatattgagaaatgatccaccaggatcgtggttgcctgcattgtccatcaggtcggataactagtattatacgacttttaagaactggaaggatgtttaatatttttggaaagggtttgaatctttgattccaagatctacaccactagaaattgagtgtagttatggacaaaatagttttggagatttccaaaagcttaaaacacatcgtctaaaccggaaccgttattaaaggacatcaatactttatatttatataatcatgtgtacacgctaaataatatatgtaagagacaatggacaccctgcttctaactataataaaaccttataaatttaagctagtatataaggtagtggacagtggacgagatagtgaagaacatatctacgttaagaaaatcctgatttgaacaaactctccgaacctcaccctttttagggaaaattataaccatgccattataattttgcaaaatttgagatataccatcctggtccacatgtcattgactcatgtggatcctacatgtcattgagataccgatggcatatctcaaactttaaaaaattataatggcatggttccaaatta

SEQ ID NO: 78203 - DNA, 5398 bp, Oryza sativa
gccataatggatttatgcaaagaaagagggaaaagtgggcgtttgtatactgtaggaacgtatatataaaaccttacaaactccatgcacaataaaatagcaaattgagaaagaatcatttgaccaggttgcatggaaatctgacaagtctgaagtttagagattgtatctcatcttgcactttctgttgaataaacaagaatcctttcacaaaagcaatgttgctacctgtccggaacagaaaataggaagtaaagggcagcaaaactgtacagcaatgttgacaaatcctcctcttgatttcacaaaagcaatttatcaaagacaaataaaatggatctctgtaattatgtgcatgatttgcctcacaaaattagtttatgaactgtagcagatatgatgctgccctgggaagtgctatgttcccaatgtatcagtaatacaagaaataaacaatttataggactgagaggcaaacatctgaattgtgatccatatagagactcctgtacagctcttgaatcatggagctgaaaaaacacattattcatttgaaaacaccaaaatacacacaattctctccaatagcaatttactctggtcagtgttcctctgcaactgaagccatataaaaacttgtcaccatgccatgaatcagaggaatgtaaatatcccttatcctaaagctggcatcaatatttacataatgctatacctcacctatatacatggcaaggtcttttgagctgtattttatagctcaacagtacagcaaaaccaaatgctggaaccaaatgcacagaagcttcgggttttttcccttatacaaagcaagttactgaaaatttataaacacattttgaatatatgtgatgatactctttgactttttagatgccttgctagcagacatcttaacagccaggaaaatacccctatgctcacctcacaatcataactttcctatagaacggaaataaaaaataggtacttttacatgaaaaacaaaccgaaattcactctaaaatgcatggcagatttcaggaaaataatgcagtcagtagaaccatcaactcgtaaaactcatgaaatctttggaggtactctccatggttgcgctatgtatgtgtgtgacctaaattagtttcatcttacaccttcagccaaccttgagcttggacaagtccaagttcagctttttaattgccctttttaggataagtcctagatcatatattttttaccctttttaggattcgggtaaaaaatggtttactgaacttatgaaatttagctgcaacttaagaggattgaaaagacattgtgaaggcatctattttcacttatttatttatttattagaaggtagataaggaaactgcaaatatcaaaatacacgagcctaaatattttgatccgaaaatgtataccgatctgaaaccaatcttttcgtaattaaaaaagagtgaattacatattgggctaggttttcttacatgaattgcacaatggactaagtcttagcaaataatttcactttataccggctattgttaccatagcatgcaatttggactataggcccacatgtcagccagatcaagtgttctctcactcttccccttctttcttcttcctccagacccatcattccccaaccccacatcatcaccctctacttccattccctgtctaccaccatatatttttgctcactgctgtttgagtttgatgatgagatcgagcactagcagatcctgccgctactgctgcaagaattagagcacaatacatcacgaggaaaaggagcagctccttgttgggggggggggggggtgctggtgcagcctgagctcgatctcgatctcgtaggttgatgtacacagaccttgagtgttaggaatgtgaaacaaaagcttgagctcgactaggatgctcaatggcaccattctgctgcagcattcaggttagtcgtgttgtgcttgtgccaatccaccagcgtgagccattatcattggcaggcaggtgaatctagctaggtagcacgttgcaggcagtgactgagttggaacaagtaggagacgttgaagatagggttgtctagtatggaactaaaggtaaaaaaccctgtgctaaagtgaaaacatgagatgtgtcatagcccaaagtgaaactttagcaataataactagcccaatatgcaactcactcttaaaaaatatgagagtacaagaaaaccttgagaatacaatcatacgaggtgatgtggatgcgcttggagtagtgcgatatagatctgtttccattattaagaaatcaatttagttttgcaataaccccttaataaaaataaaatataatgcataccaatagattccagctaattagccaacaaccgataacctaagtaggaagttatggtactcgctgatattaattgctgattgaagtaacctgagttccactatccaccaactttgcatatcattgataaccttcttcaaataatctccaaggaagacaggggcaagagtatattattttcccattttatattttctacacagttttaaattgatagcctcaagtcaaaactaaattggtctgatagatcactccatgtagaagtcctctagggagaggagatctgttttgcagcgtatcccctgattatgcttgatcactccataaaaatgaaattacctgtagccttcaaatgtgatgaagccatgtaattttctggtgccatagaattaataactgatatacatggttcagaaacgagcttatatttgaagcatgatgcagagagtatcaagacaaaacatgtaaaatgtgaaaggaaaattagcatccggttgaaatatgaatcaggctgaacatttccaatgaatagcacaaatagaatcgataatacaaacctgaagaagaaatgcctggctgggtgatggcggcgatgtggtcaggcaggcagcgctggcttcggctcggctgtaccggtcggtagtgacgcggggcgacgatgcaggagtcggcgccggtcaacagcggccgcggaggacatcggcgaggcgggagtcggtgccggtcggcagtggccgcggaggagatcggcgaggcgtcgttggtattgtcctcgacggttggtggcggcgcagacgagggagaagtcgatctcagtggagttgaaccgggggatgcggtggcagcggtgcgacggtgagggcgaggtgatggtgacctggtccggcggccattgcagacttcaagcgcgaccgtgagggcgaggcgacgacgatttggcgagagatggaacgcgatgcgaggggacggggttgcggccttgcggggggtttggcgcagatcgcatcgtgggtggacaggaagctcgtggctcgttagttcgctccgcttgtgactggctcggctcggctcgtttgaatttcctaacgagccgagctggcattttagctcgttagatataacgagccagctagctggctcgcgagctgctcgcaagtcttaacgagccaggactccatcagacaacccaaaagcccaatacaataaaaaggcctaagccacaagtagatactgtgcaactgcaaaccctagtcctctcgagactcactcctcaattccccacctggccacccgagacacgatgctgctccgcctctcccccagcggccgacgccaccggtctccgactctcccccagcgcccgccgccaccagtctccacctctcccccagcgtcctccgccgctgggaaatccagctcccgccgccgctggtctccgcctctcccccagcgcccgccgccgtcggccacctcaagcgcccgacgccgctggcaagctcaagctcgtttcctcatggtccaacagtgaaccgttcaagtgccagcggagctacggaggtgagttctccccctccaccgtcgagctcctccccgtggttaacgggttcgcgatcttaacgagctagctcgagcttgttgacgagccaagccgagctaggtttctagctcgttaggataacgagccgagccgagctagctcgttatcctaacgagccagaccgagctgagccgagccagctctacatccacccctagttgtgcgaggggatggggaggagatcgcggcaatactggtggcgcaaatcggcggatgcggtgtgggagagaggaaggtgtgggataggcggatctgggagggaggagaggcgcgcctccggtgccgtcggatgtaagtcatcggatgatttcataccgttcgatgtgtcacacgatgaatgagtaaagagtaaaatcatttatttgaattatagggtagatatagcctttaaaagtaactgaacaaatgttacaaacgaataaattttcttactaacatgcatcatgtactacgaaaacaggactaaactccatcctctgtttctcttctcttacgtttgcacatgttggcctgccagcaattgttagacatacatcatgtactacgaaaacagggctttaacaacaacttgatcaccatcctctgtttctcttctcttacgtttgcacatgctggcagagaaagcaattgataggcagaaaatgcccaagccaagtttaatcgttgcaatatgcggctgacaagaattgttcttgcgttttgctttcgtcatttttccatttctttttcacgtacctatccttcacatagatcttaaatccacaaacttctaaaatcattattcacatgtgtacaaattgtacaatagatcaatctattactgataactcgattcacctatttcaaatttcactttccccaatcaaacgaaggacatgagtgtcaaatgtggcaagcacgtagactaataaccttatatccattgccgaagctaattcacatttcaaaattttcctaatcaaatcaatccacggacaaaaagtcagacatgtaaattaatgaccctcagcccacttccaaaccgtcggccccgttaaggtttgaaattttggttagaaatttcagagtaccaaccccacacacattggcacgaaactgttcgaaaatttttttttcgtgaatttaataaaatttaatcaaatacagtcaaaacttgttcccataccatttttctcattccagaattttgaaaatataaacccaggtctcgatccttcaatgccttgcagtaaacaatctagataaacgtggctggccaaataaacaaatatgccgcctataaatgcgaagctcaagacgaagattgcaagcatttgctcatggaatgctagagggttaggataaatatgattaagagggagtgtaatatacagaagattcatctccaattaattagtatagtggaaaaaggacataagagaactacaatacacatgt

SEQ ID NO: 78204 - DNA, 6783 bp, Oryza sativa
atttgttgatggacactatgagcaataaaataatatatacacctagctgaggagagagaagctatgtgaaatgtcaattttgcccttttctttttttcactgtctttttatttattcctgctgctcgtttagtgtgatgatagtgctcgtgtacgtggaccccttggtcactacgtgcgccggcagcgccgcatggtagagcatcgtgtcccgatgtccttgcactgtcccgcaactccgcatggtacgtggacccctggcgctgtcggggtaggagctgttgtggcagacgctgagcgacttgtcgacggaccagcgggcgctaggcctggtagtgcgaggtcgctgccgttcacggcgtttgtgctgctcttgtcgctggcgctgctcaagctggtgccactgtgcgcgctctaggcggcgctgtgcctcctccgattccccgccgtgcgcgccgatcgagttcaggcaacacatcgccatgaactatctcttcgcgccgtggatctcgtggctgctgctactacactcggcgttgttcctccgccccgacgcgcgctcctaccacacgttgtgatgggcgttctcgctccccaaggtggtgttcttcctcttcttcgccgcgcggagcatggtagctcacctggacgccatctcgaccccctttggcacttgctgcaagatgctcttcttccaccgccttccactgacgctcgccaccggtcaaggccatcgccaccacccttgaacctaagtttggcctcaagggcaatttggtcctttttaattgtttgtccctccatttgttccgaaaataataaaataatagtgaaagtgtccaatggcaaattacatgatttttggagtgtctttcagccgtttcacgattttatggtgtctcttagctaattacatattttttgaatgtcctgtagcaaattttgcctagcatttacgcactcttatatcatacccggacgtggatgaatacaagggacggacaaggctatcaccacctgctgcctacctcactttctgtcggacatacccacatcaaacggtatttatctaacctaagcactatgcttatgctagtaaatagtgatactaactcctcaggacttccaccattcggatggacaagttagagttagagcaactcatcaaggtcatgggatcgttgccgtagcatagatcgactaatctaatcaagtgaaatatataaatgaagtatatcttattaataaggtatataactactaaagcaatatataaattatgaacactttagaagataattctattaattcaactatatagtcttacaataagaataaagtattaaagatataccagaatctcttataagactataggaccgaagatatgctaaacctattaccactagtactatagaaaatataatctctgagaagactataggaccgaagaaggcacacgatcaagaacaaaagaccaaacccaaggctcccgtcctttatttgtcatatctttttaaacaatagaacaaggtttgcactgcctcctgtaaacatgacacatatatggggttgcccattttcattttttatctgaatttctgagataccaaaaatttcatgattttcatacttttttgcaaaagaattgtttgaaattttatcaatttttgactcaaaaatttcgtgcgagatatttgctttccgtagggtgtgaaattacctgcataatagtcccatactcagactaaattaattataaaatggctaggataaactctgatccggactcgtcatcactaccttgaagtatattttagtgagtgtgggcttttctgcgtgctagccgtaggtactctagaagtctagattactcattctattttcaaataattcggtgttgactattaccattctaactttgaccattaattacttttaaatcaaaatgtaacattactatgaacataaatttcatggttatgtttaggataaaagaaaaggttggacccaaagaaggacttggattcaatggttttaagaaggtagaggtacatatattttccctggtgagcgggcttgataagggtcgaacccgggatggtggggtgcatgccagcaacccctgcccctgcgctactagcacatcacgttatgtttaggatacaacacaccttaatatcgagatatatttctttttctatgaaaatgaatggtcaaagtttataaacgaatagcgtccagtgtcaattattttatagatggaaggagtactgttttgatattgacctcaggacgttgtggaagcatcttgacttggctatttatagatgatttgattttccactccatatcgtcagtgagcaccaggatagaaaagtcgatatgtttgagagatgtgatgtgccggatgccaacctctaaactgccatatgttgattgtgccctctctgcaccgaattcaacgctaagccattcgagctttggcatgcctcctttgaataccaaaccaggtccagatctgttgcagaaacgtaggcgtgccaaacattggaatgcaccatggctgatcctgattccatacacgagagcttcccctatgtctaggtgtaggacaataagagcaggcaaatcttcaagaatacgtacatgttctcgttccatttgtttaacgtcgatatccaagtaggtgagacatctagagagtgtgggatgaatccacttcggaaacctggaaaagtaatgtatattgcaactactcttgtaaacaaacttttccaggaaacacggcgaaggacaccaagaatctgcgaaacaatctccacttccattgcagctggtaatatagacttcccggaggttgtttcctccaagcttgcaaagggatggtatcattgcttcttttcctgtttccccttcagacaagaaccttactttgagcaccctcaaatttctcaaaagttgtagatctttctgaaattttaataaatttgtggagcttctacaacaacctaaaaaccctaattcttgaagagattccatgttaccgaacccatccggtaatatgagatgatgtccaacaagacgcatcaaccgtttgagctgaacaatactttcaggcatcactaataatgaagtatggcgtaaatcgagtgtttgcagatactctagcttcccaatttggacaggtaggcagtcaattcttgaccaacggagccccaagtatcttaggtgaaataaacctacaatgcaatcaagataactattcctgagatcacaacgctctagattcaacactcgaagagtaggtaggtttaaaagaggagacatcatatggccatcaacatggtatatgttaattgaacgaaggttagacgaattcatggttccttgtgattttgcccttgtatattcttctttgttcccaactaaaagccggcgaatccgtttacgtgaagatgggtgatcctgacaatccaacttggttaaaaaattttcttcagttgactgatggatgatgaagttcaaaactatatcatggactcgacatccatcttctccatttggcatgatctgtatgtgttggaccaagctcctatttatcagctcgtagaaataactctctgcaacttcctgcaaagtaaagccttgtttttttgttatgaatccttcagctatccatctccataccagcacatccttaccaatcttgtgatcctcaggaaacgtaccgaggtgcagtaaacaacttttcatatgatgtggtagatcattgtaactcataaacagtatcttgttcattacctccaggtcattatccttctcactagtagaaacaatataattcagaactctctcccattcttcccttgttcttggtttatcagctaacaagctagctatagtaataatggctaaaggcaaaccatcacatttataaagtatatcactgataatcccttccagctgactggggcattttttttcagcaccaaaagtccttgtgagaaataaattttcagagtcacttttgttaagaggtttcatctggtagacaaagccctcatctgaagcgccgcagcaagattgagctacacttttgatccgcgttgttgtgattattctacttgcgtgcttgtttataggaaaagcacattgtattgttttccatgctgaccttttccaaatgtcatcaatcacaataaggtacctataagcaagtttgtgaagcagtatgaatcatttgtaggctaataaatgcacccatattcatttttgggaaacagatcccctgactttatgcagtttgcagttgtgccactgacatgtgggcctcactttggtatggtctacatgtcagtggcataaatgcaaactgtacaggggatcctcattctcatttttgcatacgtacatgtgaacaatctatatacatgtaaaactatctctgcatgcaaaagttgtactacattttgtgttggttaatttcagcctgaaataattttgattatttgaaggaatataacttcatcattggtagaaacaaaataaaaacaaaaggctaccaccactatgcagggcatggatataaatcgatgtgtaggagagaccacgatagaaaattccaacaagaaactttaatgaaaattccaaatgaaaagaactttgaatgttctttttatattaatctagctacaggctgagagatgcacgggttgattaatgatgactagaatataagaacccgtatgaaagcacacgatagaaagtaactcaagtaaacttaccgttcatctttcagacatgttcttagtttgtcgataagttgttgatcactatatgattccgttggttcattgctcttaatttgagaaagcaactcccttagaaggttatccatgttgggcttttgcgatacagacacaaaagctgaaaaagagaattgacctttaattttctgatacacctggttagcgagagtagtctttcctaaacctccttgtccaacaatagagacaatcttacgctgccctattggctccacttcctcactaccaaaccaattgatgatttccttcattggaccctggatgcccacgagtttttccttctccacataaagggcaggtagccgaggatcaatctccctacacaatttgctagaagtgccctcttcaatcctatacctcttttgccgttcgtacgcttcatttacaagaacatgaagttcctcgatttccttagcaaacttgtggcgatgatgaaacttcttcaccttgcggagggtcttgtggagaaccctcttgactccattggttgtgtcagctggctcatggtcgatacggtaggtgaagagatctatgctatcctccatgtcgtaggccaactcgcgcatctccgccatccaggccttcacctgcacgtctggactgtccatggccgcgtacttctccagcgcgatgccgatggtcattagctccttcgtgagctgttccagcttcttcctcacgcccttgacctccatgtacttcttctctatgaggttggtgagttttctgagaagagggctcatcgcccccgttagggcgctcaccacgatctgctcgacaacccctcccatctccctcaatcccaggctataatcagtctactttcttgaatcagaatcagtcgatggatcgattatggtgtggcaggatgaatttcgtagaggtgcgatgaaagaatggttggtcaccctccagctagtgtgcctgtggcgtagtagtggcaagagcatcagttctgtccctttcccatctttcaattcaatgggtgattgccgggagcatcaatttcgtgtctgagaagaaatagccaggaacccatccggggctactgactttgtcgttgagatttacaataattacagataattaaacgagtcccacagtatgttgagatcactaacactattaaatggattgcctttagtttacgttggttgggaaccttctccttcagcacacggcaaacagagaaactcattcgcacatgattaattaagtataagctaaaactagcaccggtggagaaatgctttttagtcacggttcgcaaccccctatagtcccggtttttaaactggaactaccaatccgggacgtcccggttcaaatacccgggactaaaaatagatatttagtcctggttagtaacaccaaccagaactaaaaagaggggatctttagtaccggttggtgttaccaaccggggctaaagagagggttgcggcagtgaaatgatcccctttttcttttttctttttttttcttttttattttctcccaaatcaagtgggatacatatcccaaatcaaacccccaatccacaaatcgaagtaacatctcaaatctacatcacaaatcaaagttacttatacacacaaataaatacatcataaatcaaatacatcacaatatcctaagaaattactcaaatacatcacagatccaaacaatgaatcacaaatttgtaacttctcagtcaaatacatctcagtgaatcatcacaaattaaaaaaaaaagaatgctactgccgccgccggtcgccacgaacgactggcacggccccaccggccgccaggcgcggccctgccgcccgccgcccgccgctgggcacgaccccgccgggcgccgccggccgccgcagcgcgcggccccgccgctggccggcccgccgaatgggaaggggaggccggccgggaaggggaggaggaagggggagagaagggggaggggagga

SEQ ID NO: 78205 - DNA, 6476 bp, Oryza sativa
taccaaccgtgattaaagtggtgatctttagttccggttattgacaccaaccgggactaaagatcctcggccccctgacatacatctgacaggggatgaaccgggactaaagatagtcccggttggtatgatcaaaatttttataactggaactaaaaacaatctttactcccagttctttttggatccgagactattatggattttgccggaccgaccaaagatggtttctccaccagtgtagcttaaaaagtatgatttttttgaaaaacaactttcctatagaaataccgtttagcagtttgaaaagtgtgcaggcgaaaaactagaaaggagatgggaacacaaccaaacaaacaaacgtactaaaaatatatataatccatccttgacatgaacatgcctttttggtagctactactacttgcctagtagcttcgtcctcctttttagattaaaaaaaagtactcccaccgtcccaaaatatcagtacttttggactctgatacggttttcgagatgctattttgatcaatgatatctaaaagtaaaatgttttaaataaaagagttacatattgtaatagtttatttaatgataatcaaatctagtaacatcaattttacctagttgatccttttttattttttttgttatctatctatctatctatctatctatcaatctatcaatctatctatcatatactataagtccattaaacttcctacaaacgctctcaagcagccatatggtactcatataaacactcctaagttaccatgtggctctctaataaatcggtagacccgctattttcatctattagatttaattttagaaaaaaaaatcccacaatccatctccctcccctctccccactagcccaccctcctcccctatggtacgtactcacctatccctcctcccctatggtacgtacgtacgtatcctccccccacctatccgatcttctcatctctttctttcttttcaagtttattacaattaaaaatatattttttaaaataatttccgtatagagaaataatcataatctttaaattgcacataaatctttttatcgttattcattatcgtattcatagtgcttaactaaccattcaaattagaagctattaagagcggcgggctgggcggccgctcgcgtgccacgtcggataggtacagtgcgcgggtagaagttttgcgaaaaaatccttctattttttgtaattatatatatgtccttataaacagtacttgaaggggaaaaatcgcggaaagggactgctctgtaaaataaggaaagaatagggtttttttttcaaaaatgacgcccactaatctaaccccccagaccttatccgccgccgcccgcaccctctccctctgcccgctccctctccctctccgccgccgccgcctcggccacctggatttttcacattttgatccttttaaaaaacttatttcgcaaatagacccctgaaaaaacttatcccagaaatggtcttttttggggcgccagagtggctggcgccgtcatccaacgggacagcgccagcctctctggcgccgtcttcctgccaccgtggcgcacgcgaaccgacgtggcaggaggagcatgctagcgccgccgcctccattcctatttctctgtatggagttgcaacggtgtcatttttattttattttttcggatgttttttcacactcaggatcacgatacaaacaaccacaaaaaaaatttaaacttgaactaccacttagctaagtctgaaaatatctagcataccacttagtttactttgcaccttcactcgaattagaccataactcctttagtaaaaccctttgatcagcatgttaaacataatgcactctaccactatataaattacttaatctaattcaaaatataactacatgaaatgacatatataagttaaacagtacatagagatataatttttttatttttatttcattttttgatatttttttcacacttaggagaacataggaaccaaccgtataaaaaataaactcaaacggacaaaatatgtgacatgtagaattttccaaaactctaccgaaacggacaaaatatgccatctattaaaataggcgtaactttctcatacggactcggaatcaggcaaataatatatgaacggacatctacagaaaaagttacatccgattctcccccgctttgccgggttcggcgatattaaaacctccaaattccgcttgcaagattgtgttttcgaggagagaagtttttcggtggagctttggaaaatttcacatgccaaatatttcatccgtttgagtttattttttacgtggttggttcttgtgagttcctaagtgtgaaaaaaatatcaaaaaaataaaataaaaataaaaaagttgcacatctctttcctctgcactagttcggagagaggagaggagaggaaaaattctacatgtcacatattacgtccatttgagttcaatttttctatggttggttcttgtgtgtccctaagcgtgaaaaaaatatcaaacaaataaaacaaaaataaaaaatttcgaggggggggcgccagccactctggcgcactccccctagccacctcagcatcgccccgccacgtcggcggtgggacggcgccaaagaggctggcgccgtcctgttgaacgacggcgccaggcactctggcgccccaaaaaggaccatttttgggataagtttttctggggatctacttgcgaaataagtttttcaaaaggaccaaaatgtgaaaaatcctcggccacccctcgcgccgccgtccccgcctccgcctcacaccgcggcccctcgccaccgtccctgcgtcgcgctcccacctccgtctccgcccctcgccgccgcccagcctcttcctcgcgccgccaccgccgccgcctccgcctcgcacagccgccatccccgcctccgcctcctgccgccggcgtaagaatccagccttgatgtggtcgggggacagggatctgacttcccccgtgcaccgggcggtgccgcagcctccgtcccccgaccacatggaaggggcggcctcgggtggagctggtgtcgttgccgcgacctcattggctaaaggccggctgtccgtcgatctggaggagtgagaggtgacagcagcagtaaagagtgggaaggggctgtcgacggcagtatgggggagaagcgtcggagcccgcttcccctcctctcacaggggccgccgctgtcgaacctgtgttacctgggggcggagttcaggttccagcgggcggagctcggggcggagatgatgaccgacggtggggcagttcgatgagcgccatatctgctcttctacaagggccccaaggtctgttcgtcccaggtcgatgctaaggaatctgaccacctatgttgctttcttgccgctgccatcaagacaccaagtcgagcttcaagaagggcgtgagtgttttccccttttttcctgagataagctgattagttgctttcatgtcatattactgagcttgttggagttcttttttttctatttagttttttgtatagtgcaaactgcttggtggtgtgtcactgaggttcctacagacgtactggatggatgcagatgtggtaacagccttcgagctaagccgggccatcgacgatggagtgctgcagcctttgccctttggttcgctgacatgctgttccttctatgtgaggttgccagtaccacggactcgccgtcagcactgtgcaacgtcatccttctgcgctagactgactccaccctctgctgagtgaggtgatgctaatcactcattgccctacaagtgtttgttgaaatgcatgctctgtgttgtgacttgtgcagttgtgctaatgatggatttttcctggtgacgattgatgcagatcgcgtgctttttccaccgctacaagtccgagcagccaagcacttatcgcaagaatggtccgtgtcttaaaactttcccaaaccgtgcatttgtgttgtgagtttgcaactgtctgcctatctgtatatactactacttgaatgcactgaaaacttcctcctgtatttttttttgttatttactctacaactggtgggatatcttatatgtcatgttgaaatgtaaccttttaaagcaaaattgcatttggtcgaaatgatgctagatggtatgttatttggattacagtgtgaatcaaattaggaggttgaagctaagtggttttgttcaagttaaagtttttctataaaataatctaccaaaaagatatatatttgatttgcagatatgcattgaaaattacacatttgcttggcggttatactgttagtccttatgaattgtttagttatttaagatgaaagggaaaatcattttatatcacaaaatttttttcatggattggcaacatcaaacagagcctgtggtttgctgtagcagtagcatactagaaaagtgtgtggtgttgatgtagtgcccgcatggtttagcttgacattaaaatgatgtgcagtccagatttgaggaacattgttgacaatttgctatcacctatcactgtctgtgttgaccacaataatttcagatgtaccatcccgtcttctaactagatagacgcatgaaagtttgttgcatcaattccagcacttcaattttttgtgaaataccattagaacataaccactttgctgtgatatgaaaaataaatattttatttcttggaaggttgtatgatcatgtattcttatactatattgttcattgattttcttttccatttgatttgattgactaatatctctaaattttagctacccttatggtagcctaaggaaaattgtatgtttgacagacctgttttctgttgtttgatccctccaggaaaaccagctgccattcaatatggcactggttcagttgatgggtttttcaacgaggatagtgttacagtaggtgatctggttgtgaaagatcaggtatgcactatatatctcagtcactgactatctctgatcatatactccaaaatattttagcactgttgcttcaccgctttaggaattcattgaagttataaaggagccaagccatatactttcatggttgcaaaattcgatgacattcttggtctcggatttcagaaaatagctattggagatgaggtacctgtgtgttaagacaacatgatctatagtgctatgatatattggtagtctggtccattcattgcaagctgctctttttcttaaattatttgtgtacttttgggctttttgctcaataagggtcaatcctcgcaaaatataatctaattcatctcactcctttttaactcattagattatcgctatcaccttctatagagttccttgcacagaaacctctgttctgaaaagctgcaaattatttgtagttatggtgtttttcttatgcattccatattggccaaggcaccattggctatgaccaagtagtctgctcatgtgcaagatttgtggggatcagatatgtatcatttctccctactattgtttcctaatgcgccctggtgttgtttcctcattttatttgttccatctgaccgggcatgttggttgctatccagttttccctttagttggattccaaaaataattgatatcccttaccaccttttctttgtgatacctgagtcttttattcaacttgtgtatttcaccattgaccctttgcaggtgaatatttggctttgattggtgaaaaattaatggagcggatataatcgaacttggacttgctacgcgttgtcccatcagtggtgtaagatccttttgattgcactatagatttttcatttttggtggtttaacgcagtaggctgacactccttttaactaacctattgattatttattcttggcttggacaatatggggatattgtgtgtccggataagagtaggcattatttgtaggtaggacatacaagaagtaaatatatttataatttctactctgtgaaggtattattaagtgttttagcatgtcataggcagaagttgctggaatggtagataatcatgccctcttttaaacatagcatcggaattagagtagaatcaagatgctttcctttcctttctatttcagtgtagtaccattattctgaagaaagacacacaagactatcatggaatagataatcctatatttataaggcgtgtaattcttaattcttttaatcaagccgagtgctattttgctgtggctcatgaatctttgcgttatttgtaaagctgtggtttatatattcctttgggagcttgattctcttcgaaattgactcaatcacctgtcattggtggattacctgtcttcatgcacctttttgccatacatgcaaatatgtagtgtgtaggcctcagggataaaaatgtatttaacaatatggtgtatatg

SEQ ID NO: 78206 - DNA, 40553 bp, Oryza sativa
  unsure (1)..(40553): unsure at all n locations
atgagcacaacgagcatggtggttctcttgaacaccaccgctgacatgtaggtgatcacggtgcctagcttgatgattgcggcttcaccaattctagtacaaccgatcacccatgttttgttgatgttttcacctgaacatgatatgttctatctttttagttttacttgtcaaaactgaaaatgtggtctcgagattgtgcaggaagaggttatcaaacaagacaatatatggatttgttggttgattggtttgccttttttttcctattttcatcaaacgtttgaataatttctttttttttcatttacttcccgttgacatttactacatgggttatggtaacagagtttttaagaacaatgttggtccctttcttatctgatgatatgtgaggatgaagaaaattcctgtctatagcaatggttgatgaccagtgattacgatcaaactatccagaacccattttgtaattaagtttagtacaaatcataaaagcgagaggttctatctactgtggaatatgttgtttccattgcaggatcaacctacattaccatgaataatagtagtctgattgttcaatattgccaaaaatgttcttgtatctgatttaaaattctgagcaaatggtgaattagttctaagggatttctagatgataccttgtgcaggtttctgtggctaatttagaattggtcgtatggtgctaaattagcactgctaatagctagggcggttggtaaattttcgaaagaaattgtgttgctttagaacgaaatttggctaattttggtgcataattgacatgcgcgatattcacatgataatagaaattttgtacagagcaagtaccaattctatgtgtggattttatatcttccctggggcctgggcagtttttgttgatgtttccagccatttatgagaaaaattttgtcctttaaactcctgacatgtgcgattaggtatccttggcgattccccccccccctctctctctctctctctcaaaccgagagattcataaatagactattcggttattctgtttttttcaccttgggtgctctgttgtttatctcaaatgggttgaagtctgtttaatcagtacggcaaaaaccagtgtacacagtgatttgagttaattaaaaaaattgtaacggcagtcgtgttttttcagtttttttcatcctataccgccttccaagtcacgtgctattcgactgcttacccacttgcacgaaatatttataattaaaaagtacttcggcccgttctaacacgttccaacaaaataggtgtggtgaaatacttactttgtactttttcttaaatatatttaatgtatggcctaattcaaattaaagctttgattaaactgattattttactaacacaaaatttggtcatttattatgggtcgtagcattagcatgggtatattactggtataaattaagtgtgtcctccgctatataagccatcacatatgatttgatttttatttatttcattcttacatacactacgagaaagtaaaatttattttatggttactgaaaattttcatttcattgattgacgtagactatgttgcgggtgaccacattatttgataatttttttcacatttaccgaaacattgcataataatacaacattaacaatagaggagcaatggttcacatgaatgctaacacatgttactacctctatcacaaaatataaaattctagaaccggatatgaaatatttagtattacgactctggaccgacctactgtctagattagtagtattagaatttgtctcatccaattctaagttgttatattttggaatagatagagtaccatatagaaaatttttatggtcattgaaaaaatatctctaattagctaaaattttataccacgtggtacggaaggtaccaagttttacctcccaatatatcttttcaaggatgataaaattaggccttgtttagttccccaaaaacctttccaaaaacatcacatcgaatctttgacacatgtatggagtattaaatatagataaaaaaaaactaattgcacagtttgcatgtaaatcgcgagacgaatcttttgagcctaattaattagtccatgattagccataagtgctacagtaatctacatgtgctaatgacggtttaattagattcaaaatattcgtctcgcggtttccaggcgagttatataattagttttttcatttgtgtccgaaaacccctttcgacatctggtcaaacgtccgatgtgacactaaaaaggtcttactctaccaaatgaaaaaaaaatgtagctttagttggctctagaaatcctatatatttctaacggtattgctaaatctctgtcgccatattttgggttcgatttcaatcggatagcctgatccgcatgatgcgcatgcgagcgtcgtggtcgactcacgtccgtagatcatagccggcatggtcagagattttcctctcttttcctgttcactaaaaaagtgccaccattagtttcccattaaattagcactagcatcgattctctactaatagctacttacatcaatttaggtatgtaattttagaacttatacagtaaatacactaaaattatatatgtaatttagagacttacatatgtaattttgggacttacattataaatacattaaaattatacgtttagaaacttacaatataaaaatatatgctgactattttttcataaaaagtatggcgccataaatttaggtagttttctaatcaacgctgaaatttcattttgtttatctattctattattatgctattcatcttcttgcattgtcactctgagctgcttgttgggtcaaggacgtggccggcgaagagcaccgcgcccgacgtctcctccaccacgaagaacgcgaacggatggtccgcgacgaagtcctccgggtagctcatgctcaagagcctgatcgtgcaggccgtggacgccgccgcctccgtgccttcctcgttcacctccacgaccgccctgtggaacacctcctccaccaccagcccgccgccccgctgatccacgccctccgccatgccggacaggtcggcctcgccggcgtcgaaggcggccgtcacccccatcccctgcagaaccccgttgatctggctgtagaacgacaccttgaacctcggcaccctgaggtcgccgacctcgcgacgccgcgtcggccggtggtcgcgcaggaaggaggacgacgacgacgacgccgccatcttgtcgacgagcgccggcaggccgtcgcgctcgtccggaaggaagatgtacatcgacagccctacgttctcgccgccgtagtgctcgaggatggcccgagtgatgctactgttggtgatagtgtcgccaccatcgccatggttcttcatggtccggtggtggtacggcagcttgagcaccgtgaagccgtcgtggaagccgatgtactgatcctcccggctgctcatgaacgggacgtcgacggagctgccgtcgaggcggtggaacttgccggtggtggtgctcgacctggggaagggattggaccatttgcccttgaagtagatggcgttcacgagcacgagggcggtgtcgacatgaactgatccatctgggaggatctcggggatgagcttgttcgtcgccttggacacccacttgttgatcttctttcttgatctctttggctgcatatgaaagttttacataccaagattgatcgaatttactacatatgttggtcgaaatttcacaaatcgtcatattgaaaccctggactgactgacctgtctttggaagttggcggcgcgcgtcacggccttgtaggtgccggcggcggcggcgcggtaggccggcttaagctcgagcgtctcgtcgtgccagacgccgcaggcgtcggagacgcgcggcccgccggacgcggactcgtcggcgaggccgacctccacggcgcggcgtacggactcctcgaggtcgtcgagcgacgcggcgccgagcagcgcgaggagctcgtccagggtggtgccccgtgccccggccgccaccagcgccagcgcggcgtacagggacgccggcgagaagacgaggttcttgttgctgctgacgccgacgtcggcgagacgcttcgccaggcggagcgcgaaggccgtcatgccgccgcagtcgccggcgttgtcttccatggtgatgggtgatgatgagatcgatacttcttgattggatcgcaatgcaaccagggtacgtagatcgtgctagacgtacgccgcaagggtcgttaaacgtacgtacaaattattactgtatataagtcggtgcgcatatatggcagatggaagttaattaagatatgtttacccttaaatttgcaggagaatatggagaagataaaactaccacattaaccatgaataatttccttttatacggatggggattttcatccctcgaggggacatcacctcacctcgttgcaaaatagttatcaaaacatttgaaaaaaaaaatgacaacgtagattaatacgaaatatatcactccacaaaaatacaagaccaaattcaacttctataagttgcaacaaaaattacaaattaaactgaaaatagttatcgcacattcgcaactatatttgttatttttgttacaacttatagaagttaaatttaaacttgcatgtttgtggagtgatatatttcatattaatatatgtttctaatttttttttcatatttttttatgactatttaggtgacatgcacgaaacgagaggatatcccctcgagggatgatttcactttccccttttataccattgtaggcagccgcgcgccgcatcaggctagatttaatgctgcgcttcgaagcacacgacacacaggtcgagtcgagaagaaagccgtcatcaccgacggctactagtattatgccagtgttactactacacaacaccatattggtgccggctagtgccagattaattcccggccagcaccatgaaagaggcactgatgagagagggttctcacttatcggtgccgattgagaacgtcatgaactgcatgattttttatttaaaaaatcagagaggcttagctcaattagatctgatgctttaaatccatcaaagataataaatctaacaaaaaaagagtcacaaaatcaacggcattccatcccgaatcattggaatcaacaatactcaacttggtgcataactgaattcattcgaatgagcaacaaaaaggaagaagtccacaaattttgggcagtcaagaatgcaattcacaatggtgcaggagctaatatacatgttggatatagcacaggaagtaaggaccttgtcggcacaggagcaccgttttagaaaagatctcaaataaagccagaattttggggtggcggcagtggaaaaggcaaggaaaaaacaagcctcgcgagttagatggctcaaagaaggggatgcaaacacaaaactttttcacatcaaagtcaatgctcgcagaagaaagaattttatccactgtctgcagcgtggcagcaacaccattcacactcatgaggacaaagcagaacacctccatgcgcatctcacctcaattaatctgggagcaagggaacggaggaactgcacaataaactgggaggccctagccctggaaaaactacaagatgaagatacagatgacatggatggccccttctcagaagaagagatttgggcggcaatgtccgaaggaaaaggcggcagggccagacggttacactggggctttctataagaactgatggcatataatcaagcgagagattctagaggtctttcaatgcttctataacttatcggggggaaattttggaagcattagccgagccatgatagccgtgctgccaaagaaagattcaccttctctggtccatgatttcaggcctattagtctgatccacttagtggcgaagctcatttctaagacactggccatgaggttggcacaacgcctagatgggctgatctcacatgcgcagagtgcgtttatcaagaaacgatgcatccaagacaacttcctttatgtcagaaacatggtctgctccatgcatatgcagaggaagccatgcctcttctttaaattggatatagcaaaggccttcgattcggtatcctgggaatatctttcggaaatgttgcaataccaaaggtttagccacaggtggtgtaactagatcacactactattgtcgacggcatcatcaaaagtgttgctcaatgggatcgcaagagagcaaattgcacacaagagaggcctttgacaaggagatcccttatccccatacctattcattttggccatcgaccctatctagagattactcagcagggctaccagccaaggactattgtcaccactagccaacaggacggcacgggatttatttcggaccggcaaccaatttactcatgatagggacaataagagaccggaaatcaatccactagttaagaggtgtggaactaatccggatgttttgttgtacctatcatgagtaaattggttcccagcccgaaataaatcccagtctctacttgagccgctactgagcccatttcgaaaaaaaaaatcccctcctcccaaaaatccctaattccctaaccctaaatttgcaagagacagccagacaggccagtggcggcgtgcgttgcggcgcgggagcggcgtgcgttgcgggttgcggccacgtgcggcggcggcctcgcggcgagccagcgaccatggggcagcgcaagcaagccaggcaggggcggccgccggctgggcgcacaggcgcagccgcggcgcagcgccgacaacggccatgcggcgcatgcgtcggcgtcaccggcttgagcgaccgtggccagccttccccttgacctcttccgccgaggcgccaacgaccgtggccagcctgccaggcaccactcgctgagaacccgagaccgcgaagacgccgacgggccatgccgcatagtgagtcaaaagcacaaattttaaataattgtaatgaagattttaggattgggaattgcaattgattgatgtagtatacttgcttgcttgcttagtttgtagaattgtagttgcctagtttgttgaattgtagttgcaattcattgtttaattttcagaattgaaacatgaagaggaagaagggtcctgctattgattcgaagtcttttttgagaaatctgctgcaaagaaggaaaatcgaagccaagcgtcgaaaagttaatctctaaattgtaagatttcttcccaatttatcattttctatcatttttgtattccatatggtggcactttgatatgtttatcaattagtatttctatatgttaaaacgtgatgatcaattctatcaatgtgtgaacttatgctcaattttatgttatatacgctatatattatataattattagtgtgtgatactatatatacaagctaattattaggtttttaggtgtatgaacaaatttttttcctctccccatttcgaatacacaagttcaaaatcctgggcccgccactgccactgacctacacgctgataaatttatatggtgttaggtagtgttaatgttctttaccatcactgtgaaatgggttgttgtttcacttaggggtgaaaatggatcggataatatccgctccgaatctgtccgaaacaacgatatggtatgggcttttagaaatccggcggatacggatgcggatgcggttagtatgaggcggatgcggatatggtatctctaaaatccgacggatgcggattatccgatatttttgtcggattatctgataagccgtttgtcggataatccgaaattatcaacatatataaccactctatctattgcatataatataagttggtacatccaattccctaattcatcaattaacatagattttttagtctaaggcttttatcgtctcatgtcacactcacgtaactatatttttcatactatggacatcatgtattcatattgtttagcgcttaatcatgtaattattacgataggtcatttactgattattgtattatttttccttggattgctaactcgatgttgcattgattgcatatacacgtaacatccgataaatttaatccgcttccgaaccgattccgcaccgactccgcaccatttccgacatccgaaacaatccgctctgtatccgcatccgtacactatccacacccgttctgaatccgcttaaaaaatatggtttaggatatggtataaccactatccgtccgaatccgcttcgttttcatccctagtttcactcgtgttcctgctaatttattactatatgaaattttataggtaaatcaattttaaagaatctgtgcgattgattttattattatttttacatttaaacctttaaatatattagatatattgggctcattttttatcatcgctaaaaatacagaaaagaagatgaattactctcactgtatatgctttatttgctacatgcaaacattctaatttatcatgtaattttctgaagacgttaaatatgcaattgaaaagaagccaagggattattttgtgaaattgtactgtttggacagggtatggacgataagtagccagttttttttttctcacacgcactttctcttccatctctcttgggtactctgcttcaggaatcatacgaccagtatttcaccacgtgtcagtaaattaattggtgaatgtgggagccgatcagctggcgtcaacacggccagctttagatatacagaaagataagactaaaaaactaaacagactgtgcgttgcaacgagaagaaaagatacaaaattgagaaaaaaaaaggtgagaaagatttgcattatataattaattaaaaatacaacattttcagaatacttggtatttctacgtaggttggtgtagaattaaattaatttgtaaagtaagtgtgagaaataaaattatatggctggatttaatttttataaaatattatccatgactagttacactctctagaattttctcataatttttagaggtcaattgctaattttaatggcaaaatttgctacgggatatcaaaaaccacgtaactagctggtggacatcgcaagaaacgcgaatttgctaaaggacaccgtaaaaaaccagtaattagctgctggacacccgtcggattattttattatatctgatggaatttgagagagaaacacccatgtaagtacggttttacctttcattttttttctttattctttattcttccttatcttctctctctttctctcctctttcttcaaccgagagcggcagcacggcgaggcgcagtccggtgcggcacctcggctggggaagcgctacgcggtcgtgcgcaagggtcggggctggctcaacgcggcggaggtggtgctagagtaggacgggaggtggtgccggctcggttgggcgtcgtcggcgcgcaggcaagcggtgctcaatgggacaaaggcggagctcaacggggttgtccacatccatgtcggtcacactaatgctggacatcctcatgctgcaacactcgtcctattaaagcccccgcagaacgccgtgagctcgtccagcggcgccgcgaccaccaccttggctggggctcacgacgacagcgagagcttgctcggcccgatgctggggcagctgccactgcgagggagctgcttcggcctggcgggaattggtaccatgccggctgcgtcttcctgtggcgcgggatgtgccgcgccgagctgctggccagcgatgccgctgcgtctaggcatgacgcgtcgtaagagctactcggcggcgccgacgtcttgtttggctgggttgccggccaccgtagggctgccatgccacctccatagccacacatctcgcgaacgtcgtgctacctccgccggtctaccagcgtcgctgcaccgtgctgtgctatcctagccccaccgcgcttggtgccaacacccggccaagctcttcctccgctcgtccgttccctcgttgcaccggcgctgctgccgccaggccgcgccctgccacacgggtatgccgccgccactcgccacgcccctctggccaaccactctttcatcgtcaccatcctaatagagattttttttttgtgtggtgacgcacggggcaatctgggcatttggaaaaaaatctcaccacttttaaccaggaaatgataaattaatgcgtctggtgtcctactatgactttcacagttgttgtagtgtcctggggtagtgtcatattttcgcggtgtctctcagctaattacacaatttttacgtgtcttatagcaaattttgccaattttaataatacaaacaccatttcaatattcacttaaataaaaatctaaatacaaaccatcttttctctctggaccattttcatcccatgttcttcctcagccagcagccgagctagcccactttcctcccttgtcctttgtcggcaaacgcacgttcggcccagatagcaaccgaaagtctaattagcctcccaaataccagcccactttcctcccttcttttcacctccgcctcagccctcagcccgcaagcgcacgttcggcccagcaagcaaccgaaagtctaattggtgtcccctgctcttcctctcactgtcacgtgggcccatcgctatataacctccgtccggactcacttggttgcccaaaatccggttgtattcttgaagaatgaggataatccaaaattgattaaggggtttctatcctcgtcgcctctttccatttttccaagaatcggagcaaatcttaaggggtttctatcctcgtcgcctctttccattttcccaagaatcggagcatatccgctttgtatagagcttggaattgagccctatcatcgcctctttccgtttccccaagaatcggagcaaatccgcttcgtattgagcttggaatcgagccctatcatagacaagcgaacctagctagaaacatagggtttcgtccgtttcgcttggaaaaaaaatcgtgtagcggatgttgacaatgacggagaaaaaatcatccggaaaccatacgtattttttaattaggtatagataggcttgtttaaaggaaaaactattcagcctagctcggtccaaaaaaggactgcaccaggcccatcctgaccattttcatttcattgatcgatgaattttctttttttaccaaaacattcatgaaataaaggagcaatgctgcaatatggttcacatgtatgctgatacatgttaccaaacaaacaaaatgtagcttactttatttggctttagagatattctacgtatttctagtaaacactgaaatatcactatgtttatctacttcattctactccatccgtttctatcttatataggagtataagatagagggagtactcatcttcttgcgttgttactccaagcttgttgggtcaaggacgtggccagcaaagagcaccgcatccgacttctcctccaccacgaagaacgcgaacggatggtccgcgacgaagtccacaggagaggttaaagttaaacacaagaacttcatcgtgcaggccgtggccgccgccgcctccgtgccttcctcgttcacctccacgaccgccctgtgcatcaccttctccaccaccaccagctcgccgtcgatcatgccggataggtcgaccttgccgacgtcgaaggcggccccaatccccatccccttcagaacctcgttcatctcgctgtagaacgacaccttgaacctcggcaccctcaggtcgccgaccttgatccgccgtcgccccggccggtggtcacgcaggaaggaggaggaggccgtgccggacgacgccactgccatcttgtcgacgagcgccggcaggccgtcgcgcgcgtccggcaggaagatgtacatcgacaaccccacgttctcgccgtagtgtttgaggatggccggagtgatgtcaccaccatcgccatggttcttcatggtccggtggtacggcagcttgagcaccttgaagccgtcgtagaagccgatgtactgatcctcccggctgctcatgaacggagcgtcgacggagctgccgtcgaggcggtggaacttgccggtggtggttctctccctggggaagggattggaccatttgcccttgaagtagatggcgttgacgagcacgagggcggtgccgccatgaactgatccatctgggaggatctcgcggatgagcttgttcgtcgccttggacacccacttgttgatcttctttcttgaactctttggctgcatgtcaaatttacacaccccagatcgatcgaatttactacgaaatttcagaaatcgtcaaaccgaaataatatatatcgaaacctggactgacctgtctttggaagtcggcggcgcggtaggccggcttcagcgcgagcctctcgtcgtgccagacgccgcaggcgtaggagacgcgcggcccgccggactcggactcgtcggcgaggccgacctccacggcgcggcgtactgactcctcgaggtcgtcgagcgacgcggcgccgagcagcgcgacgagctcgtccagggtggtgccccgtgccccggacgccaccagcgccagcgcggcgtacagggacaccggcgagaagacgacgttcctgttgctgttgtcgccgtcgtcggcgagacgcttcgccaggcggagcgcgaacgccgtcaggccgccgcagttgccggcgtcgtcttccatggcgatgggatggcaatgcaaccgaaggtagatcgtgcaggacgtaaagccccaagggtcgttgtgaaacgtacgtacgtacaagttattactgtatataagtcggtgcgcatatatggcagatggaagttaattaagatatattttccccttaaatttgcagaatatggagaagataaaactaccaaattaaccacgcataatttcccttttactattgtagccgcgcgcctcatcaaaggatacaggctagatttaatgctgcgcttcgaagcacacgggccgagagtcgaaaagaaagccatcgtcatcgcggacggcaccaatatgatattgtgtcaccactgcacaacatcatattggtgccggctagaaatctcgtgtaggtgccagattcccaaccagcatcatgaaagaggtactgatgagaggggattttctgtgccgattgagaacaaaagcgctcaacttaattagatctgatgctttaaatccaccaaaggtaataaaatcgcaaaaaaaaagagtcacaaaatcaacggcattccatcctaaatcattggaatcaacagtagtcaacttggtgcatgactgaattcattcgtgtatgagcaacaaaaaggaagaagtccgacgtggagaagtcctctgcctgctgtaagtggagaagtttgttcgctcgccggatccaaggagagagggacagaaccgctacgtccgaaagaaggggagagagccgtgccgtcgagtggaccgaatcgataggatcggaccgccaccgagatcgtggaggccagaccccgacaccccgtaccactaacatccaagtgaccggatctgacaatccacgagctgacccaagtcaattaatacaattgcgcaacataaaaagtgttaaattatcaaattcattgctcggattcggacaaagagaggaagagggaggcgacttattgcattccccgcctattgcattccctctgccagtatgtaggcctggtaatgggtagtggcccaccccgaaccccacccctgcccatttctatttatatattgcacccaaaccccaccctaacccactaacatgcatatttagcacagaccaaccccaacctgtaaccttcttagtgcttgttgaaccctaaccctttgtgaacccttggacaacccataaacaatgaagggactaacccattgggctcagcacgacagcacgtcaaccgtacaacaactgtagagccttcgcacatacatgaaaatgaagctttgtatacatgcatagcacagctatagggagtaagacaaataattttcagataagttaaatagagattaccacaaactaagccaggtttaagtatatgactgaactttcttaagacatacacaatagtttagcaaaattaggccacaaataggcacgcattgaaactaataaacatctatgaatcatatcagaattttttcattcaaaagtactagcaagatctattgatgcttaatctcagccttcctcttatgccacagcttgtccagtgcaatgtttccatctccctgtagaaacaaaatgaggttagaagttagaacctattgaaggaggcatcagtacaataatccatgttcctatacttaagcaatggaaattcagaattgctttactcctaccagttgcttaatcattcaccaattcatagtctatcaagttacaaacagaattagaagttgcaaaatcaagttgaacacaggggttaaaaacatttatcaccagtttaggtctatgttgaggacagaacaatccggtgcaacaataaatatatagtgcagatcaagctacatctgaatagatatgtaactctaagtatattacttagaaacaaattgaaaatttatactagttgacatcaagtaagttttattacagtataaattaaattacctatatagcacaagaattcacttaggccaaaaggacatgcagtaacttgtagccacacaacctctaacaaatagcatgcatttagcatcagcctaagtatattcagcacaatgcgccatctacctaagtggcatgaaaaaaatgtatattcagcactcaaaggcagaatatcagatccttgtatcctcaaattcagatcaacacatggccaccaactttcagttaatctcaaacagaagagcagctagttcgaccaacacagtttcagattatatatgtgtgtttatttaaaatccaagatatatacaacttaatgtattacaagttgcagaagtacaaatcattatatgcccagaattttctctattatagattcctaaaattcaatatgagttacagttaacttctcggaataatcatcacaaagaactaataatctaaaacatgatattcgttagaaaaatcatttcagtgtcagtagtacaactgaaagtggcaaagaaggcttttgacacaaagagggactagcaagaataacaatgccttgaaacaatattcgttcctctgcatatacttcttatttaagagaatcctatgatctctctatacaagcttatacattatattcaatgtctaatctaatcctaatagctttttacaagtttgtactgtgaatcggcaaacaaataagcaatccctagctggatcaacaatttcaacatgtgataaagatttgcttcattcagatgttagcagagcaatctaatctgctgcaccgaaaccaagaacaaaaatagcaatgcctgtagcaaagaaaacaaaccttggttgcagaaaccgacttgcagagaaagggttgcacggtgctgtggatctcgaacaggaggcggaggcgacggaggacggcggcgcggtgctggatcttgaccgggaggcggaggaccgacagctgatggaggcgtacgacgcgccggcggacggggtggcgcgatctggatgggaaggacggagcgtcggcgctcgcggacagggatcgggacagcgacggaggatcgcgacggggagggagaggaggaggcggaagcggagggggagagggcggcgcaaggcggcggcgggcggtggccgccgatccagtcgccgagctcctaccgctgtgggttctcccacaaagaagacccttttttactgcccatgggctgaaccccattctgagctacagtgtccagcccatcgtaaccctcattttatatggcccaacccaaccctgcccttatccttcctataacccatacaagacacaccattttcaacccattattgtttcaacctgtacaacccatgggttggccagcccattaccaggcttaccagtatgtgcaaatgaagtagagaagcagaggatggagatcaagttgctggttagccacgatctcgtagtacatgatgcctgtaagaaaatctattatatgttctagcatgttgttcgtttgacgtttacttattcggatttgctaactagctgtcgacagatttccgtggtctgcatcatgcgattttttggtcgttagatattctttgagatgtgtgcttggatcggcccacatgtggcaaggtgacatgggctctgtagagcagagtcaattgggccctgcaaggctgttcaattttgatttttgtgctgctcgcaagaccatctatacatttatcgataaattttcttcaaaaaaattgacagatgtaattatagtataatcgtagtgtaattacactgtaacttatatgtaattacactgtgacttgcatataactacagtgtaatttgtatgtaagtttcacgtaattttgaatcgttagatctattataagatttgttgtggtgagaaagaaaaaatcgcagcacacacatatgtgaaaggatttgtttcaacaacctccattttaccgaaataacatcttacagagagatttttgaaagttacatataagttacattgtagttacagtgtaattacatgcaagttacaatgtaattacactataattatactgtaattacatctatcaaatttttgggagaaaatttatcgataaatatatagcaaaattgtttgttcaatgtggctaagatgatttttgggcctgttaatgggtcttggtaaaagtttggttgtttaatctggctttagacaatttttggatctgttaatgggcctcgggtagttggcctcggtaaagggcaggcttgctatcccctttttttctttttatatatatttttgtaattgtttttctgctgaaacatctgagccgtttggtgttgatcccgtggctcaaaaatctgcatgatacaaccccttattttctgtcgaatcataaatagacagtcattcttactgacactaccggaaagtaaagcatattttatggttactgaaaacattcattccattgatcgacgtagacggggtgaccacaatatttgacgatttttttttttacaaaaacattcgtggactaatatcttgacttgagctctaatcttgcgcccattatgtttttacttctaattgtttatttcgagcattgtcgaatgtagatgcaccggaattcagttggtggattttgagttagaagaagtagtggccgtgtttcagttctttgaccgagctggagacgtttcgtgggatagcacaaattcaggatctagctgcttaatcggtcacagaataaatagaagaaaaacagaaaagctgcaagcatatgaaacatcagttttcgttagatactgttcaccatctgaaatccatcagttttcccgtgagcgagagggagtgatcaaatgcattttgcacttcagatgtagatgaaataaaggagcaatggttctcgtgtgtatgcctgtacatgttaccaaatagttaaaaaaaagtaggttaaattcgctctagattagaattttttttattttcggcgtgtcgctgactctatcattgaacatgccataacagctctattattctatagactattccattcgagatttgctccggcccaacaaaatcattttcaattgttagatctaataatcataacccgccgttgtacggcagcttgagcacgttgaagccgtcgtagaagccgatgtactgatcctcccggctgcgcatgaaccggacgttgacggagctgccgtcgaggcggtggaacttgccggtggtggtgctctccctggggaagggatcggaccacttgcccttgaagtagatggcgttcacgagcaccagggtggtgaggcgatgaactgatccatctgggaggatctcagggatgagcttgttcgtcgccttggacacccactcgttgatcttctttcttgatttctttggctgcatatgaaaattttacataccaaggttgatcaaatttcagaaatcgtcaaaccgaaaaattgggagccgcttgaactgactgacctgtcttcggaagtttgcggcgcgcgtcacggccttgtaggtgccgccgtgccggcggcggcggcgcggtaggccggcttcagcgcgagcgtctcgtcgtgcaagacgccgcaggcgtaggagacgcgcggcccgccggacgcggacgactcgttggcgaggccgacctccacggcgcggtagacggactccgcgaggtcgtcgagcgacgatgcgccgagcagcgcgaggagctcgtggagggtggtgccctgtcccccggccgccaccagcgccagcgcggcgtacagggacaccagcgagaacacgaggtttctgttgttgttgacgtcgtcgccgttgtcggcgagacgcttcgccagacggagcgcgaaggccgtcatgccgtcgcagttgccggcggcgtcatccatggttcttgattggatggcaacgcaggcaaggtcaccgtacgtgaaactcaaactacaataacggtgcgcatatatatggcagatggaaattaagatatgttcccttgaatttgcacactatagagaagatcaaataatcaattacccaattaattaaccacacaaatttaaggataataaaatggttgggcccagcttaagacctaggttttcctttcacctgtgcagccgccgcatgcaagctacttcgaggttcgagctatatatatgcccaaatgggtccaggcacgaccaggccttggccgatatcagtcaggccggtacggtctgacctacatgccaggccgggctgggcccacccacgggctgcaccgatggtccaggcatgctgaattagactcgggccattgccgagccggcccgaaggcaccacagtctattgtacttctttatggataagtctattttcaatcatcaatctctttgggccgtgtattatacagctggactaagtctattttgtatcccttttatctttgggtgtcttttttgagtccctcaaccatttttcttccgtgctcattgaaccgtgctttgccaagctggcccaccgtgctgaggcatcgatctaggcatgacccaactgtcggactgggtcggcatgggctcgacaccagtcatgccgtgttgtgcttggggcgggctgtcgggcctcaagctttacggccatctatacttggagcttcgtcgagaagaaagccaccattatcgctgaaggcccacacatgcatgccatgtttgactctcctgttcttcaacatatttggttagggaaatttgaaatggtgaattagtcgctctgttccatacaagtcaaatataagatgcttccattgcctcgaatccaaattcaaatctccaaatccaaattagatcaccatcaagatcgattgatatcatagaattgtgaacatacacaaaatcaacaacaaaaacatccacaaatcaacaaacccgtgggtagtgcacttgacgacgtcgagtgaaggccaccgcccgccatcgccgccactattgaggtcatcgagagcatatctggtggagggctccacgcgggggctagatccagaggccctcgagctcaggcccgttcgatctggcatcggtgccaccaccctcgccgttgccgatgaatccggcacagtaggctggagagaggcggggcactggccatcgggtgccgggtgatggccatcgggcactgaggagagatgccggcgaagaaggagagcaggagaagtggggatggggagagggagaagttaagtgggagagggaggagctgaggataaggataaggtatagagaggagctatagatatttggctcccacgcaattttttttaaggtccggttgtgtcaaattttttttaaaaaaatgatacgataacggtttttatctaaaaccggcactatatgtgcttaaaggtgccggtttttttatcccgtgaaagattttgtagcagtgaattcagggttgaacctatggaagaggaagatttacgtgtttgcctacctttattgtcctacgcctacccgtaaagcgagttcctgaagataatatatttttttcaactatccagagtttagagccatacaaaacattaatgtttatttagtatattttacctgtttaccatcttctatataattgataatgaaataatcttatttaccatgttttcatattcaaattataatttataaatcttttaaatttccaatgtcttgtggatttatgtctaaaattttaatctcaatatccataattagattagatcctcactgtattcaaatttcaaatcgctacgtataacggtattcatgctaggatttgagcttttattactctcttttgatagtgtagatctgagaggactatgaaaaaaatatcagtaccacagcgtacgtttttttacatatatatactacttttaaatatttcaaaaattacatttgtgaataaattacttttgatgaattaaattatacactcctgaattgaaatttttacatactttcatttatgacttaagctaaataatcaaacaaaataatcataattaacatatgaatgtgcctaacaagtttagaaattttaaaacattcctgaagatgggacttatgataagcgagctgagaaatcctccgtcatcagaattcatgttcataaattaaatatctcattgcatcaatcaatccacatcagccgttttcatcatccgttcacgaaatcaccaacttaatcaacactactcatacatctcataccaaacatagcaaaagtaatactaatatataattatcgtccacattaatttaactatttcttacttaatcactcaagcaaaccacacctaaacctcgaaaaaattacatcaccaagagactatacactgcactgcttatcatagacacacgctaacccagccaaacaagtcggcgccaccgccacgcacgccacgtcgacgctgacacgcggacgaacaccttgctgctccgtggcccggtcactcgctgccaccgccgctggcagcggctgcggcggcggcgctctcggcgacgaactcggcgatgcgtatcatgaggtcgcggccgtcgtcgaacgccgggaagacgtagaaggcgtggatggcgttggggtactcgaacaccctcacgtccttgcccttgccccgcagcatctcggcgtaccgcctctgccagtcctggagcgggtcgtagccgccgatggcgaggagcaccggcgggaacgccggggagtcgacgccgggggcggcggacggggcggcgaagttggccgcctcgtgggtgcggtcgcagccgtcggggaggaacgcgcgccacatccagtcggtgcgggagacggtcacgatgggcgcgccgtcgaggcggagctccgagtccgtcctctcctcgccgccgaagaagggctggatggcgacgaggccggcgacgcggacgttctcgaaggcggcggcgtcgcaggcgtagcggcgggcgacgtggtgcgcgatgttcccccccgcgctgtcgccgccgaggtagcatcgggcggcgtcgagcggcgggacgcctccgccgccgccgccgtggtgattcttggggtcgtcgaggtagcgcagcgcggcgatcccgtcgtcgtacgccgccgggcagcggtgctccggcgcgcggcggtagtcgacggacagcaccgcggcggacgcgtaccgcgcgatacgcctgcacgcggcgtcgtacgccgcggacgccgcggagaggaacgcgaacccgccgccgtggaagaagacgatgacggggagagggcgaggaggaggaggccgctcgtccttgccggcggcggcggaggggtagaagaggcgcgcgcggaggcgggtgggcgggtggacgaggacgtcgcgggaggcgacgccgcggcacggggaggagaaggccgggacgcgcgggtcgaggacggacagcgcgaggcggttgagcgtgccgtcggcgcggcgcgtggcgtcggtggcccagtcgacggccttgagggacagccgcatcaggcgggacatcggcggcttcggcttcgtcctccgccccagcggcgtcggcgtcgtgtcgtccgacgacatggccgccgctgccgtcgccgtcgtacgtgtcgcgggcgcgatcggtggagagaccgagtcggggcacacacgtatttatgggggattggacgtaggagatgggggtgagtgtggtgtcgcgtcggttgatagctacggatggttttcgtgtgccgtattgccaattgggtctattggctattgggtttcgtgttgaatttttgggtaggcacaaaggcagctcgcaacaaccgtggatggctattaataaaaaagtatacggaactgctaaaattgtggaattaaattttaaaatatacattatttttctcgattttgtatatatatacatgtgtttgaaaattgtgaatatggtttagtccaattgtgaatatggtttagatttagagacgaggaaaattacaatgtaaattttaaaatttacatgtaagatttgaaaattacaatgtaaatatataagagtttcatggtaagtacggtgtaattgcaatgtaagagtgaatgtaatttagtgtaaaaatgatttaactattttttttatgaaaaatatgacgccataaatatagctactcctgtatacatcagggttatcatcgtttggagaacattagttatactattggtcgaagccagtgatgaggacacgactagcttagatataaccatgactaccttatgtattaatcaaccaaatgtgcatatgttctatattagatttacttattatatatttgaacaaatgttgctacacaatgagttttgtgtgttttcgtttgcagaggtacttgcttgggcgaaggaaaagaagttgattggggactaaatcaagaccttctccaagtttacttctacctcaccatgtcacttttggtccatagaagacaagggataaaattctacatattttggattcggattcgggccttctgacagcatcaacttcaaacagacctagccgctgatttagaaggaattttggggctcatgtgtacttgttggaaagcttatggaatctactatcaaatggttttggtcccatgtcaaaattcctaccaagctgccaggaatctacaaaacaagccacgtatctcatccagtccgaatctgatttaggttttgggccttttagttgtgtcgtgggcttagcccaaggggttgtgcaccctaggccaaccctaggacgtccctaatcatacttaatcagtagccatcattgtttagagtcgggtttcgcttagattattctgtcgagaacagtttcgccgctagatcggtttgtaagaccccaacttgtaagcttaatctttcacctgcaattttggttgtattctaccttgttcttgtttgtgttcttcgattggtaaatagggattagtcttctcggtgaggtcatccgcgtttcgacacgggtgataaccagaggagacgtggtgctgcgattgcggggctcaagagcatgtttgttcaagaagccggatcaatttgtgtcgcgactccgctcaaatcgttggttatcagaacctttcagaagattgggaaccctagtacacatcagccagtgttgcttttatatatcaatatctcacgagtataatatttgaaatgacctaatctagtctttgtaagcttaacagtatggagctctcacatgtgatcgacgtcttaatagaagtgcaacattacacagatgtaatatgttccataactactaatccgataagcttatctaaattacatatatgcactagattgcatctatattgggacggaggaagtacagtaagaaaatggccatgaccgttgcaaatatccctattttgatccagtaacagtcacagctatgcccgctcaattgacgaagtctattgtggttttcttgtagaggcaaggtttgaagagtggtgaatttagaggtgatttacacaatcgtcgcgtgtgtggatttgtttacgttgaggtattattggaacaaaattaaaggatcggggaaaacgaatttgaagaacaataatttatagaaagggagggaacaaccttgatggagctcccatgacgcaagtaggaaagcaaatgggtagttgttcgtgcagctgaacaagacctgagctgcaaagcctgcgaaaccaagcaacacttcgtttcatgtcttcttaaaaatttaatagcacttgccaaatgaacagccccgtcattacgcttatacttacgtttatccatatcacttattaccaactaaaatataatttattaataaaatttttatatacaaacaaatatcgtaacttaaactacgatgaaaaaccacaaaatcaacttcataactaggttataaactttaaattttgacttatatacataaacataaacaaaatagtggcgcacaaaaagaaatgaaattgtatatgctctaaaacctattgatactaggctgaaatttttacaaaagaaatgttcaagctaaaaccgctaaaaaatgaattgtgtaaatcttattgaaactctgtaatattcttttttttctcaggaaagaaaaagaaaaacaatttgccggtacttcctctttatgggcatccatactgatactccaaccatgtttggtgaccgacctttcctgctaacacattgaatgaccgggaattttgttgaggaataagttcaccagccgtccctcaactttacgtcgagtctgtataacatcctaaacctcaaaatcagatatgttcacccctaaattatacaaaaccgtgcaatctcggtcctatgacagtatagatctctggttttgctgacgtggcatactagtcagcaaaataaaaaaataaaaaatgatgggaccctcatgtaagtctcttatttcttctctttttctcctctcctctcttctcttctgttttcttcttctcttcacttctcttcagcgatggcggcagaggcagagaggggacaggcggccggcgacctccgtcgcctcgagcgcctcgcgacgggagggaaagggggagaggggaggcggccggcagaagatggcggaggggagaggcgcggcgacggcgccatggccagcctcaccacttgtgggtcccaccgcggaagggcgcagccaccgctgcctccggatgatgacttggaccgccttgtaacaccctgaaaattcgacaaataaaacgaaacctgaaattaaagtactttcaaaaacttttaaataaattgcatcatgccgatgttattggttcttttgttgtgcatcatggtggatgttatggttgttattgcttgccaaactataaaatatcacaaatgaaaattaagctaaagctatataactacgtaaaaattataaagttatgatatttattatgaaccctacaaatatttatgcacaacacaacaaagcaatacaaagagaaggttaattactaaatcaatttataagtcaaatattaaatgctacacatgaaataatcgccactacgatgattctatatataaaaggagcgttccactagaatatttacattaatatttataatgttcattgagtctctcatggaatagaattcactcacataaagtaaatggtaatgcaaataaattgagctttatatatataatatgtttatgtgaatgtctaattaaacatttagatcaatatggtaccaagtctcaatttacttttgtgaaataaatagattaaacctatccatgtgtaaatacattgttatccaaattaactcgaccaatgtgccattgtattaataaggtgatattagtatattctaattaataaatgtccaagcctacaagttatataataattatgttaaaccaatacatggtgaaaacgaataaataccgaaatcccaaaagtataggaaatcataaaaggtatagtacaatttaaaatttttggacaatattaattttgaacaaaattcacatttgaatactgcatattgtcgttaaaatgcattggtgaaaatataaattgaaatagccctctttcctcaatttataaaatcaatcaaaaccctaaatttacagcctggcactgttcattgtgcgccaggtgttcgactcgggtctaacccggccaaacacccagcgcagcatccgcctccccgtgcacgcgcgcgcgccctccttgcccgtgcaccgcgtaaccacgcgccgcaccgcgccacactcgcgcgtgggccccgccgccgaccgagccgccggaaacccgcgccaaagccgcgccgccacgggagcgcgcgtcaacaacgtcacgtcgcccatcgtctcggagccgataggtaacggccgtgacgccaccccacatcacccctaaaccctatccaaccgccctacagccggaaatccccctctcaccgagccgccactctgccgtcgcccatgtgcgcgcgtcattgccgtcgcatccgtgacgccgcgccacgccaggcgggcccgcgatcggaccccggtcaagacgccatcctcacgaaccttccactccaagggttggggagcgaaccgagtggataggcgcgctgccgtggccacgtccgccgcctcatccacaactaatgattactagcgcccttccttgtgtacgatgggtaaaacggagccttcctctctagctagagctagaacacacagtataggggtcatagatgcaatgatctactacagaactttaatggaaaaggagcaggaaacatagccgcgtcaacctccctaatctaggccgtatagacagccattgagtgcaccagctgccgatcttatcctccacgccatcctggcttatccccaagccaagccccctaaaaactccatccttatctgccttttcctcgaatacatttcatcgaacaccttgtgagcatgtttcatcatcactggttggagccgaagccggcgtagctgactgcgggaaccgtggctcgggacgcctctactgctgctgctgccttggatcaacgccgggtgctgctggaactcgaggacctgctgacgaacggctgcgcgctcgccgccgtcggcatcctctgcttccttaccgcctccccaccgcgacgccgcgtttcgccgactcgccatcccacggtgagccctcgcgtccgtagcgtcctctaccctactattagctagcctcggttcctattttagcgattagcacccatggccgtgccggcccggctgctgttccgccgccggcgaggtccccgtggacatgctatcccggaggctttcccttccatcttgttaggaaaaatggaatcaccatacactgtagaagctttcgcacccatcaatttggttggaacctagccctaccgccctatccccttgcaccccggagctcggccatggcggccatgccgcgccgctcgcccccgcgccgtcgtgcgccgtggctgccggcgggaggtcaccggagattcgcctcatcctccccggccgcctctgtgccggcctcgcgccgtcccggcgtgcgcgctaggcgcatggcgcggctgcctctgcctggcgagaggtagaagacgacggggaaaaaaagaaaggaacgagagagagagaaaccgtgtggggcccacatgtaattagcacacagtaatgctctccctaatggttattagcccactcaatgacatgtggggtccctgttattaaaatctaagaaaacttaattatagattttgtgtccatgacagaggggacccaccggcaattatatgaccggcttgacctcagtcaacagggggccggacccacctgtcagtagcacatcacatttcccttagtagaataaagataaagaaaagaaaataagagtggacctacctgtcagtcactaccacttactgttaacgctgcaataaaaataaatcaattatgaacagtactgtttcacaattattggaattaattcaaatttgaatctttaaactagcataactcactcattttaactcggattcgaatgaaacttgaacctaaatttatctaaaatcaagatctaactattggtaccactttatcaatttaatttgtactgtttgaatttttggtgattttatttgaattctaattgaattcaaatcaaatctttcgcacgtaaatttagattccgaaggagttgctgagttaatcaaagatccgggtcagcaaatctgtgagcaaggcaagtcatcactaatctttgagcatgttggacctattgcgaacttattttgatttaaataaagtttgcatgctatttatatgtgaatatcctactttgttatatgccatacctttgatattgattatccatatgtcggtgacatgggatcaggagtatcatgactagaggtttgaggcagacacaatcgcacacgtggcctggtacccccgagggacgtcgggcccgagggtgatgcgttcgccctcctcttagtccccccgagggggtggggccgcacccccctcggccccgagggccgaggcgcnccgacccctcgtgggtttttgctccgcgtatgggttaggtgagnacagtggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcctgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgtcgtgactggtctgataccggtcatgttgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaagagagaaatggtgcatgtggtgtccccttaagatataaaaggaggaacttgcccactgagaggggggactggacttttccagattagaaacccagaacaagggagaggctggctgatactttgtagctccttcatacacagatctcccaaaacacaggagtagggtattacgcttctcagtggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcttgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacgtcacccgcccatcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcgaccgccactccttcgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcttcggaatgtccgtcaccacggacgcggggatcagccctccgtgcccccggttggtggtgtcggctgtagagcctttgtggcgagccttcggaatgtccgttggcccccaaggtgccggcccaccatcgccgaaaaatatgacgggagcgtcaaccccaccgagtttctccaggtctacacgaccgggatcgaggccgccgggggtgacgacagggtcatggcgaatttctttcgcatggccctgaaaggacaagcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaaccccttcggttccggtgtggcagcttcggccacccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccaccgtcgatgggggagggtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgccgctacatccaagcccgagggtggcgaagagaggcttggcgcttccgcccccgccaccccgaggcaacggatgatcacaggcgacgaggtcccggtcaaggaggttgccctgggcgacggcccgtccaagaccacatggatcggtggtcttctggacggcaaataggaagacgcgctcgtctccttcctgcgggcaaacgctgacgtcttcgcatggagaccgacggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaagccggattcatccgtgaggtcatccatccggagtggctggcgaacccggtggttgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctacgggcaagcttctagggttcttggtctctgcccgaggcattgaggccaaccctgagaagatacgggctatagagcggatgcgccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcgacattggttgtggagcgcgatgagaacaattctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggaacccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaagatcggccccaccgaaaggtgcagcggcccgtctactttgttagtgaggccctccgggacgccaaaacccgataccctcaggcccagaagatgctttacgctattctgatggcctcgaggaaactgcaccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctattggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccagcccaggccctgcagaccataccactttcgtggccatttgctgtctggggactcgatatcctaggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgtgctaccagcagagcctgcggcgctaaaatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggggtcgggtgtcaggtttcgggctcgcgccaaccccgcacccccctcgggcgtgcagggttggccgggggctacaacatatgcatattcttatttctcttatatctgaatttctataaaagcagtttcaatttcctaaaggctgtatctgtgctgttttttcattttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcagtccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggaggtaactcatccagcgccatccatggagagaaattggggtccctggcctggtaactcgccaggacgagctccaccgctccttgggcgaggttcctcgaagatgacttaattgtcttctcgagctcctcggggagccgttggagagccccggccatcttcgagaggcgctgggcgaggcctccctggttggcggcgtactttacggtcctccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgtgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtgcgccgccagcgttgctcgcggcctcgcggtccgccagatccctctccacgacgcaggcgcgctcttccagcgccatggcgcgcgcctcaagggcctctttgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgctggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccacatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcatcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggttcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatacgggaaggcggcagcacgctaccatcgagcagagcggaaccccgtgccatggcgccggaggaagagaagattaagagcgagcgcgtgtggcgaaggtagggcacaggaaagaaggagttagggcgcaagacaaggggaataatggcgaaaggaaggaaacagatcccttcctcagtgcctttatactcttgccaacgctgtgcccggctcctcgcttctcgcgcccactatttcgccccctcgtttctcgcgcccacgctcccactaatcccattcgcccgcttgcggcgcatgaggtggatatgcggttgtggcagtcgagatagatcatatcgtgcgcgcgttaattacgctcgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggg

SEQ ID NO: 78207 - DNA, 17741 bp, Oryza sativa
  unsure (1)..(17741): unsure at all n locations
agctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggggtaagtccccacaaaaaagagagaaatggtgcatgtggtgtccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccatcaccatataatctttgtaatccatgatatcgtgtgtctttagtcaatatttgacaaatgcttagcccatgctaatttagattcatgcatattcatatttatcaaaatgctttatgcttgggcaattaccttagggaaggtaattgacatacggcatgtggagacatgagcgccacattgctatgataatgatgagatgatttgtgaaagaaaattaaactaaacaaatgttttcgactgaggcggctggaggacttgggtggtgtccggtaaaggctagtgccgtccctggtcagttaaggaccgagccatgaagttaagcatgaatcgaccccagtacatccgtatttctcgaatgggtatagacctagcggagtagatagccgagcggaggcagtatccctgcatacccgaaacaagcagatgtggacgaacaagcagtctactggcggatacccgaaacggatggccaaatggcggatacccgatacggatggccagagactgacttgtcaagactacaagactacaaggagataaccaaaagaggacagcatggattgggttcaactacaggaagcaacgtaggaatgcatgtgtttttcccatcccgggagcgccagaactcctctcgctgctagaaaccgtatacgcctagagtgcatgaggactcaagttcatggagcgggtactgccaaagtgaggttgttgaaaggctttgccgtggcaagtctcattcgttgggacgtaggctcatgtgttaggcaagtcgcggagtacgggtaaagtgtacatccactgaagtatgagtaaaccaatctattcgaatagccgtgctcgcggttattgagcaccgggacatgtattacacttggctagactctaatttcttaatatgatagggaagggatatgcatgatgattttgtaattgtggatcaacttctcaagaggcgagaaggggtagaccccagaaaaccattacgaccagtggcgggaagctatccttgggacacaatggatggtagacagaaccgtcgctgtttaatgaacaatggagttaaaacttgatcagtttatgctaggtcttaggcttatgaaaagaattgcaaaattggctttatgcaaataaaccattagcctttcattgaatatcctctatcatatgcatcgttgttatggtggcttgctgagtacggttggtactcactcttgctatttacaaattccatcagaagccggtgatgaagtctcggatgacccatatgcttactaccaggagggtgaagaagatggcgacgcttagtaggtcttagttacggtcgttgcctgtggcaatggtgtcaccgctgccttgattccgctgcttatctatttctgcttttggatgtattccggaccatttggtcctatgttctaagactgcctgcgggcctatgatgtaataattcgcgctagacaatctatgtatgcgcacttgatatttcagcaatgtaatcgtgagtaccagactacttgatccagggaaatggtactattaacacgagtgattcctgttataaaaatgggggtctacacgccttgacgaggtgtctcccgacgccctcgccttcctcgcgacgggccggcgctgtccgtcactgtgcacgacgcggcggcggcggcggcggcggggcggtccaagtcgtcatccggaggcgcctctgtaacgtgaacacggcggcgcagccgcggatgatggtggtgttggcggcgcgagcagcggcacaaaccaaatgaggatctcttcctccgccatgttgcagggctcctgaccgacgaacaaccgcaccctcttgactacaagttaattaatcgatgagtaataccaagatcttgatctcgagtagcagtaaatgtgatcgaatcaaaagcagcgcagcattggcacctccgccttaccgtccagtgcgacgacaatgtcgtgctcagcgccggactccagcaaccacgccctcgtggaccagcacccgcacccaacgaaccgctccctttcctcctgtgcaggtgcctcgacgtggccgcagagtcatgcatggcgatggacagtgccgtcctgtcgagaggaagacgacggcgtcgggagacacctcatcagggtggtcgaagtcgtcatccagaggcggcggcggctgcgccccctctatgacgggacccacaggcggtgaggcttgccatggcgccatcgccgcgcctctcccctcccctctcccccttcccctcctgtcgcgaggcgctcaaggcggcggagcttggcggccacctgtctgtcacactcggattttcccttcccttaggtttcaaatcactaataaatggcttcaagaatttgctttagttaaccagaagaaaaccccagttagcaatgcatttaataatcggaattgttaggaagaatttttttcgaattctctttgctctgaaaatcactaacagaacttaaaggataaacatcttcctcatttgcctttggtcgtgaattatgcccaattcactctcttctcagtccgcggtttcgttttgcatgacgaaccgtatctgttcgcgggaccgttttctttccttttctaaaacggcaccgcattgtttttccttgttgggaaagtctcccctctctgccaacattgttgaagaaaagcgaagagaagaagaaaagagaagagaagataggagagaagaaggaagagacttacatgtgggtcccacaattttttatttttttattttgctgagtaggatgccacgtcagcaaaccagatatccatactgccatgggaccgaaattgcatggttttgtaaagtttaagggtgaacatttctggttttggggtttagggatgtcatacaaactcaacgtaaagttaagggaaggatggtgaacttattccaatttgttgagacggctgagcagctacgcttatggcccagcttcaggccgaaactctaccccaggccagcccaacaggaaggattcatgtagccattagctagcccatcaccgactggaggtttttttttttaacacattatagatttggtttcgactatttgatatctggttcattttatcataggcattgtcatgaagtgctaacacaatcaaaatgacaacgaatgtatggctcattttatcataggcattggtgtaaaactggatgtcccatttcgaatttgatttctcagcttcattgtagttagacattattaggcatgtaaaaaaaattgtgactgaaatctagcctttgccaaatgttctgttttgtcttttgatgttcaacatggccatatgtaatagagaagtgaagccataaaatatgtttgtttaggaggcaaggcataaaagattgtattaatcagatgacctatattgccctcgaaaactgcatgccaacccaggaaaactgtagcctatattctgatgattcttgatctgaattgtgcatatacaaatttgtggatctgtagctatgtcatcatggattgatgctttctgactatctgttcaagctagaattctggttatcaatctttctacgtttttcattgaagatgtgtattggttcatgcatatacataaaaaaatctgcacgatatgcatgtctcaggtggttaatattcctgtttactaaaacccatttcataacgtaccgttctcttgcattaatcatgaactggagaaaccttttccgctcgaacaattatcactcaaacaattttttttttatgctgtgaacctccaaaaactagatatgtgagcaagtcatgtttgattcgtttaaaaactcatgttcaatagtcttttttttttgaattttggttatttaaaaattttattcctagttgaactcttatttttcgttttcaaatttcggaatttattttactttgtatctcgaattttaattaatctcatattatgttttatatggactattctttcaatatttattttttattctaaattttggttgtttgtaaattacttgaactcttattttattttttccaatctccaattttatttaattttttattccgaatttcaattaatctctaattgtgttctacatggactattcttttaattttttttcattttgaatttcaattatttctaaatgtgtttctatcagaattcttctttcccttttttctatttaatgtggttatttctaatttccacagcgaacgtggtgtcttattttaaaattgttttaataatacaatagacagcggttagagttgtttttaaccttgtttttttaattttatttacaagtattaccaccccgatggagtaaaaagtaaaacatgtaatggagggaagttctttatataatggttacaatcgaaactcaaacttaaatcactacctcatctgtcacaactcacaaacaataaatcatatttattggcaacctctactttttaacaaattattcatacacacgaggtatacggggtactactatgcaacaaagactactccacgcgtcatcttgctattggcgtcatcttgctattggctttaggtcgttagtgcctagtgacacacgtggctggcatgctgcctaatcattccacgtcatcacccactcccacatcacgcagcaccaatcaatcaccacttcacccccaaccacaggagctcgtcctcgtgcaccgcgacgccgacaagtcagtgctcgccgccgctgccgctgccgccggcggcgacgatgtccttaatccggagcatgaggtcgagcgactcgtcgaactccgggaagatgtagaaggcgtggatggcgtcgggtaatccagcacgcgcaccgccttccccttgccacggagcgtctcgcagtagcggcgctgccagtcctggagcgggtcgtagccgccgatcaccaccgtggccggagggaacgccggggagtcaatgccggcggcgccggcgggggaggcggcgtgcgcggcctcgtgggtgcggtcggcgccgggcgggaggaacgcgcgccagagccagtcggtgcgcgggacggagacgatgggcgcgccgacgaggcggagctcggcgggggtgcgctcctcgccgccgaagaatggctggatggcgatgaggccggcgaggcggaggttggcgaaggtgtgcgcggcgagggcgtagcggcgggcgacgtggtgcgcgatattggcccccgcgctgtccccggcgacgaagcggcgggcgacgtcgagcggcgggacgtcgccgtcgtcggcggcgagggggtggttgttggggtcgtcgaggaagcggagcgcggcgaggccgtcgtcgtagggtgtcgggtagcggtgctccggcgagcggcggtagtcgacggacagcacggccgcgccggcgtacctggcgatgcgtcggcacgcggcgtcgtaggcccgcgacgccgcggacaggaacgcgaacccgccgccgtggaagaacaccacgacgggcagcggcttcgtcgcaccggcttcgccaccgccaccgccggcttcgcctccggtggggcggcaggggtagaagaggcgggcacggagcgggatcgccgggtcgacgacgacgtcccgcgtcgcgacaccctccctgggcgcggcggagggcggcacgggcgggtcgaggaggtcgaggaggcggcagctgatgatgccgtcgacgcggcaggtggcgtcggcgccgcagccgacggcgaggacgaacaggcgcgtcggccacgtcatcggcggcgccaccctcttcgtcttgtccgaatccgaatgcatggcctcgtttcggaattcgggacagcgcgctgagctgaatttttttgagaattaatattatttttatgaaaaatcgcaaaagtagtggtcaaccggggaaaatcgcgaaaataggtccctgtcgaacgggtgcagttcgatagggcgcctatcgaacggccagagcgcgactggcgacgagatcggaaggctgccgttcgacaggacctgtcgaacagcccccgttcgacaggcagggctgtcgaacagcccccgttcgacaggctgggctgtcgaactgccgcagttcgacaggatgtccgtcgaactgccacagttcgacagggtcgcgttctccatttatttgtaataagttattttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaatagataagtcaaggacgatcagtgcccttcgcacgcttgctaggtcctcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcactccgtgatgcgtcgacgccgaaccgtactcatcgtctgtttgtacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtctgttcaacacgttgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggacactcgtcacgtcgtcagacctgacgactggaggtctcgcctctagtctttgcagcagggtgtcggactccacgtgaacgtgctcaacaaattccgcctgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactaggtgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaaatgtaggattaaacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtgacaagtcgtcctccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactgcggctgtaacaagtagtagttttcattagtcatataaggaaagtttgtgaactagtattcataatgataacataaacgaatttaacaaaaattacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagttcggcatatgtcgccgcaagtaccgccgacccccaactgtactgtggaatctccgcgataggtaactctgcaatctgctccgcaaagtggatgaagtgcttgtccacggagtcagcgtgagttcccgtgaacatcacccatccaaacaaccacaacaggtaagcgactaagtgccgctgcacgatccactcctcctggtcatcagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagctatcggcagccccaacaaataagacacatcctgcagagtgggcaccatctctccaactgtgtggtggaaagtgtgggtctcaggcctccatctatcgacaagagcactcataagcgccgcgtcaatgtggattcgttcggaccttgcacgtgaaggctcgaccaaccgtgcaaatgtcaacaacccagctgctctcagcctacaacatgacagagcgcaagttattaatacatgaaaatataaacaccttgtattagtaaaaacaatatattttcacacaccttggaacccaacgaggatcaatacgccaatattgatccggtcctcgcatctttagcacattgcagaaagttcctgtactaagacgtcgcgatcgatggttcctatcgatctccttgtctatcagctgcccatcattttgatcagccatacctgcagatcaaaaaccacattagtacaatgcacgtatggtaacagtacaataaatgtatgcaacataattcaattaacaaatttgcatgccatttcaatttaaaattacagtaccagcacacatagatacagataagaatagttcagtacatttcaatttanaattacaagcccacgacacatatattacgatattacaagtgcagtgcagttcgaaatttanattagtccaccaatacaaatacatgacgatattaaaagtgcagtgcagttcaaaatgaaaattacaaggccattacaaatagattcgggtaataaaagtgcaagaaagttcaaattaaaattacagacgcactaaacataaattgaacgataacgatcttcaaagtagggagtccaccaaggataatagcgaactaaggattatttttcttcttcgacttcccctttggaacgcgacgaacatcagcgcctgtggcatcttgccctacattgtacatgctgcaatctttacgggaatggttctccccgcaaagaatgcaagctttcttacgacgagaacgatctttcacttcagcttcatccataaggttcttgatcctgcgtgactggcgacgacccttagtatcaactaataaatttgagtcaggaacccaattggcttgccctggaggaggacgagtgaaatcacacacggcacgccaaccacgcaattcaccacgccaagttgcctcccacgattcctttctaaagtagggagaaacaaaaatgtttccatcaacaccccctttgcggaagcagcaagaacatgggaacatggccgatgtaacaggtaaggcttgttgcaattgcatttgcaagcgtgatactctggccacaacgtgcattccaatgtgatgtcagtagtcccaatgccgacaccactcttgtcacgaagtcgtatctcaaataacaactctctattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccaattatacacttcagcaagatttgttgtcatcacaccatacctcaatccatctgtatcgtacaacaacgaccatttctcccttggctcaaattctacccactccgtgaagcacttcgtggcccttccacgcttcctgcgccgagtaatacttggtgcttcattaggaatgggttcaagtccctccggctcctcctgtctggcaactatgggttttttcctaacctcttccatgtgtgtagtggtcaaatgatccagttgctcccatatggcatcaaactttctttgttgattctgcttgcataacttcttgaacaggtccatcaatctcttactcctgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagttgatgtgttctcgctttcaacaaatgcaaaagcaacaggaacgacatggctatccgcgtcgactccgatcgcggttagaattgttcctctgtacttgcttgtcatgaaagtgctatcaacacagagcaaaggaatgcaatttttaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaattatcgggtatgtaagtttcgttgtcccacagtgttgtatcttctccttccactacaagcgcaatgtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacattttgtcttctgcaccactattgccaggctatagcctttctcccttactttactaacaaacttcctccaactcccagttgacgcaacctccactactctccactgccatccatgttgacccctcactggccacacggcatttatgacaaatttatcatgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacatattttaacacacaacatatcaataatatgtactaactaagaactaatttaaccgtacaattacttaaatacctctaccaacatttagcaataacaaatatgtgctaaccatacatactaacattgaacaatgcgaaacaattaacaactcttaaaccaattttttattaaactttcatatgcattgtacttagggattactaatgtataccttaacttcactgctggagggcgtcgccaaccctttcctcccggccggcgcctcctctccggcctgctatcccctcccctcgctccctccggtgctcacggcgacgatgtggcgactctcgacggcggctggcgatgtggtcctcaaataaatcgaacaagcatcgcgggctggggagacggggctttaaaccggcctgtcgaacgcccattgttcgacagggtcggtggagggacctgtcgaacgcccccggttcgacaggcctggcggcgcggggtggtgggccctgtcgaactccctccgttcgacaggcgagcgtgtcgaacgccagccgttcgacagggctctgtcgactgcccgtcgttcgatagatgccctatcgaattgcacccgttcgacagggacctactttcacgattttccccggttggccactacttttgcgattttccataaaaataatattaatcctcaaaaaaattccgctgagctcgctttgtcggatgcggaagcgtgtgggttatttataggaggcgaccggtggctgacgggtggggccacagccgccgctctagtagtctagttagtcgccgtcgccggccatatgtatgcaactgggggtaattacggtgacgacgctattaactgcgatgttacccatgggtgcaattagtgcaactactcgtgtatgtagccgtcatttggggagatgcaagtgtacctgcagcgggggcgtgtcggccgtagggcatttcacatttgaccaacgcaacagcacacggtttcgatatatggcgtgtgacgagctgacagtgtttcaatgtgtgcccttatcttgcaacaagtgtctttcaaactgataagcgatatagaaatatcaacaaataataataaaaagataatttataggtacagtatttatatataaatataaatgtattgttcgtggtttacaaggcaaagggttaaaaaaatactacctcagtttgttaatagatgacgccgttgattttttatcatgcgtttgactattcgtcttattcaaaaaaatttatgtaattataatttattatgttgtgagttgttttatcactcaaagtattttaagcatgattcatatcttatacatttgtataaaatttttgaataagacgaatggtcagacatatgtttaaaagtcaacggcgtcatctattaaaaaatagaggaagtataacactgcgatgaaaaaaattcatagaaacataagtcttaagtagaaacaactataattaagtttatttactccctccattttaggttataagacgttttgactttggtcaaagtcaaactgtttaaagtttgacttagtttatagacaaatatagtatatttataatagtaaattagtttcattaaataattaattaaatatattttcataataaatttatcttgggttggaaatattaatacttttttatacaaacttcgtcgacttacgtcttataacctgaaacggatggagtaatttatttttttaggctgacatgtgaacgaacaaatgataataggctactaattatattaccgtgcaaaacttttatctatcttctcttccctcctctagttgacattgtgccgactgtcaccggctaattactacgtacgggatgtttcgttgcgctagttcgctacgaggataacaacataggacgagtagttcaaaaaatcggctaacttttctgtaaacaaagaaggaagtcgtcaaaacctatacgcactaaatgctctacttgataggaattttatctacagaagaaaacggggagaacgttaaactttaattacgtagggtttccctattggccttatccttgcgtacattgattgcagcaaatgcatctactactgaataaccgaaaccacgaccatgattaatgctagcgaaagccgctctgtctttgatcgaaggtgcccacactcatcttgttcgttgtcctcgagtattattcttctaagagcaagttagtacagtccactactaactccaattcatctatagctaatctaatagtcaattcatacaatagttgattactatactattaagaaaaaagtatgaattaccccctaaacaattgcggtcgaccgaattacctcccgtaaactcaaataccagacattttacaccctaaactatttataccggactaatgaccaacaccgttctgagcggttttgatttgagctagtacacgtggcgccacctgtcagcaaaaataaaaaagttaaataacccctaggcccacctgtcatccctctcttcgcccaacctctctcccagccccccgctctctttctatcgccggcgaggagatgggcttaggcttgatgcggttgagatggatgtagaggcagccgaggcactggacgaggcggtcggcgctctggacgaggaagcgcacgacgtaggcgtcggtgaggagttggagcggcggggcgacgtaggcggcgcggaagcacacccacgaggaagggaacgagtcgacggaggcgacgaggacgtggccacggccgttggcgttggcggcgagctcgacggcgaggaggaagacggacaacaggagcgatgccctgatgaacgcgtagagccgggaacgcggcgacggtgtctcggcgtcggcatcatccgtccgcccggcggcgacgcggcggcggaggcgaggcaccccgcggcgcggtgcgcctgagcagctgcaccaggtgatctgcttggcgttcttgcccctgcctcgccgtcgtccgccggccaagaactccccgtcgtcgtcgtcggcgtcggcgtcgatgtcgatctcgcagatggaccagttgggattgtccatcttgacgacgaccggcgtctcgccggcgccggcgagggcgggcttgctgccggcccagaagccgctccacggcgccatgcacgcggcgggagcgagaagaacactcgacgacatgacacgacactcccgccactcgctgagctcccaaaatagcaagctttcactgacacacaaatgcacactattcctggggctccccttctttcgagctgctgccaatgcccatcaaccggagccgcctcaagtcaccacacctccctactctccgcaatgcgatgcgagcagcgagctccactgccgccgttgcaatggcagaaaagctttagaagaagaaggtgctccatcccgtgcggcttcaccgcgctcctcgccggcgacctcccggcgtgcgcgccgccgctgaccgtgctcttgcacttcttcgcagcgctcgggtgcctgcccgagactaggtactccttccgtgccgccccatgagagagagagagggagagagtgtgaagagagagagaggaggggaaggggagatatgacaggtgggtcccacaacttttttttttaaagaaaatactgattgggttgtcacgtgtagtcacgtaggacaaaactgctctgaattaagttgagggggctaattcatccggtattgaaagtttagggtgagcaatgtctggtttttgggtttagggggtaattcggtcgaccacgatagttaatggggtaattcatactttttcctactattaatatatggtcccacctgtcatacatacattgcgccttgaagcctatgctgcagctggctacagatctatagcccgctgctcttctctcttatcttttatcttattaaaatatgtttatagccagcactgttaatgttaatagtgctattgtacatgctctaattcatccctataaaagctgaattctaaacggcacctttaaaattcacgtgctggaaaaataagtcttgacccgactcagtttgtgccggctctgccaaattcaataaagatcaatacatagttcattattattagaactagaagatagcgtgggcatgcatgataggatgcgttgtttggataagtttttaacctatttgttagctttatgccatataatatttaatcatcctttaaaaaatgagtaaatttcacaaaaatatacgtatagttttgtggtccaagttacagagaaccacacactttaacatttggcacttaagtatatatattttggtagtgt

SEQ ID NO: 78208 - DNA, 3605 bp, Oryza sativa
actaaactaccaaaatatatgtacttaactgccaagtgtcaaaatatatctgtaacttgaaccataaaacatgtagttttgtaaaatttactcttaaaaaattatctataatcttcttcctcatctaaaataaggcagaattagtctgttagaaaacatatctaacaaattaaatgtaaattaaaaggtaggtgttatttttttgaattgaatgtttagaagctatctttttttctaccaaatcttaaaagactataattgctaacaaatatgttttatttgtatcatctagttagccctccttttatttagtttatagtgatgcaatttatattacttacatatgaataaaacagaggagatatacatgcaccctaggtcttgtttctctataatatgtgtgatctagtgtactttctaaaagaaaaatataatcaacttgacccttaaaaataaatttaatagtaagaaatataacttatacactctatgtgctgtaacgttatggtccctttgtatggaatgaaaaaacagaggaataaaaaatagacaggattcagataggaatgaaaaacagagaagtgcaaaacgtaggaaaaatatagaaataaccgtttgattggaccgcaggaaaaacacaagaattggacgagagagatagactcaaaggaacattttcaaaaggttggaactcttgctaaattttcaccaaaatctctatataattgttcatcccataaaaatttcaaaaggatagggtatgattaaatcctttgttttaaagtcctttatatgaatttttttctagagatgaaatcctccaaaattcatatatttttccttcaaatcaaagattttattagtattttgcttatatttacaataatatgtggagaaattcataatatagtggcatacgatagagaaaaaaatttgctacaggacaaaaaaccgtgtaattaactgtagaacatctaaaaaaaattgatttagctcacatacactccaaaagaaaaggtgtaatttgctagaggacactaaagctattatttttattattttcaggtcaaatgaaggaagaaacaacatagaaaagatgagtttgccctttagatccgctccctttggtttgggtattaacattcttgtcttctctcccacgagttagcagctcaagcgttcagccatggcgactccccaaatctaattcaaagccctcgccttcctcctcctcctcctcgccaccgccacggtctccacggtgtctgctgactatgtggtggccctcaccgagtactgcgccgccctcatcaagttctacgcgccatggtaataagcgatgatggctcgcctcgccgggtttcgtctcctcccgtggccgctgtgtctcgctgggatgtgtgtttgggtcggatccgtgggtgttctgggctgagggtgctcggatctctgtggatgagatgggttcggatcacgctagatcggtggaaatggtggcggcgtaacttgcattctcgaatttgtagtcgatttttgtgacattccacagccaattacatgttttttttcctgtagcaaattttgctaaaaatcattaatatctaagcacttaattaaaaaaatgatgtaatgattatggtaatggttgtttcaatttaagtgaaaagtatgaagaaaaagaagttataagattttctccaattagtttcaattaatgtatttcatattggcatttttttctattttctgttttgttttatgcaagtcttattttaagtttaaaatttgtgatatgttaaatagagatgaagcgttacaccttttatgtcaactttcttgaaaaagaaaacaaccaccttttttataagcatgtaagaccgatgtaggttttcactgtttactaaatgcatgatttgtagagtccaatattattgcatagtgtgggaaacatcccatctatgaacatttatgtagagcgtgtgaggttccgtatagcctagcgtaaatacaatcagagggctaaatttagttgtgcacgcattattattatttttggaatgtgatttattatgaatacatgcttgaataaatatgtgtgatataccaaaaatgcattaaacaccacctaaaatctattagatggtacctaaaaaaatctgttagatggtaacgtaatatagtttagagcaattacatgaaagatcatttggcttactcagattatttgactatattaatttcaaaaaaacatgaaaaaattggattattttcgttaattaaagccactatattttttagagtaaatttcacaaaactacaggtattttgcacaatttatcacaaaactacagatttaaaagcttgtttcacaaaactacagatttagggtcaccgtttatcacacaactacaggtgctttgtacaatctatcacaaaactacatatttaagaacttgtttcacaaaactatagatttagtgtattcgtttatcaaagaactacacatttagtgtcttcatttatcacaaaactacagatttaatttctccattatcacaaaactacatatttaaccatgctaaaacctgtagttttgtgataaatgaagacactgaatctgtagttttgtgaaacaagttcttaaatctttagttttgtaatagatcatgcaaagtatctgtagttttatgaatttttctctattttttatgtagtgacttggactatttatatttgagttaaatttgttttcttaatttggctatacatgtttgcataacaatctatggtgatgcgacttgtattattgaattatttcataattatttgtggtaatttggatgacatgacaaaggccaatggtatatgtcccaccgatttttatttgttacttcctccgtttcacaatgtaagtcattctagcattttccacattctattgatgttaatgaatcgagatagacatttttcacattctatctagattcattaacatcaatatgaatgtggaaaatgctagaataacttatattgtgaaacggagggagtatgttcttttctcatgtacagtatatttaatttagttttcatgtttacaaaataatatatgatggtgaatcctatgttgttgaattatttcacagctattttattatttcaaagacatataaaagggcaggtgttgtccataaaaaatattgttttatacttggatttatatttttttatactattgattgaatttagctatgcatgtttgtagactaatatataatgatgtaatctatgttcacaattttttacagtattttgttgctatttggatgacctgcaaagtgcatgggtcgattgttcccaaatttcatgtttcttatataacaaaatataggaatatgcatcttactttttttttattataatagagcaaagttagattagacattgcaggtgcaaatattgattgtttctctttcactttgatagcttatgactagtgaagagcatagagctagagccagagaggaagtggtgggtaatgctatgtgcatatgagggagggaggtggaggcgactttctttttctatctttcctaaatgatataatg

SEQ ID NO: 78209 - DNA, 994 bp, Oryza sativa
tctaacatattgccaggataggtataacaatcctcatacaaaaaatactgatttgcatttcaacagctcagtagaaaataatcatatatggaaaattaataggagatatggttgctgatttgcatttcatggtaggaatttaaaggaattgtagaatttatagatttggttatccacttgactatttaaataaaaaccaactatgttttttatactaagttatctaaatatccttctgtagaacatgcaaccatttcaaattattaaggttgccacatcctctccttagtgtaagaagaaacttcccaattgaaggtcactggacctggacagaaaataggcaattgcaccatgcatagaaatatagtatgaaaatatattcatctattggacttgcaaacaaaaactgaagtctgctattccatattgggatccagataattacctcattgtgcaggaaggtactgcaaaacattttcatcagaaagtaacaattgcttttgttccccatattgcattgagtcgtagatgtcaactaataatctattatgaatggttgcaaacctgaaattaggaataaatattttaatatcagaatgcccgctatcactatcagtaagttccaaaatgcttgaatgaatcacacaatagtattgggtaagaaagaccatagatattatagccttctatcataatgaagaaataaacacggatggaaaatcaataaaaagatccaaggccataaagaattgttgatctatgggcctagaataagcttactatgtaaaaaagcatatagagattaataaattaagtcaatcaaaatggagatataaaataatgtacctttggagtggctaaaatcaaaagttggttgtggacttgtggtaatatgccaagattgttaggtttacatataagctttgatgacgttcattaacattgccaatataagattgttcataataaacatcatctatctattctatactat

SEQ ID NO: 78210 - DNA, 7567 bp, Oryza sativa
ccagaacctgcgtcacattaacagatgatgaagtgaaaaaataggactcagtaaagagaggaaatggggaggggatggcactgagcgaggtgctcatggagagggagaggataggagggtgtggcgatggctgctgactccgtccgggcgatcggatccagtggagggggaggccaaggccgatgaatcaaatggtcggagagggtgagggaggcagtggcgtggcagggatgaaagaggagaaagggcggcagcggcggctctcgttcctctctagggcactggatccgccggcgaggagaatggggtcatcggatccggtggccccagcctcctcattgggagatccggcgggaaagaagcggcaatggcggcacggcgagatggctggttgagggagtagtggcgccgatggcggcacggcgagatggctgagggagtggaggggttgagggaatggaggaggagggagttgcggcggcgacgacgcacgcgaggaaggaggagggctaggatgcggcgcgatgggaggaggagggagaggcggcgcgcgtggggaggagaggacgggtggctagggtttgtacgagttggggaaatccacaccgtccgttagagatccaacgatcccacgggtgcggaagggccgccacaggggggagcatggacggccaaatcaaccctatctcaagatcggacggtggacattgcgaggaccagcgcttaattaaccaaaagtatggggtatattttgtaaaagacggctgaggtggcacgctaatcttcagccattcccacggcgtttaagtaaactaatatgttgcttcagaatgcttacaatcaaaactcaaactagcttcaatcactgcctcaaacatgtaaaaacaataagatttaatatataaaaatggtatcagtatattaacttagcattacaaatactactctctaaatgaaagttttgctgttgtggaccactttttgataaaatggatctaaacaccagtagcaaaaagtaggcaagttggcatttgtcatttgggagtccatcgcagcaaatttggacaaaaaagcgtcgggccccatgcatgagagaggcagcagcaattaatggtaaaactttaccattcatctaaacaccaactagcaaaactttaatgccaaatcttttgccaccaaaacttttgccaaaaaattttgccacaacaaattgatctaaacatgcccatagttgttgagaaacgtccgagggtctccggctagcttcacaaattggtgtgctagtcggtctgggttcgaagccttacatcttctatttatttgatattagatcattccataatattccttgtacattagagattgtattgatgtgctaacgccatgtttagttccaaagtttttctttaaacttccaactttttcatcacatcaaaactttcctatacacgcaaagttctaacatttccgtcacatcattccaatttcaaccaaactttcaattttagtatgaactaaacacagcctaaaacaaagtaaattagaaaagccactttcagttatctaaaaccataaatcccattttattggtggcctctactttttactcctaacaaattattgacgacctcatcctacaccatgcagtataacatatgcgaccaacacaagtcccacgtgtcatcttactactggataagctcactagtgcctagtgatagctacaatacgtggcatctcgcctaatcagtccacgtcatcactcaccacccccatcacgcaaccccaccccaatcactcactcaccaccaccaaccaaccacagtactgctcgtgctcgtgtcgtgcactgcgacgccgaccagtcagtgctcgccgccgccgccggcgacgatgtccttgatccggagcatgaggtcgcgcgcctcggcgaactccgggaagatgtagaaggcgtggatggcgtcggggtagtccagcacgcgcaccgccttccccttcccgcggagcgtctcgcagtagcggcgctgccagtcctggagcgggtcgtagccgccgatcaccaccgtggccggagggaacgccggggagtcaatgccggcggcgccggcgggggaggcggcttgcgcggcctcttgggtgcggtcggcgccgggcgggaggaacgcgcgccagagccagtcggtgcgcgggacggagacgatgggcgcgccgacaaggcggagctcggcgggggtgcgctcctcgccgccgaagaatggctggatggcgatgaggccggcgaggcggaggttggcgaaggtggtggaggcgagggcgtagcggcgggcgacgtggtgcgcgatgttggcgcccgcgctgtccccggcgacgaagcagcgggtgacgtcgagtggtggaacgtcgccgtcgtcggcggcgagggggtggttgttggggtcgtcgaggaagcggagcgcggcgaggccgtcgtcgtagggcgtcgggtagcggtgctccggcgagcggcggtagtcgacggacagcacggccgcgccggcgtacctggcgatgcgtcggcacgcggcgtcgtaggcgcgcgacgccgcggacaggtacgcgaacccgccgccgtggaagaacaccacgacgggcagcggcttcgtcgcgtcgccggtgccgccgtctcctccggaggggcaggggtagaagaggcgggcgcggagcgggatcgccgggtcgacgacgacgtcgcgcgacgcgacgccgttgcgcggcgcggcggagggcgggacgtgcgggtcgaggaagtttaggaggcggcggttgatggtgccgtcggcgcggcacgtggcgtcggtgaggcaccccgcggcgaggatggagaggcgcgtccgccacgccatcggcggcgccacccccttcttcgtcggcttctccatggccgtgcctctcgattcggacagccgaggtgagctgtgctactgagctaactgaggtagtgagaggtttgtctgatgcggaagcggaagcgtgggagactgggatatttatgggaggagagaggtggctgacgggtgggaccatagccacgctgccggccggggagctctactggcctgtgactgtggtcgtttggtggttctgagagttaattcctcccgcccgcaaaacgaattgatttattagtacacaaattactatgaaggtgccccgcttatgagtggacacttatattatattattgaaagataagtttttttttcagaaattttgtcttataggttataggcaaactaaagtttagataatattattttataataatttaagggttctatttttttttcttaaggtatctttaaaaaccattcagaaacttttgagtaggagatggattaagtacttacgacttttgaattatgttttttctctctagttaataagaaactattgctagttaattatcatacattccatctatatacataccgtgtagtatggccgcaaatgaaaaatacgagtgcaagatactcaaaattcttgtgattaaatcgtctcacgaaggcgcatgatgtagtaataaagggaggaaagcatatgcatggaaaaaagaagaaaggggaaaatgaaaaaagggaggggaagcatacgtacccacgtacgtaggtgcatacctatgccgcgggaggagaggtgggacctcgtagtatttagtttgttctaatatcaatttaatctaacggtttataatattggacgtaccgatttaagtgaaaatcaagtaatagatactttgatttttttttcttagaatttataatatttgccataatttattagagcgccacgtggcagcttgagagtattttaaggaattttaaaggacttaacacatgtaattagaatattaaccgtgcaatatatataggggacatatgtaaaatttgttccagcttcgtttatgtttatatacatgtagagagaaaataattttgtggctagcaagccattagatgtctaattaatagcaattaattttgacacctatttacaattattcagagtagatcttacatattcatcttacgactttgatgattcgttgatcaccaatttactgattaccatgactcgcatgaaaaaaaatatgtacaacttaaggtttagaggtttaggatagctgaaattgatgaactatctaatttatgagatagctatttgagggtataaacgaatgaattgacttctaaaaagttaaaatgttgtctaaagaagacaccatttaaaaacttggaaagcgtgcgaacaaaaatctaaaatatgaaatgggaaaaaaaagagagggccttaaactccctttatcacccttgccatcgttagagttctatttatattcatcaatattgcgctcacatttataacataatgattcctttcacatgtacgaacaaatagtacaaaatccaaatacgacataacacaaatacaatataattattatgtaataaactctcagtttcagcttaaacagaactaagtgttgggaaaaacacaacccatggtgcttaattattcccttgcttcatcacacatttaattttcttctcatgttattaaaaaaattaatcatcttcatatatgatttgatatgtggaaaagcggtagctagcactacagcggttatgatcaccttagatgtttcacacactacgttttgtcacgcgtgcgaaaagtaaaggtgtagacgtgcattgtgcagcgggcaaaaagagaatttcagacgctttatttattagaaaaaaatacatccgatgattataataataggtccgccggttacaatgtaagtgtaaattagttagatttttaaattgttaatttaatgggtacataataaaatggtgtagtccttattttgatacagtacattgcttgagaataatagaccaatgtaataaaaaatagatccgaggatttacataatggggccatcagtttaagtgcacatataaattagttaatatagatcttaaattgtttatttaataggtacacaatataattatgtaaaatttattttaaaatagtgcattatttgaaaataatagtacaatgtaaagagtacaccggtttaagttatatgatggcagattttttgtttataaaattatgattatttagaaaaatatccattatatatatagatggaaaaaaaaggaaaaaagaaaaagggaaggaagtgcacgtatgtacatacgtacatatacctgccaatgtgtggaaggaggatatgcaggaccccatggtatttagtttgttttaagatcgattttatctaacggtgtataatattggaccaatcaatttaagtgaaaatcaaggggtaaatgttttgtttttttcttagaatttctaggattttctctaatttattagagcgccacgtggtggcttgagagcgtttgtaggaagtttaaaggacttttagtatataatagataatagattaattaattaactaattattactcccctccgttttaggttataagatgttttaactttgatcaaagttaaattgtttcaagttttataagatgttttaactttgatcaaagttaaattgtttcaagtttgactaaatttatagacaaatatagtgatattcataataccaaattagttttattaaagtaataactaaatatatttttataataaatttatcttggggcgaaaatattactatttttttctataaacttggtcacatttaaagtagtttgactttgaccaaagtcaaaacatcttataacctgaaacggagggagtaggtaaatttttgaagaaatagattaatacgattttatttataacttttctatacgaaatttttctgaaaagtacaccattttggcagattgagaaacgtgcatacacaaaacaagagataaggccttgtttagattataactattttctttcaatttccaacttttccatcacattgaactttctacacacacaaacttccaacttttccgtcaaatcattctaattttttcaaacttccaattttaacgtggaactaaacacggcctaagtagggaacaattctcaccgaacacagcagctactccctccgtcccattttaaacacagttatgactttccgtattcaattttgatcgtgtgtcgtatttgaaactttttataattaataattttattcttatttgataaatagtattttatacgtgatttatgtttttaatttaaaaatatttttaaataagatggaacattaaaattggacaatggataggtgtcggtcggtgtggccgccggcggcggcggcaaatggttaattacagcgaggtggccattaactgctatctacttctactgaccagctatatggcgcatatggggagagttaatgggagcaactactggtgtgtgtaatgagttcgcagatgcacgcactgtgcgtctacctgctggctgcgggcggccgtgggtgggagcgcgagaccagcgcaacggcaggcagcacacgggttccgccttccgcgcgcggcgccgatggtgtgatgcgccagcgacgcatgtgggtcgcctccagtaccgtccgctaacatgtgggcccttcaaatgactgattctgtaaatcttttgggcaagctccatctccactttcatctctcttggagttggagctcagccaaatagtttcagctccacctaaaatagaagaggagttgggtggagctatctcacagagaggtgtggttgggtttagacagctctacaactccactacagacccaacttgtaaagctaaatttagaagttggagctctatcaaacaggccatctatctagcggttccacgtatccgtgatgcacatcagataacagtgttgtagaggggatatccggatcgaagcacagcacatgatcattctatcatcttgtagtttggatcatttaaatataaggtataaccacccctaacccaaacactaagaaaataattattatcatcttgtagtttggatcatcctaataaatacgatgcatatatccaatagaattagataacatgagagtagaggattttaaaagtaataatttaatggagaatgagtcatagttaattacttacatgtatgtatattctatagtattatggaatattaagaaaagtggttgtgtcataattatattatcgaacgaatggaggacatcctgcaatctcttcctccatctacttgtacgcatgcactgatacaccgcgtggtagagtttgctagaattatctggagtctgtagtctgtacaggtttaacaagaagtgaaggatttcacaccactggcagagaaaccatttttagtcggtccaccagatttcacaatagtttcgattgtattaaaaattaagactaaaaatatttttagtcccggtttgaaagctctgaggaattttttgatcactaaagatctatttatagtctcggttggtaacaccaaccggaaaaaaagatagatataagctttactcccggttgatgtcaccaaccggg

SEQ ID NO: 78211 - DNA, 4386 bp, Oryza sativa
tccgatgaattggtcacaaatttctcatagcaaacacttgatatatataggactaaaaaggaagtaactaatgacacctagatagatgagaactagcatgatttaggactaattagtaaatactattatattattttgatgtataaagtgacagttgtttgtagctggtaataatttggatgatcctacagatttaggaaacatgaatgtagtcaattaatgactatagctacaacattcaaacccttcctaaattgaatcttttcaaatcccaccagatatttcatcaaaatcaaaattaagagactaacaagtttatcaagatgtgtgcacatagttagtgccagtatgcttaactttgaatggaacctctctacaaatagaatgaaaaagcagagcaaggactcgaagatgcatttatatttattttatctttgctcttgagtctaagaaaatcaaactatcaaagggatctaaatggttgcctgtgtcaatctgaagtgctatgagttcatatttttagaagagagaaatattttcacaacacttgcatgaactcaggtgtcaatggtaaggtttgcccggaacttcatggcattttggctcgaacttcgggcgactatttttctagccaggtgttaagtgttagcatgacctttaaaatagttaatagcccattctaacttaatatcccattgcaaagcacgagtaactaaaagaaaaacccacatattatcccatttgaaagtgagaaaaaaccacgggctttgaaagtgataaaaccatgtgtggatccaccatccatcaaccttgagcggtcactctcatacgatagaaattgaatgttttccgatgaattggttatacatttttcatagcaaacacttgatatatataagactaaaaaggaagtaactaatgacaccttagataggtgagaactagcatgatttaggactaattagtaaatactattatattattttgacgtataaaatgacagttgtttgtagctggtactaatttggatgatcctacagatttagtgaaacataaatgtagtcatttaatgactacagctacaacattcaaaccattcctaaacagaatcttttcaaatcccaccagatatttcatcaaatcaaaattaaatcaaaccggccaaaattcaaccaaatcgcctgcttccgcccgtccaaattttcaaattccagatcggttaaaacccaataaatcaatccatccccttgctaagccccgttcacactccacaccccatccaacccccaccaccatgtctcccaagaaggacgccggcctctcgccgccggtggcggcgccgccgccgctgtcgctcgccggcgtgcccgtgctgacggggagcctacgccccgcggagtgcgccgacctgctcggcctggtcgccggcgtgaagcgcccgctcgaggacgtcgtggcggacttcctcgcccgcatccagcccgagcgccgcctccgcttcggcgccgccataaacttcgtcctcaaggtaacccgcccctccctggattggattccccccctcgctcccgcccgcccgcgtcgtctgcttgatgcctcctggttcgaggcgagcgcccgctcggcttaggcccccccccccctccgcgtggtggtggggcgcttaggttttcgaggggttcttggggacgtgttggtaggtgggctggtttggagcgcgggtggattcaggaatggatagattctgaatcaatcgcttttgttggtaggggaattttaaggtttttgctgggttctagtggtgcgtggatagcgatgtttagcggataatttctgcttgtagtgttgctctatagtctatgtgcgatctcctatttcgagaaagattgagtttttgattggggactggttgtttccatttcttgacaaccagctaagctttctaatggtgggttttgtattttcagtggaacagtagatatgttggttgcttgatgaggtttttagtgttgcacagcttgattacctgtctattttatcttttgaggtgcagttgcaagcccaatcgactgctgtcttgctaatttttgcgttttccttagtcacgcgataggttgcggtcaaaattggtgacggtctatgtgttgaaatggattttgttagtgggtaaatttgtacagcatgtgttcttctgttgctcaggccactgttgttacagggcaaataattgctgctagctgcattgttttttttactgttttaactgtcttgagtccatatgagttttgtgttctgactttaggctttgaagcgattagcagatttgttatgttctgtgtagaaactaatattgttatttgatttaacaagagcgtagtgttctacatgttttagctgggcatgagtaaggggtccaagttatcagtgtgttgtttgatgagatttgcgtcgttgaaatgaatttgcaaaccattatacttgaggtttaaaatcaatgatctctttccccctttatctttttccatttcttaaattctaaaagaaattctttacatgggtgagtctttctgtacactatccacaatggatgaaacctcctggaattatgctaacatctcattcttccaacctaccatacgaaattcttccctttttgcccatatgctctgcctcttatgccttacgttgccccttctacccaacctgtcaaattgttttagaatgtactagctattagcttttcaaggttttagtcacttggaataaattaagcagtgaataatatgattaaaaagtcacacagttaccacttttagctcatggtagaaatcaatgtttcttctagtgatcataatttttgtgccgctgttgttttaatggaatataattgaatatgtggatggttgcttccttgactgcttatgggcgttgctactgttcgtgctacattactaacgcccacaacattgacatatttgcttcctttttttattgttgttcagtgtcagaaggactcaacatcatcgtctgttttcatttcccctttagggaatggtactagtagttgtagggggtctgtcttcaatgcatttagttttcacatcttctattggagttgacatgatatgttatagatgatttgttggatttggttgtttctgcacatcactagttttttcctgagtgatgatagccgcgtaaattgttatgttgatggtgatatatatgatttttgtgtgatgttattattgatatgatttgagaaaaacttattcacctccatatcaaaatctaagtcattgtgggatctgtgtggttaattatttctgacatttctctcagaaacattttgaaagtctgagcactgatatattcaattgtacatagatggagtaacaaaaataattccattggatctatcttgcaaaatacttctgtaatgtgtgattattatttcacttatacaaaggtagagcaatcaatgggttgatttgcaggcctgttatcctgttttgatcatttttcttgaaattatacccttcttttctaaattatattttcttaatgcacaatccatggaaactctgcaaatctgcacatttttttctccctctgtaagtagatggtagtgaaatgcttggcttagacttacatactgcaatgtgctgtcaaaaggtttagatgtttttgtactgtttacatagctctatggattcttgatggtagactcccatctttcaaaaggttttgatgtttagagaatgatataccgaaaggaaagagtttttctccaattattcttctgttaaggtcctttttgtctattccttgtaaatacaggacggtttttggcagcttgtttttcatttcatttaatgtgcctcctgtttctgggatttcttctctaggtataggagaatgaaaataacactttgactttatactactttgtttttttcaggacaagatgatgcttcgaccagctgagcgtttagttgcattcacaattcttcatcaaggttattcctcacagttggaaaatccctttgttcctctaataatacatgtaagttgcaaccttttttctttttctttttttgggggcataaatattttacaggcttcattaatgtgtgctgatagtctgaattggtcatgtttatccttttaatttcatcgaataaactaatttattgtaaaaacatatttgtcaaaaggataaatgtaccagaaattgtgatttctgtctgcactattttatttttgttgtcaatttctctcaaatagttccacttgcctgtccaatttctatgtttgagttccatgtcacaattgaaccagggcacattcctttcacttccaaggtttatcaactactattaggtg

SEQ ID NO: 78212 - DNA, 2529 bp, Oryza sativa
ccgctggtcatccgagccagattcggtggtgttcttgtcgaaggatgtgctttggagatcatgaaaatgatttccgcaagcccagtacctgagatgtcctggttttccgaaattgattggaataatctgttgtcagtgtataactttggaaacacggtgattattcactagtcttgtgtttctgtttcgcctgacaaaacccggacaaaacagctaatctggtgttgttgctccatagtccacataaaacacaaaccttggcatgttcagagtatttcttgccacttcagtctcgagaaatactattcccatcttgatacacacatcctcaatagtacatgatattttggatttgcatcaaagccaacagctctatactactattgtcactaatgatgatgaattcggctttgcttgaaatatgaactccaataagtacaactcaaacagcaagacttccagctgatattcatatgaacagagcaggtacaggctatatactctacaattgctgccttcgctaagtaagttctgcccatcatcttcaagtagatcttaggttgaacctatctaccaggaactgcatttgacataagatatgcgcttatttatcagccgtagctcaaacaatcagagaaactattacacaggaccctacggtgattgagttcacttttgaaagcccctttttttttaaccatcatgctgcagatttgtcataatattgatcataacaactcatgcttaaaaaaccagatggtagtatggtactgcagagaacgaacggatcctgaaatcttttttgggttatttttttctttttgagatgaggggtaaagttcaatgatgacaactagtacatgacagagctatattctatgaagtcgacagctatcaagatctagcggtaaagtacaacatgaaaaactatggatgtacaccatggaaaatttttgtttaaaccatacatccttcttcactctaacgattttaaaagcctgaacaaaccagccgcttctcttattcgggaaaacgcaatgcagaacgcctgtacctcgatgaagagatcttgcactgcaaaatacagaacagtcaacaaaaatgtaaaagggacttcaatgtataaatgttacactattaatcaagacaggcctcgtgcattccacaagccatgataaatgagaaaaattggtatttcaaaatcagcattctaaattaggaaaacgaacataagatgtctatatctatgcacaaaattagggtacttcaatgcaaaatttattaaatcagcatctcttttgctgaaaactggtgggaatggtgcattagcattttgctattcctagatggcatagtaaaaatgctacttcttagatatggttcaataatcacgtcttggaaaatcatgacattttttcttaaaggaagaacagagagttaacaaaaagccaagatacaagcttgtcaggaaaatgattttggaccaggttctagtgattatacccaacatgtagtacttggcaaagtttgtcacaagaaaagaactgaaaattcgatatctggaatgtgaggactaaatataaattcataattcttcttaaaccattttatatgtctggcaactggcaaccaccataagacaccttactgaactcaagttttcagcaattggttgagttaatacaatatgaaggaaatttttgaagattaatccaatcaatatataaatgcaagatcacagttgtgtatgactggagaagtattcaagaatcacaatctatgtaggcccaaccaaacagaatacagaatgtaaatagaattgcacgcagatctaccaaatacatgacggtattttggtaaaaaaaaattacatgatggtacactcaccatttattatcttgtttcgaatgagactctgtaggaaaacacatactagccttactagcctgttttgcatgtatttatcctgtaaagaacgttaaacaaaaaaacaaaatctcagaattttctacacaataaacaatattgtcaatcacacgatcaagaggtagaactgatggtatcaagagtgtaaaaattaaaaaaaatacatatttgattggatgtaaaattgtaataaagttaaccggttatctaaaattttggattcagttctgtaagtgatttccattttcatacagtttatcgctggtcccatcaaagaatagaattggcatagggcagtttttctcctaaaacagtttcctaatcccctgataagaagatgtttgcaaatacaaaaaacacaaagaatggctgctggatccacattatcaaatgatttgatggagataagccaaccagaacttgatttggtaaaaggtacatcgactagggataagctggaaaaacaattcagctaaccatatagaatatgagaagaccaatgtatccaacccactcaaatacttttgtgtttaaagaaaaaaaatgcatttctttttatggtttgactttgttataaacatataatatgagtcatgtcactaa

SEQ ID NO: 78213 - DNA, 1259 bp, Oryza sativa
tgtttaacgggcccaacgcgcataaacccttttttcccgaatcgttcctttcttttccctttgcacgctcgaatcgattccttttcctgcatttcgttccgccgcccctttcgtataaatctcgccgtgatcctctccatctcccgcatcgtgctcgcccgtaccggcgctggcatgtcatccgcctcccgtgccacacggaggcaggatgagggtgtggcgcttcccctcccgtcgcccccatggcggctcgtgcgctgcttcccccttcctctcccatgctaaaggttgttcgcccctttaggttgccatgattaatgaaaaccgtcgacaaccaccgaggaaaacacttcacggctgttatcaagtaaatccattaatggcttaatgcgttttcttctcctcttatccctttatcagttctgcatctatatccaatttatcatctcgcttattcgtcgatctaccacactctaccaggctggtggcgttttactaccgttcttgcaactctgcttgctggattcatatgcagccctcacctggtcgatcctctccaattacttcaatgatctaacacaagttacctaccgatttcccctttctttatgttcaataaatctgatacccaacagagaattttattgttgctgtatcctctttttccaggtttcaggttcttggctactgatttagttgattcatattctttatttatcctgaattatagaccacttctcattcttaagtggttgaagacgtggcaaatatgcatctattggttgatttgtcgtcacccgatcagatctaagaactcatcgagctaagtaacaatcatatgggctgctaagcggatggagctttcttcttttggtattttaattatggtctttaactggtgaagctatatatatctcggtacatctatgtcgttgatgtgcttttcacttttgataaggtcctcatcaagaatgatgtcagattctccacacacagacacacaggtttgctcttaaatagataaggttgtcttccgtctcaaagttcattttattttctgatcatgtatactctagatatgtttttaagtatcttttgtcactcttgaattagcttggtgatataaatatttttggagttttctgaaagctaaaatcactccaaagagttaatcaaggatgagtacttaattatatatacgaggtaataatccttttcccaacttcccatatcttactcaagcatgaaaattttctacc

SEQ ID NO: 78214 - DNA, 1016 bp, Oryza sativa
ctgcagcccaaaatcattcgagcatacctcggatcgaagctcctcatcgctgccacaatcatcagccaaatcctcatgagatcctcccctccctcccaatcctaaacaatgccacaaacacacagatggggacaacgtacgcgcttacccccacacgaaaccacacaacgaaatcgatcgaatcagacctagctcatcgtcgtccgagagcagctccccgagccgatccttgtgcgcgagcgaatcctgcatcggaacgccagagaacaatcaccacctcaatccaaatcccctcccaaaaccaaacgatccaacacgaggtcccgcaacgaagcgggagggatatgtgtacgggaggctagggtttaggggggttcccttacgcggcggccggagccggggctgtcgtcgcggtcgcggtcgcgggggtgggggccgaagaaggagaggaagaagccgacgaggacggcgtcgaggaactccaccaccgccctcgcgatcgccgccgcgcaccggcacatcgtcgtcgcgtcgcggcccttcccgccgacgaggagagaggcggaggggaggaggcgaggagaggggatatggtttgaaatgggaagcgaagctgcgaagaggagggaagcattattattattattttattatttttttattattttggggaagcgagaaggatagttgatgggccaggccttcgcgacttcagcccaactattaatagtttgggcctcttctgttttagtcagatttgtcaacgcaccgggccgtagaaaaaaatatgtttgggcttcagccttgctgctctctctgcttctttctcttttttttttctgggaacatatatgctgtttggactttccagcagattgtaaaaaacaaaaaaaaaaagatttctgggttccttttctgtaaatagaagatcaatatctaaggaaactatttaaaaaatattttctcgatttatgtctctgtacacgtacttacctcctgaatattcctactaaaac

SEQ ID NO: 78215 - DNA, 1345 bp, Oryza sativa
ggttaattagcaaataagtttacataatgatattaggagataaacccagaaaatgaatggtactaattaatttgaatgccaactttaatttctggaaaaacatttaaaaaaaaggcatctatcgagtcacttaaacacttctggtcattctctatagcaaaacgtactaaaaatatctctgaattccagacaaaaaaattacatctagatctatcagggttcacataaattgatctatatctatcaacacgtaatcctctatactacatgggaaatgaagcttgttgttgttgctgttgctactaccactataggatctaataggtaatcctgggaccaccaaaaaaaaatcctatcccaatgtatatttacatatgtgaaatatatttttgcaaaaagaaaaaaacactgtcttattaatatattatgatgcaatcaatttatatttctaaccttattatatttagggtattttaaaaaatatataagttggatcacccatataaaaattctagatacgccaactactattatgggagtgaacattatttgtttgctcacctaaaatagttgatttctctccatgtctagaataaatataagtcaaagttgaaaagttacattttggtttagaattggaaaaatcttacagatatgaaagaatatcgaaattgaatatatactagaaaaaaaactccaaagaaaattaatccaatcgatataccaataattaatttaatattacttctagtcaatgtagtgtgcatttctaaaataaaaaatagccgcgcctagtttttgtaacaaaccaagtaccaaaatattacacgagtgcaaaagcaccttattcacacgtacggcatatgtacacgtgtatcacacgatcgattgaaaaccgaatgtgattaatcaagcatcattttaagtttttaacgcatgcacgcacacggaaaatatgcacactgcatgcgtaatacggcgccgaataagcttaaacttaattggagtttagctaagcttaattggagtagtcatcgttcgtgcaagatgccggtacggcactacgacctttttggcttagctatagactatagtctctaggtagctagctgccacttttgccttttagaccctgcaattgcacgcttgcactattccctatagtttatccgtactcgtaaaataagtcgtttaaaataatatttaagttaaatcttaaaaatataaattataaataattctcaagttgttaagtttgaaaatgtaaaaattatatgaatagatttgtcttgaaaactattttttaaaagtatacatatatcactttttaataaatatttttata

SEQ ID NO: 78216 - DNA, 558 bp, Oryza sativa
atagttgtagggtatctcaaactacctaaatagttgaggagtaatttagatttttcttttaaaaaaagagtgaagccaaatcctaagtgtgaatgctataacagaacaaaagtctgaataagttatcaagtactcaagattccgaaattccataaacagtcgatgtgcacggtttatatattattatatctctcattttgcaaatttaagttgtaagtccgtatttcgagctacagtcccagaattagggccccttttttttttgaaacacagtacaaacgcaggcgctcacaacgtgcgcacactcacccctatgaacgcacacacgcacactctacccctatgagcacctccggaagactgggccggcatatcttgagattgacgaagtcaccacaggcgcctcgctgtcgacgggtacgtcgcctaccactgaaagaataattagccgtaaatgcgagcacccgtgtcaaatctaggatttaaacccgggtgggctggttccaccacaaggaacctaaccagttgagctatgctcacttcacagaattaggcccc

SEQ ID NO: 78217 - DNA, 1238 bp, Oryza sativa
ttattctttcagtactagacgacatacatgtcaacagcgagaccgagacgtccgtggtgacttcgttaatctcaagatatatcagcccagtctttcggaggtgctcataggggtagggtgcgagtgtatgtatttataggggtgagtgtgcgcgtgttatgggtgcctgcatttgtattgtgtttctaaataaaagaaatgaattaattaggatgcatgcattgtttttactctccgtcaactgcatgtaaataactcaaagaaaatattattttagagtggtctcaattagtagtaatctactatcagtataaacaattactcagtttttgatagttaaaaaattaagatacttagttctactactactactactatttgaggtacaaatattaatacatatgtactcctgttaatagagaccatatatactactactactatttgaggtacaaatattaatacatatatactcctgttaatagacaccatagtaaaatagctatgaaagagaatatggtacatatactggcagtgtcatgtcatatcatcactggcccgggcacacagtgatttaattgttttatttcagataatgaatgggacaaactattttctaattataatgtatatatgccatatctttttcgtggagggggatttaccacgtctcgagatatatgctttcatgtgtgtgactatgttcgtgtgtgtgtgtatatagaatgaagaatttgtcttagtgtagagaacacggcaggcatgcagtagcatatatagatgagccctaagtccatacgattttaagaggtcggcaccgtcttaaattagcatgagggcgacttaatagtataggcatctactagcttcaattcatctataaccaacctaatagctcattcatacaatagttacatactacactattaatatctggtccacttatcatacacatcgtgtgtcttgaaatccgtactacagctggctacaaatctgtagctcgctgctcttctctttccttatttatcttcttaaaatatatttgcagctagcttatagcctgctctgtacctgttctaatggagatatcaattaaaacatctagcttataattaagccttgacttacgattccctagctccttcatcctggctccctggaatatatattctcacggcattatttccgttgttccatatgcatgggctgccaagcctttgaatttttagtatagcaag

SEQ ID NO: 78218 - DNA, 938 bp, Oryza sativa
aattagaaatattaatcatagactaatgacaaacatattccataaccctggactaattcgcgagatgtatctgttgagcctaattaatccatgattagcctatgtgatgttacggtaagcatgtactaattatggattaattaggcttaaaatgtctcgcgaattagctcttatttatgcaattatagttttattataagtttacgtttaatacttctaattagtctcaaacattgatgttacaggcctaaaatttaggtggtgtttggattcagggattaaactgtagtccctgtcacgtcggatgtttggacactaatttgaagtattaaacatagattacttataaaactaattacataaatgagagataattcatgagataaattttttaaacctaattaatccataattagagaatgtttacggtagcatcagataagctaatcatgtattaattaggctcaatagatttgtcttgtgaattagttcgggttatgaaatactagtaggttttatcattagtatatatatatattttgagcgaatcattagtacatattcaatacttctaattagtgtcagggaatttttttttttagcacctcccgtctcctcattcctcaatggtcatcctcctcccaacccacacggtccagtcctcctcctcgcgtagacgcggcggccgaggaacaagtccgtcacgcgaaccttccagaacctcacacgtcacgcaacctcctcctctttattacgactactaccaccccctctctcctctccgttccaccgccggattcagattcggagagagctactcctcgtcgttagccatggcgtccaagcggatcctcaaggagctcaaggacctgcagaaggatccccccacctcctgcagcgccggtgagatgcatatccctctcatcacctttttttgc

SEQ ID NO: 78219 - DNA, 718 bp, Oryza sativa
tcaaaagattcgcctcgcaatttacacgcaaactgggcaatgggttttttttcatatttaatgtcctatacatgtgtttaaagaatttgatatgatgtttttgaccaaaattttttggatctaaacaaggtcttattatacttgtgtttcaaactttcaataatgttttatgtacgtattgaaagctggatgagtacacaaggaattatacttgttctggtagcccggcgcccgggcctgcttctactgcgatataaatgattccggttaaatgacaacgatcgtttcatcgaaggattgacaacgctattgatggatgtgatttcctaagactactctgcgctgaaacgatcgacgacttgccagtcgtcacaaatgggggcaacgtcactgtccctgtagtgacagatcatctgcatctactggtgcaggtgcataatagtaaccgtgctatcccaaatttccaatgtgagctcattaagcccaacaatttcatagcaaaactgtgtgaaatggacgagtgaaaatttgggtaggaaaattgtccatgttatataggcacttataggtaacaataaggtggaagtgtttctaaataaataagcaagaataatcagcaataactatattaatacttactccctccgtattttaataagacgagtggtcaaaatgtcggttaaaaagtcaacggcgtcatacattaaaatacggaggg

SEQ ID NO: 78220 - DNA, 643 bp, Oryza sativa
tgaggatggggttggtgtctggtggtggtggtggtggcgggggagaaggtaaaggtgggccaccttggatgttggggttgctaccttcgggttggttgccatcaccagtagcagcagttctcctggttgtcaccatctgaaataccccaaaacaaaccagccaacagagagaacagactattaaaactaaccacccacgactaccaaaattattgaacttattactgatataaaatgggttcattaaggttcaggatgcttaagccaataaaataaagacaggctccgacacaatcataccacacaccggtacaaccatgccccacacgacttcaacaggaagacaaagagaaagaacacactcgcaagcctactaactgctcgtctacttctgcgacgggccagggcggaaggtgagcagcagcgcatcctccgtgctaccaatgccggaggtttccccctcctgaggaaccacgggcgcgggctcggcacgaggggtttccacgaagcaggtccacgccagggactaacgaacaagctcaggcctggaggtgctcttgcgggcagtgatcttctggctgcggcagacgcggcggcgcttgggacggcagacctctccctgggcgaccttgagctgacacag

SEQ ID NO: 78221 - DNA, 1109 bp, Oryza sativa
atatgtctattttagtccctatactttatgtgccgggcctagcctgccggcccatcgtgccgggccggccggtcgggccagcgtgccggtggggaggcccaaacacggcccggcagtcgggccatgccgtgccgtgcttgggccgggccaaaaagccgtgccatgggccgggccttcggcctcgggccttatggccatctataattgagagcgattttttttttctgtggaaatctaccaatccagaagcttatccacaaatcatcaatttaacatgcatcatatatggttcggcaccattcagattcgccagtggaaactgattctatgtacgcctactaacttcaaaatcttcttattttcataggcaacctgtccagctgttttcgataacagaggtacatggcgatgtggttatgtttgtagctttcttgggagttctgaacaaaccatttgtaacacattagcaggtgattacatggcttgttttcccacagaaattacagttttgttgttaaggggcaatacccgaattcttggaggatcattgtttccatttcatttcgttcaaaagaaatttgtttccatttcatcatctggtagactggtatgttcatagtgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacatggtatcagagcgttgatcaattccctaatagatcaatactcatggcctcgtcgtccagtacggctgccacaaatccgttccaaggccacccaatctcagagaagcttgggaaggcaaatcatgcgctctggagaaaattgacatttagccattgtcaaaacggg

SEQ ID NO: 78222 - DNA, 1235 bp, Oryza sativa
tctgaaaagttcaacaagaagatgaggtgctggctttgattttattgctggtgttccttcctttctgcctgtaccccaaccaccccgctctcctcgaggcgcagcagccattcgcctaaaaggaaaccagtactaacctcgggatggtgatggccgcgaccgcctgatgcgtgcgctgcggctgtcgccgtctcggcgcgggaggcggaggagaagctggcggcggccgggggcgagcaacggctgtctccccgtggacagccgcgtcgtcgacgccgatgaggaggagagcatcccctcattcgccgtcgctgccgggtggttgttggtgttgctggcgcgggatgtggcctccatggaacggccgcctccccactgcggccgccgccggcagccgtcgcagcgccgctctcctcctttgccgcgtcgccccggcggcctcctccccagccgccgaacagtttgcccagagaagaggagaaagaagaagagaagagagagagtatgaggaggaagggaaagagatggcgtggcatcctgacatgtggggtccacatgggtcctacgttgactcagccgctacgtaggataaaaccggggtcaacactatcgaaggagctattatgaccagttttgattagttaagggacggtcgatatctgattttgcggttgatggatgattttgtaacttgacgacaagtttagggaccttcgctgtactttttccttttaagagatgtttctttttcgaagcattagcgggcacaaggacctgtgcagtcgtgctgaccttgggtgaagcatttgacagaagaattgggaattgatcctatcatcaacgttttcagaggaaacgagtagccgagtactccctccatctcatagtaggtgacgttttcgattttttatttataacgtttgacaattcgttttatttaaaaaattagtgcaaatataaaaaaagataagtcatatgtaaagtacttttgataataaagcaaatgataaacaaaataaataataattccaaaattttttgaataagacgaatgatcaaacattgacaaacaaaaacttaaaaagacaagtaatatggaacggaggcagtaggtattaggtaaacaccgtttggtggaccgaatatacaggtagcagagccgagggttgaagagagcctaaaaacttgctctgggtgaacaatgggccaaccccttctgcttctttgatccgatg

SEQ ID NO: 78223 - DNA, 3942 bp, Oryza sativa
cgacatgatttacacgaaccttggatgctggtacagcagagttattctgggcagggacaaccttcacgcgtcggggcttcggacacttgtcagcataatgtcctgggtctccacagttgaaacacaccacgggcttgctgccttgctctctcttggcaggttgttgctgtgctggagctgcaacaggacgtggagcttgattacggatgttgttgccagcattgttgttgaagaactgacgctgcggacgaacaacagacgaagaacctccctgtggcatggactggggtcctaaagtaagacgcggcttctgattatttccctgttgtgccttgaagtgagcaatccgacgtttcttctgctccatgtgattgtacttgtcctcctgacgtatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgggtaagcgacctgaactccttcttcttgagagacactactcctgatggtatatgcgtcttccggaaagcagcggtgaattcaagccaagtgataggttcagcagtagtcctgttaaggcggaaatgatcccaccattcagaggcagggccatgcaactgatgtgatgcaaatgagaaccttctcctgatcagtacactgaagcaaatccaacttcttctctatggcatgcagccaatcactagcttcaacaggattagtggtactagagaaaacaggcggcctcacacaaaaaaattctgctaacttgttctggggaggtgcatgattatttccttggttttgctgattctgaaattgctgcatcatcatgttcataagctgtgtctgttgagcaagaacttgagcaagagtgggattctctccattgttggtgttattggggttgttgggaccattcccattgctgtgagtgttcaccatttggcatgggcagggcacaaaaagaaaaaccgggggaaactacttaagatagagaattactttaacttttattgatcttaactgagttttattattacaaactaaagactctcacaccactaaactcaccaacttcctaactctcaaaagcaaacaaacgcatgcacttacatcccaccactgatgtaaatcacatgcaagacccacacacacaagcaaacttaaaacaagcaaactaacacatcgatctaagacaacggcttaacaagtcactctagttcttccaagcatcggaggtcgattgaaggctcgtctttatcaacttgggttgctacccactcaatcttggaattgttgcgcttggattcttcttcttcatcactacttatgatgatgaccggaggatccgcttgagctggggcaacttctttctccaccacacgaacctttggcgccaattgatagcgaggaacaaatagagctctcttccttgcggtaagacaaatcctggccttctgcggcggtgcttctccctttaatgcggctaattccttctccaaacgatccaccttgtcttctaacttgcaaatcttaccacgattccaatcttcacgatcttgggctgctaacacagtctccgcacgactttcatccatagcccacaacatctcaaccaaatgctttgtggtaacatcattctcaattccttcagtctcaaggtaactgccacggtcacttccctgtggttggcgaggatggtagcgatactcagtgtcggccaattgatcactgtagcgatcacggagctctcctatggcgatccttgccacctcctgacatgcatggatgtagtttcttcctccagcttcaaacatcactgaggggatatcttcactattactgttcaaggtgactttgactcggcacttctcttcatgacgatcatgagcaatctgggcataaaaaggggcagttccaaatccaatgacaaaggacatcgtacgcaactcctggacaaaaccctcaacaccaaacaggtactcaggcttgtaacgcggcatctaaagacaggtgaaaggagggagttaagacatctatccaattaatagcacaagtttttggattaatttgaataaagtttgaaaatcaaagtaaaaaggtaagtaaataaagtaaaccaagcttgcgagataagttaaaacagttggaaacgaggtcacaaattttgtaattttgaataactggtttcaaaagaaatgaaagaaaattataaaatcaacatgctaaatttattttattgcagcaagattaaataaaacagtattgtaaaacttttgctggtaaatgagccattagtacagtaatagatgtacagtactaataacactggaataaattttgaatgagaaccattaaaagagattatgaaatgcatgtgccattagtttggtttaattaaaagagaaagggaggagaacagttctacttttccaatatttttagagggcttctatggataaccatttggcataacctaagggtcaagggagctctgataccaacttgtcacgcccggaatttctatccaaaattccaaacgcttacatgtgtgtgaaccttcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaataaaacagttaagtaattaaacaatattaatccaacgctatacaacataccctgttgtataggcccaaccattttgaacaaccatcccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccaccgcagcgcaccttcctagatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgagtcattagttatcccgaatgtgtactaatgtttctaagcagggctaagcaattatatctaatatctagttgaaccaatataaataaagctcaactagtcaaattgtaataacccaaggtatcaaggaataaggtaatcaagtacgaaagggccataacaaagaataggtca

SEQ ID NO: 78224 - DNA, 6950 bp, Oryza sativa
atcatccccgccgccgatccctcctcgccgtcccccggcgccgcgccgcaccatcaccagatcgcgcccgccccccgccgatgcagccgccgcctcttaaccctagctcccgagcagcggatccgcggggccttcctccatacgcctcggatcgcccgaattcgcctcgcccgcgccggtatggacgaaacgcctctcccgcaaccgcagatcggagctcgaattcgcccgaatcgactccaccagtttggtggttcaactgcaaatttggggattcggggattgggtcagaggaggagacccggcgtggggtttggtctcgatctgtggtggggtggtggagaaatggagaaaaaaatcgcgattcgggaagagagagaggcggatttgggaggagagagatggttatatggagcacggcagagagagacgacggcgagcgagattgggatgaaggggaatgcgcgatgcggggggcgtcctcgggagaggaaagcgggggcatttccgtcatttcgcccgcggcccacctcgcccgcacgggagacgctctctgtgcggaccgccgctccgtggccccacctgtcagtcgcggcgtgcggccggctcccacccgtacaggtcaccgacaggtggggtcctgttgacttgcgggtgggcaagtggtggtgtctgtagtgatttcctcgcacgctgatgtggatgcgggtggacggatttgacaagtggctggctcggtacgcggtgccctctccgctcctctcgctcacgtgtcactgacgttgcgggcccaggcgtaggtgggccccacttggtagtgacgtgagcggtcgctgtgctcgggctgcgacgcgtgatgccgggggcgcgacacgccgtggacggcgggggcgggggaagttggcaacggccaccgagttgccacgggttgcttttcactggaaggtgggcccgtgcttttctctctcggcccacatgcgccgcggggctgtgaagtggacttctctcacgtgttgttcttttttatttttctctctctttttggttagggagtggagcccgtactgagatgggccttgtgggctgcaaactggtttcccgtgttttgcggttagcggatctgcagatggctgtcagcggcggagacgggcttttgcggcagagtgtctggtcgcacactgccataccgtcatgggacataaccatctccatcgctttataaacttcagaacaatttttgataatttaaagtagggtccgcttgtagtaaattcattttttttgttaaaaagaacttgatggatctgttgtccttcattagggtatatccccttcgtccctaaaaaacaacctaaaatagaatgcgacattttctctattatactaggaacgccacaatcacattttaggttagtctttctataggacggaggaagtagactattcttaggttgtgttattaactcaaggtttccaacttccactcctacacatcccgaactactaaacaatgtgttttttccaactatatatatataagtttttatctagtacttaattaatcgtatgttaatccgtcactctattttacatatgaacgggagaagtccccaacccctctaaaagaacaaaatcatagaatgattaaagaaaactacgtaaaataccacctcaaatgtagagatttattttttagctatagtcgattggatatctgcataactattatttattcccaatgatttacaggttgtacgtagaccatgtcttactcaaaccgaaaacaaaatatctataatcaacgtccaaatatctataatcaacgtccgattattatgttgatcaaatcacatacaccactccccgtaaaaaaaacacacacaccactgccagcaactgacattgaaccaaagcaaagtatagtatcggagaataacttagttgtagtcactcactcggatcttgtcacaggtatattcatcgaaactgattcgacgggaaatgcatccaccaaggaagccataccacatgtaacctccaatgcggcacatccaggaaggccacaacatttaaagtgtctttgtcgctatttcgaccatttgaaactaagttttcaccccgaaagcccacataccacatgaaggtacagaagaggacgtcagcatcgtatttggaaaggtatgtggcacccataggagtcacctatcgatgctcctagcgagacatcgcccgccccagatctcaacttgagcttgaccttcaacattgtgctggcgatagagaggaagggggagatacatgtgtgccaacattgccttatccaaccatctttgatagtttgaagaagccgatggcaatgatgagtagggtgacacctttagtaccagtgaggccaagcgtcaacatggtgaggaggctcgtcagaggaagctcgctgaaaggaggagaaagggggccgctgaaggaaggctgctaacctaagttttattttctctattggaggaaacttgccggagagagaaggagggggctcactagaggtaggctatcaccgtcatgttgccggaggaaggtcgctggctcgcgtcttgttttcttaccatgtcacattgtaagttcaagtgtcttaatttggtttcggtgattaataacaaatctaattatatgagactaacgtttttatgagcctttctttgactagtcttatttggatatggaagtaaaaatgatgagaggtatgtattaaacttcacatattctaacttggcctctcttgtggatccaaaatatagtgtgagcttcctatttaatctttgttgattatgtgcatatgcgttccttcatatccatatgtatgcacatcttgagggggagcttattctatattttgtttattataagatttctatcttgatttgaaatcatttttcatctcctctctctatattgtttatatcgggttattatccatcaccaaagagagaaaagattgaaagatcttggattaaacaatttgtgtaattgttactttggtgatagatgataaaccgatgtttatgggattaacctctcttttgcataagttgtctactaggttatttccgataatgagatgtggaagacatgcattcttttgtgatggaccttaatcatgacaaggatgaaatgcatggagataaaacgatatgtaccactttttatctcctactttttgataggttcatatatatgatttccatgttattgatatataagtgtgagactaatgtttactcgaatgttatcttatttagtctcatttacattgagaacatggagatcatgaaggtatatgttttatgttgctctacatcattactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagattgcatacgagtatatgacacttgtgatgttaatgaatactcaacaaacatatccatatctttcatatgcaaccggttggtcatcaagtgaaggatgacaaccgatttgttgagactaatattctcctttgaggtgtgaaaaggaataggtcccactacgatgaggctaatgaatgacaccatgggttagtggtcaccaagccaaggacatcgtcatgttggcaagaatgaagtcaaacttgtgatgagaataaagtattgacaaaggatagacaagacctcggcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagtccggatttactagataggcgctgtactatcaagaggggtctatgaagcgagcttgtggatgatcttgtgccatattagttcatatgcatgcaggtgcattttgtgggcttgtctaaccaagtgtgatgagttttctcaagtcctaaaccaagagagaagtgggcatgtccaataggagtgagtgacatcttgtgggtatgtccggtggatatcctttggagtgtgagccctttatccttgacttaagttgtgtttcttggatggatttttcatgggttggatggccctttgaataagctttccatagagtccaagaacgccaaattccgagacccgagtcaagagatatcgccgttttactaacggtaggttgagctgaaaagtgacatgcggtctgaccgtgggccttaggccagtctgaccgggtctgttagccggtctgaccggcgtggcaaggccggtctgaccggccccattggtctgttgcactggtctggtttttggtggcgatacagagccgccagagccgcaaccggtcagaccgagcagacggcggtctgaccgagccgtggacggtctgaccggccactacactgcggtcagaccggccaggttgagtgggctcaatgattgccctgtaacggctagttttctagccgttacaaagttgtccggtctgaccggcctcacaacggcggtctcaccggtagagcacaaagttggggatttcggttccaacggctagttttggtggttgggggtatatatacccactccccagcagcaagagtaaggttttggcactccattgcattatcttgaacccttgcaagagctctcacacccttgtgcacttagtttatctagtgaggtgttatagagtgagttaagtcaatgctgaaaaagaaactacgttgaaaatatctcaaaatcaatctcaaaattaagtttgaaaatttaaaatttagctttttctttaacttattaggacatccgatgggagtctttttaaaggatagacttttaaatcgctaaagatatacatattttatttttaaggattgacttttgagccgttttggcttatgaacctatggcgaaattttgcgtcatgtctcgctcaaatgcaaagctcaaagggaccaaatactccaaagcaggaagaggcggggaaaggaaaaaaaaaaagaaaagagaaaagaagagagaaggaaaaacaagcgggccgagttgtgagtgactgcggtgcagatttttttcgccagcaaggccgagttcttcgctgaacccccaaaatctcacaacccacctcccctccgcctctcccatctacccaccggcgggcggcggcggcgacatggagggtggcggcgaggagttcgcgatcggggtgctgatctccgtgaagaccaccctcggcgaggagttcgaaggccagatcgtctccttcgaccgcccgaccaacctcctcgtcattcatatcctttccaaatccctccccatccggttctcccccccccccccccccatctcagtgctctgccactttcgctccccgtgttgttcgtgctttttgcggttgtttttgtttccatgacggggtagatcacaggaaggcgtggggagggcagagagaggtgagcggaggaacgtgcgggtgctcaaggcgaactacatccgggagttctccgttgtaggcaaggccgacgacccgctcgacccggccggctgcgtgctcgacctcgccgccatccacgcccgggaggaggccgctctcaggtgcgtcacactcccatctcgaccctgttctaccactgtgtgctccctatcagatgtgtttctcaggctgaagctggagtaattagattgatcatacaattcttgatgacatgtgttacatggcatatttttccagatactaattactgcaaatgtgaaattcagttttttttcctgtgataatcatcgagcgacttatgtcatagctgtcgcaacagtggacctgacctttctagttggtaaaagtgatatactccgtgttatgtggatatccagtcagaataagtgatagcaagtgaacaaggacacataggtgcttgaaaacaggaggggagatagaagaaaggccatgctatctagaacagaatcacactgtttaaactgttatgaagttcttggtcgttcatcaaaatattaagagtcgaaattgaatctgtcaacaagcagccccctccccaccccccaaaagaaaacctgtcttggttcacagattataatagcttagattttgtatttgagttggagatttatagtttgttgccttctggctttccatcaagaactgtagctactctggtcattggacaatgaagcgaaagacatgtgtgcaatgcaatttaaaattccgggatatgggctattagggctattatggatttcaagagagcattgaagactgtaaaacttggtttgacagtgtgtactttcgcttcttcaagactgtagtgcaccctgtagaattacagacatgcaatattgcaacagccaacctgttaaattgcttatgtatcagctctgagctcatgctattaacttattttagaaaccaggtttcaaaactggcttgtcatggtttggtttcttcaagcataaactgtaatctaaatgttttcttttgcttctacgcttttatgaattgttagggattaaatatgattttttataggaattaagtatacctttttcaagtttaaaatttatgatatattttaaatattttttgcacttggtatttggctagtgaactcagaaaaatgtttgctttatctactaaaaagataatttcgagatcttctgctgtttacttataataggtgatttttgcatcgacactgaatgttaagttactattttgggggtatttatgttttgatggaagcacagtacatggggatattatagtttgttggctggttagtg

SEQ ID NO: 78225 - DNA, 961 bp, Oryza sativa
ggccagaacccccggacaggcaggcagaattgagcccctagcagcaggacaccagccctgtgctatgacatctcgactaccgggccgcagcccgtgtagccttcatttgtcctaaagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggggctactatcaaaaccatgcaccccaagcctagcctaaaaccattttgagagttttgaatagagggggaggtgtgcatccaattccacaataatccaaccattccaatatgtccaggtgatatgaatattcccaaagtctagagttataaaaccacctaatgttgcctaattaatcagcgaagcatctacctaaattcttgctagtggaaccatgaatagagtgcccactagttggggttttgtttattctagggtgaacaaggtaataataacaataacaacaataataaggtcataacaaaggtaaataggcatggctaaataaaacagtgataacgcgggaatttaaataaagcgataatgcaataatttaaatcaaagtaatttcacaaagtgggatccaatatgttcaaagaatgatgtgacttgcctttctcgctttcccaaacgtcggcttcaacctccacgaagagcggatcttccaaagctgcagcgtctacacgaccaacggaaaagaaaagggcttttactctaataaactccatataacaagcaggaacaaagcacaaaaatgggttcttgacttcttaaggaaaaattagagacttgaacggtccaattccgagttcaaatggccaagttatggccatttgaagtttatatgcactttaaatgaatatttacgaattt

SEQ ID NO: 78226 - DNA, 8370 bp, Oryza sativa
gctgcttccaggtgtggtagaatggtctcttcacgaattgatactttgttttgactgggttctgttaggtgattattgtcagcatttcgaaatttattttctgtttgttttggagaaaataaaacccatgtgagtttgacatgtcagttctgtttattattttccgatttgtcagatcttggttgtgccattgtacaatttgctcctgcttttagttaaagaatacaacacagtgatattttctgtacttaaggcaagcagacgctggcttcatgtttttcacagcaataaattttctttctttttgtttgattttattctgttagtgtcaaattgttttctgtcaatgtggcttactctaatttgttcgcaacaaattgcttttgacaaatcttgtaaagcttctctacatcatggaactatgttatatgttttgccagttttccacctgttgtcctcgcatgttgcattattagcacaactttttggtatatatgtgaaaatgtaatgaaacactgtttgttttaaacgtaaatttgtatgcatataacaagttatattcttctcaggcttccagttcagtgggacaagactgacattgttgtaatgaaggaggttcgtgtatgcaatccatacctgcctgaaaatgtcagtggaggaacatctgctgcaaatgaacgggttaagaaagtggtaatgcatcgatgcttgtgaaccatatttgtactaataatataaactactgcctctgtcccagaatataataagaagttttagagttagacacggttattaagaaagtaggtagaagtgagtggtggagggttgtgattggatgagtagtggaggtaggtgggaaaagtgaatagtggagggttgtgattggttgggaagagcatgttggtgaagttgttatattttgggacaaatcctaaggtctaaaagttgttatattttgggacggagggagtagtaaaatggctaatcattatgtatctcatcttttctttttggggtgtgtcttgcagcttgactttgaaaggaaaaggctacatgtgcgtgtacctggccaattctaacttattcggctgcttttcacctgaactccccctttgtactctactttaagggctgaatcatcaatagatttttctaaaatttgtttctgcaaaatccatgccataaactatctcatcagctagctaaatctgtatcctgttatagatatctcatcagctagctaaatctgtatcctgttatagatgtgcccttcgaataaattgtcatgctgatgttaattcagctgctggttgtaagagggctttgattgaggcaaacttagaaagtaaaatttgattgatggcattgaaagaaggtgagttatagataacaaaggaaagatggggagctacaatggaaaatgcttcattgaacttatgtattttgtgtgagatttgtaactccagtttttttttcttatacttcttggggaaacttatacttcatgggtaatcggggtaacctttttatttctgactgcagaattaatatagggagaatggaggcattttctagaccacaggaactgaaacttaaattgtccaatcctgtactatgctgtatctttaatttttttgttcaggttaagaagttgctcatctgttgtcgcgttcagtctgatttgtgatataatgcatagagaattgttgataccagtccactggcgtatatattctatacatgttctcacataattccttggtgtgactgaagaatgtgtttaccatggcaaaaataggctctcattcttatgctggatattctggagtcacacttgcatgggaatggatcttcgctgtcatactgtggaaacgttgttattatacctgatttgttttgctcaaacattgttgtaagaacgagttttttttctgacattaattgatttatacagcacatgagtattgctagccttttctgaacagagtatgaggcctggtttagttcctaaatttttttctccaaaaacatcacatcgaatctctagacacaaagcattaaatatagataaaaacgaaaattaattgcacagtttgcatagaaattacaagacgaatctttttagtataattagttcatgattaatcataagtgttacagtaatccacatgtgttaatgacggtttaattaggcttaaaagattagtcttgcggttttcagacgagttatgaaattaattttttcatttgtgtccagaaatttattttgatatccggtcatttgatgtgataatttttttttcttttcgcgatctaaacggggcctcaggtggtgtttagatccagggacttaactttagtccctgtctttagacactaatttagagtattaaatatagactacttagaaaactaattacataaataaaagctaattcacgagacaaattttttaagcctaattaatctataattagagaatgtttactgtagcatcacataggctaatcatggattaattaggctcattatattcgtctcgcaaattagtccaagattatggatgggttttattaatagtctacgtttaatatttataattaatcttcaaacatccgatgtgatagggacttaaaagtttaagtcccatctaaacagggcctcagtagatcgataagggaatatcaggctttatcacatgttgctgttgactagcagatcgggcctggccagctggaaagcccagctcgtcctatcattagcccagcaccacacggcataggtactgcatccactagtactggtgttttctttggaacaaatgttacactggacgttttgtctgcacgtaccggcgcagtactagtacggagtagtgcattaaattggctcgatgtgtttttactcctacccgcacggtggttttccatgcagggtaaaattagtcaactcataatcataaatgtggaaagtatagcgtgagagccattaatatgtgcatttatttctccaagtcccattcactttcatgtttgctgcagcatctgctctcgctcgcttctcttgtactcgttcgagggcgagagctccacatgccaatttgccagccagctgcctcattggtcgtctcaaacaaacaaatccccaggcttcacacgaattctcgcatggtcgagatctccatgcaatccaatctttctaatttaatgcggccgtgtggtacttaaacatgagtgcttctagttctagaatgccatctgatctgataataaatttattggagttagttggatcccttgatcacgcacggtcaggtgccccctaccaaaactacacttttgcttaatgcttatggtaggcgacgactactccggcggccaagagcccaagaagccaagagtacaagaatgatgccctctttgattcaaataaaattcataagaattttaaaggatttcatttctataggaatttttcctacaaagccttttgaatcaaaggaataaaccctatgtaatcctatgaaattcctatggaatgtctcttcctatataagttttggaggaattttaacgagaggtagatcctttgagtctttatctctcattaaattcctatgttttttctgtggtccaatcaaacgatcattcctacgtttttcctgtgttttgcaatactctgttttacacttacattactatcagaatcctatgttttttctattcctccgttttttcattcctgtgattcaccattgcgaatttcacgtacgatctgtatgttctgtgaacccgtgactaatcattctcaccgaaaaatggcgaaataaccaagtcccggcgaaaaaaagcaaagcactgtagcggtgagagaaaacaaccaagtaacacaatgatagggaatagtacggcgacgcaactttgcgtacaggtcgaaagcatacttgcctcctcttttcacctctcttcccttggaacgagacacgggaaagcgcgaaaaaaaaaaagagtatactcatccattttccattctcgctcctctgccctaccccaatgccccatactactatgccacaataattcactcacaataatactaatgctagtactactcacatggagtagccacatttctctcctatagcctgattgaagaagcttaagcaactgattagtagccgctccgagaatctgaaaaagcttcgtttcttagtttttggcttgtgatttgttttctgattttataattatagcttttcagaatgtaaaaaaattaaactgtttaagaatgctttcgatcctgagataagctgtaccagctaaaacttccgaaacatgcctcttagtctcccctcctgtcccaacggaaaagaaggtactacctccgttaaaaaaaaaaaacaaaccctggtttccgtgtccaacgttgaccatccgttttatttgaaaaaattataaaaaaattaaaaagacaagtcacgcataaaatattaatcatgttttatcatctaacaacaatgaaaatacaaattataaaaaaattttaaagttggatacagaaaactagggtttggcttttttttactcacttctttaggtacggagagagtactgctaaagagagacgagagtcccactcatctcttcactgtgagaaccactgtgctacgccatcgtactcgtaggagtgatctgcaataagaaatctttttcttcacgcacaatccatgaccaactcgtcctttccctactgcccaaactcaaaacccacaaatgcacagcaaaccatgctgcgcaaaacggcaccgtaccaaaaagctcaggcgaatcaaatccacaccacaacccccctgaatcaaatgtgaattatcccaaccttccctttacccgcaaaatttgacgcgctgagagagagagagagagatgagactggggagattcgcacggctcgaacacgcacacacgcaaaacaacacgggcataaatgcggttttggagcgctgcggggtgtgcgtgaactgtcctcccacaaggcgaagagagaagggggaaaaaaaagagagaagaaaaacgatgcgtggtgtggtgcggtggtgggggtgagaagagaacaaaacaaccgctccctgctgcgcccctcctgccacccgctgcggcaagcgcttttttgaccgcttctgccgtctccctcctcacacggcacccggctcgcgtctctcctcccccctactactctgatccaccgggtagtactagacgcgctactactgccgctgtactgctctgccaccacttctccactccactccactctcctctactaccaccgccgctctcgtctcgtctcgtctcgactcgactcgcattgcgcctgtgctgtgctgtggtggtggccgcgcggggggcgagatggccggaggaggtgggggagggggaggggcggcgccggcgccgaagcacgacgagctgacgccgcaccccgtcaaggaccagctccccggcgtctcctactgcatcaccagccctcctccgtggcgtgagaaccaaaccccctccctacccaattttttctccgcacgcttcccccccccgctcttgtcggggtttatcgttcgctctctgtttccggttggtcgatcgcgatagcgatggttctccgcttcctcgcgtcgttttcgcgaggctcctgcttcctcgcgtcggtggtggtggtttgcgtgcttgcgtttactactacgcgggggtgcttcgttgctgcgcttgagttgttgctgttgttgtttttgcgagggagtggatagatctgctcgagctttcctcattaggaacttgatacgctttcttaaaagcgatttgccttttcgttttgttctcccggctatttaataacacctcgcattagtttatttagtgatgctgaaaaggtttgactcgtttgattctagtcgcgggtaccaaccatgaacggatcaacccaccagatgggacctagaattgttggaaagcgttgtaggaaccggggttttggtgccagtttgatgctcattcttcagactgattccgattctctcgatcatgtttcgctgttgcctcgatttatatcaatgtcagcgtgatggagacttgtgtggatggaatattcaagaatccagtaatactatggaattttgttgggtaatttcagttctattaaattttgctttgacttgctccagtgttttcacatgcaccgtgctctttttttgttaagtactagtatacatattgttgctatccatagttggcgtgttatatgtagtggaattcgcatgtactttcttgatagttactagttccagacgatactgtccatatcgaaaaatcgttgtcgctttgagttccattcgttctcatgtttttttaacagagattttatctctttgtgcatgatttcacgtatttattagataagtccctgtcacgtttttttttgaatttgtattcccaaggcatgatgcatgaacttgaacgaacaacactcgcaagagttctaaaggatgaaactcatctgcactgtatgatgtaatcgttagttttgatattttttgatctttcttcaaaattggcttattgtcttcttatattacgttactttttctttttcgaaactacatacgttacggttaactacagcatttttatatgttgccaagtatggcttcttcctctatctgctatcccactataaaagttgtttgttatacatttccaccttatgctgtttataacatttgtatggttttagttagaaacttggttctgaagtattttgttgtatgcaattttttaaaatgcagctgaggccattcttcttggtttccaacattatctggttatgctgggaactacagttatcataccaactgcactcgttccgcagatgggaggaaacaatgtgagattacacatttacctgtttgtgtttcttttgacttgagccatcaatcaagactaacagtatttcttactgtgttaggaggacaaggctgttgttatccaaacattgctgtttgtggctgggattaacacccttttgcagagtttctttggaaccagattacctgcggtgattggtggatcatacacatttgttgtaccaaccatctcaatcatccttgctggtcgttatgccaacgaaccaaatccacacacagtatgttaaaaatcagtagctacttactttcagatattgtttttgtgtttcttgacctgatggatcacctatttttatgtgaagaaattcctccgaatcatgcgtggaacacaaggtgcattgatcgtggcttctgctctacaaatcatatttggtttcagtggcctttggcgtaatgttgcaaggtactgaggtgaaccattggtaattggcattgttttttctcttaatcaagtagctgcttcagaggtactcaagcaagaaatgatcttgcagaaaaaaatatcttgttttcagtctcattactatgtactggatttctttcaggtatctgagtccattgtcagctgctccactggtgatgctagtcggctttggactttatgagcttggttttccctcggtaaagtattgtgtttccactcaagactccatatttgtttaaaatattgtattgctcatcttagactaactgctcaggttgccaagtgtgttgagattggtcttccagaacttatcctcctggtgatcttcgcaatggtacgcatttatttccatcatgtagttgtcaccttcttcacctagcatcgctgtgctccaactttcctttttcctttttattgtttcatttttgcagtacctgcctcatgctatacacatgatgaagtctatcttcgaccgttttgctgttctgttcactattcctatagtgtggctctatgcatatctgctcacagttggaggcgcgtacaggaatgcaccaccaaagacccagtttcattgccgaactgaccgttctggaataattggtggtgctccttggtaatatttttgaaaaatatgactgttccattggtgccactctcgttgtaaaagtaacatgaccgcttcctatcttctgtacaactacaatgacaggataagagttccctatccctttcaatggggtgctccaacttttgatgctggtgaagcttttgcaatgatggctgcttcatttgttgctctggtggaggtatggccccatgctcttgggaaaatcaaataatacttcagcacttcatttcaatctgaggattctgaagtaatgagttatgaactcctgaactattatttttgtagtctactggtgctttcattgctgtttcaaggtatgctagtgccacacctctcccaccc

SEQ ID NO: 78227 - DNA, 1298 bp, Oryza sativa
  unsure (1)..(1298): unsure at all n locations
ctgttgcagatttgtcatggcctgttgttcttttgataccctccgatagtcaaatgcgtgatgcatcggaatgtctttttatcgtttgatggatgggaagtatnctacctnnncgtttgctgtgtatcttnngcccactgatnncagaacgagagagattttcgcggaaacgaaacaagatagaattggagtttgataaagaaatggtacttcccatgtgaaatcatgtggactgcccttgtcagtttatcgcgccaaatctttgtgccatacgaccatatcacacatggactactagtacttcacaaatatgcaaagatcttcagctgagccgcctccatctgatagcaatagcctaaaacgatcgccttcagcgaaggaagaaatttcgtcatgttactcccagaattttgcgttcccgtctttctgacgcacgcaaccaaggaggaaaccggcaaatctacaggaaacaacaagcagatgggggctaaccgagagaggatgatgcagcgatgctaatcgatcggccatttggggtgtggtcacggctcacgacagtcgttggaccaccaacacccacggcgatcattgctttgcttccgtccaccgttcgacagctaggaggcgttctcacggccctgaaacctgacaaaaccgccgccccagatggtgccaacgccgatcggcactgcacggacacgggctcggcagtcggcaccaccactgacacaaacgcaccaccatcaagcagaaaaggcgatgatgatgagggtcacagcctcacagtcacagggtttattagcactgatgaacagataaatgacacttggtgccagtactgaattactattgctagtgaggaggatacagattaataatggtattctctccatctcaaaataaacaaacaaaatataatctatctgtattcgtgatgttatgatatgtgatattcaatactagtaagtttaatttttacactacaagtttgcccagttgcgaacgtatggtccctggtcgagctactgcaatttatttttctggcatggttttgggcctctagtccaagattagttcagtcaaagaaatggaaaatttataacagataggagtatatacaagccttgtctgaataaatgtatggctcaggtgcatgtgctgtaaatgtgcacgcattattgccgaaatgattcgagtgggcctggccttcgttggcccatgcatttgccgcaatcgcattatcaattgcatcgcagagccaacaacacgatcgccaaatctcccacttgcgctccatg

SEQ ID NO: 78228 - DNA, 645 bp, Oryza sativa
ggaaattgattataaaactctttagcatttagttgtttcaccttccactccccatttagcccaacaaatagatgcttcagctctgcaaccacttttcccacagaagcttcaggaagaatcacagttagtatacctttcacagggagctctagccaactctatatcagaaatctcaacttgcaagctgtaaaaaccttgccagggaacccaaacccacacagcttaatacccttctttcccaaaagcaatggacagtgagaagagatatggccagtattgtgacaggagtagtagaggtgagggttagggcacgttgcctgatggtgaccttcacgcccacactcgaagcattttatcctcacctcgatccgccgctctcgcaccacgatctgcctcgccaccttgacgcccttgagatcttgcacctagattccccgttggattttgagcgagaagttggcgtcgaagctcatcctcttcgcgcgcatcacggttcccctaatctccacctctaatcggatccgtcacccttcgcttgttgacttgccactccggccgaatttggagggcgcttgtccatcaccacctctgtgtatgaacgatggtcgcgcttgcgctctggaactctcagatacggcgagcacc

SEQ ID NO: 78229 - DNA, 2470 bp, Oryza sativa
cagcatcacaggaaacaaacatacactatgctgcctctgttgcaagatcgcaacttgcaaaggaagatgtccctgcgtaacatgccatcaccatgtcgtacacatgggcatagcaaaccccaataccccatcctatgtttcctgaatcctgactggtgcagtcagctctcggatatgtcactgacgacggtggccaactcggtttttggcccacctgtcagtcaactggtcgatgtgtgacgcatgcaaaacggcagcagcagcagtagcttccgtcccttaaaaaaacaaacagtagtagatgtgacacattctagtactacgaagctaaacatatatgcttggagtgtactccctccgttccaaaaaaacaaaccctggtttttcgtgtccaacgtttgatcgtacgtcttatttaaaaaaaatataaaaaaattaaaaagataagtcacgcataaaatattaatcatgttttatcatctaacaacaataaaaatactaattataaaaagatttcatataagacagacaatcaaacattggacacggaaattcagggtttgtttttttaagaacggagggagtatgtaattaatgggtggcaatttagtcttttattgatggtcctcgacactccatgttagtattattttttttctttttaagtgtggttttgtatgttcagctgtatgtatcttagttatgtagaggttagaggtgttctcaggataactgtatcactttgatgtaattgactaagtttaataaaagcttttattatttaaaaatataatcgagtatatcttaaattcatagtataagaatatgttacattctgttctagaatttttttttcttgacaggaggagtacggaggaagacggcatgggcctgagggtgtgcgagaaggcagcctctcgcacaaagcagagcacatggcctcattaaattcatcagcacttgggtcgtcgaaacagccctgtgggattacgtgacactcgatcttgacatcacgccgcaagatactgacgtttaacttgccttgataactgcgttgccgttgttgagtgttgaccctcaccatgtaatcaggatgaagatcagcgcaaaaatggagtggccctaattgactaaacatcgtgagatcgatgcttatcggttcccctggcccatgacacctataatctcattcggaacttcatattttgatagactgtaaacacctcagctaaactctgtttttaaaacaggcctgttcgcttattctctccctcttccatgagaagcatttaggatacaattaaaatactaaattggactagcttgttttcaggatgttgctggttggacggtaaccagaagacattgtcgtcgcaaatcataaggtagtctattccattatcagcaaaccgcagagtgcagaaccaaaaaaaaaaatactgaagaccaagccatgatcacagaactgtgatagaagcagtattttgggccatgatatgtgccatccatcatggaacttctctgtgacgtttgtaaacaaaattaacgaaggagcctcgaagacgtcatggaactagactgcattttgcatcgcatattatactagtacatattgtaagtttgtaacattttggtgcccgatgtaaatggcaaagcctttccctttttaattaattcttccatagctagttaggtagtggtcgccaattgacatgtggaccagaatatttggctaccggaccagagctgacttcacttaatccatgcatgtgttcgtgttgctcctgagctaattctagtagcatctttcagaggactaaaaatccagttacgtgaaagaaaagattgtgtggccggctctatctttggcatgcattagatgtatacaaaaacaaaaaaaacggaagattctcttacagatgaatacgcccaaagttctctactagtggcactgctagaatacaacgttttggcacaagtttggcagctcttcgcaacttcaccaatacaaaacttcacaattgttcgccaaatccttagccccgttaccagcatgggttgagttagctacaccagtgaatcgatccaaacgtacgtacataggacagcgacccccactcaaaattctcaatgcaaaaaacggtagaaaaagaaaaggaaacggaagcaagccgcacgggtgaagctagcccgaaagggcatagtagtagtagtagtaggctgatggctcggtcggtttggcttggcttttcatggtccaaaccgcacgacgaacccgcgaaagcgaccggcgccgatggccgatgcgacacgcacgggtgtgttcccatctccgcactgtgcaccacactgttcgtttacgcggccacaacgtcagaaaggcagagcttcccgttccggacgagtacaaacaaccgtcccggaacatgtacgtgccaacccccgcgttcacgtgcgcgtcgcttcacgg

SEQ ID NO: 78230 - DNA, 6150 bp, Oryza sativa
ccccccccccccccccccccccgcgcgccgtgcccgggcgggttggcctcctgctcgtaatccgcaccgcgacacgctcgctcgctcgcgttagctgctcgtagcctcgtagctctgcccatgcgctgcctgttacgtactccctccttcaaaaaaaaaaaaaaaaaacctgttttctgtgtctaacgtttgaccgtccttcttattttaaaaaattataaaaaaataaaaagataagtcacacataaaatagtaatcatgttttatcatctaacaacaatgaaaatacgaataataaaaaaaattcatataagacggacagtcaaaattgaacacggaaacttagggtttgccttttttaaaacggagggagtagggataaaaacgtattggaaatttttcggttatcaaacttgtttttgaaaaaaaaagggaaaatgttcgttgttgagttgttatcatattcaataatatgaggttttctatttctattccagttaagaaaagtatgaaaataaaaataaaaacattagaattattttcgtctgttttttaaccattttgaccccaggtaggtggtgggttgccgctactctgtgatgcacttgatggtgcagaagtaagagttgtgtgatttcaacttcgagatcccgtgtttaatttctaacacataatttctttaaattgtttggagggacctcccctctttaaatctcttttttttttctgccgcgactcgcaggtcacgaccacatataggagcaggcggcgcgtttgagcggtaggtgcgccgaagacagcagcgggggaggaggtggatacatacaggatacgtgttggtcaagtccactctccatatataccactacaccacctcgtcgctcgggcagttgctgctgcagcgctgctcactgtgccgtgtccacctcgcgcgcgcctccctcccgttcccgtatagcggtgggggctcggctagctaaccgtgtgtgatcgagcgttgcgggggggagaggatggggaattgccaggcggcggaggcggcggcggtggtgatccagcacccgggcgggcgcgtggagcggctgtgctggtcgaccagcgccgcggaggtgatgcgcgccaacccggggcactacatcgcgctcgtcacgctccgcgtcgccgaggagcgccaggacggcgacggcggcgcgcgccgcaccgtgcgcctcacccgcgtcaagctcctcaagcccaaggagaccctcctcctcggccacgcctaccgcctcatcaccacccacggtatgcgtatacatcactcactcgccctttaatctccttcttccttcgcttcggttaattcttcgtgcgactaaaccgaatgcgtttgttgtgatttttgttgcagaggtgaccaaggcggtgcaggcgaggaaggaggagaaggtgaggaaggcgcagcagcagctggaggagtcgaggcagaagctgcagagcaaggcacgcgccgccgcttcggcggcggcggaggtggatgaggccgcggaggagaacgacaacgacagcgacaacttcgacgacgaggcggcgttggatgcgagtcttgatcaggtgggtttacatggatcagagtggtagtaacctgtcctgctttaatccaaccactttttgttcgatgctcccatgcacgtccgtggcatgattgatacatgctcctactacttctttaaggctgtgttcgcattcaccttttcccatccccttcccctcgttttccgcgtgcacgtttttcaaactgctaaacggtgtattttttataaaaagtttctatacaaaagttgcttaaaaaaatcaaattaatccctttttaaaaaaaatagctaatacttaattaatcacgtgttaatggactgctccgttttccgtgcgcagaagttgggttcccatctcccccatccgaactcagcctaaattgtctctctcagatgctgtcgttagttgttcctcgcgatcaccgtgtccttccatgattctctatctccttttaacttctgtctatctgactttatcatccaaaagaagtgttctttttttttggttttgggatttccatttaagatttttgcaaccgctgaatctccctagtaatcacggaaatcaagagtcctcgtcttaatgagcccagttgagaatacagtactacctattcccaacctccaagtgacatgcattcaataagattataaggttgtggccctatggggccaactggttttaatagttggtttctctaaatttagtgagtggagtagcaactagtgtcaggtttccaggaccatattgcgagattccttaccacttctgagaccgcggcaacatgcaaaggttccatcttttctgattactctactgtttacccacctgattgcagttggcgcgtcaggacagcaaccggagctccagcgcgcggcaccggcaatggcggccttcgctgcacagcatcgacgaaacgacggggagctgatgccctgccaatggcgtcaagcatagaacacgatcatacgatggttaatcgtcgagcggtgaatctgtatttttcggtgtttcacccggccttgattagctttgcaaaggttggcgcgtttgcacactgtgaagttgagtttgacacctcaggatgacagggctgctcgggaaactctggccctgatgaatccgtgtaaattttcaggctttgatggggccttgttgtgaggttgctcgttttttctttcttgatacatttgcacctggaatcagaacaatgttgctccagaaaaaaagagaaaaaaaaagccagaaaaactctgtacttgatgctctcctacaaatgggaatcgagcgcatttcatgatcatagttttttaaggatgttaatctgtttatacaagtataattcttgatgccaaatttcgcaatcataagctcagtgcccagtgacagatgccgagatgcacctgcagatggtggaatcagcatcatcagagcattcggaggttggaaactcatcatgctgattcgcgtcggcgattgcctattgggatatcaaacatttgtttaagctgttcctgatgtcctaacaggacaagtggtaaatgtctcaaatcaagatgcccacaagccaaggccaacattacctaccactctaccaggctgagttatgcattgacgcagtagaccagttgtttgttttcacatgcatgcctcagaagaacacatgagctgacagtctcactgtcccactgtatattaacggcaagccacttgttagcgtaggatataggtagtcttctggctctctgctagcaacagctcgcagaaattaaatactgtcagctactaaccacttgttaatgcagctaattagccccaacttctagagcgagtgagtgcctgatggctggtgcttaccagttaccagccaccacaggacatcccagccattgcacgctgcggcccctcgccggctcagtgcctctactttaatttgcagtgttgctcctgcagtaacactgtacaaaagcaccaaaatgtatctcctcggcacttcatcctccaggattcaattcggccgcggaacaaaaatgatggatgacgaaacatgaacgactggtactatttggcatgtttccttcatcttatcatcttggtatggacgtcccaggccaggcttcagggcccttgtgctggtggacatggcaaaagcttgcccggcacgtgcagtccctgacatcagatgagcggcacttttgattttcagttaaagccacggaacaaacatcaaccgtagctcgagaatcagaggaatttggatgatccttatccatggaatttggatggcatcacggcacatctgcagtgtacctgggccctgtttagaagattagcccagagctaattttgagagctagtacttagtcatgaattggtaggctaaacattagcctagggtggtacgtttggatccataggctaattcaaggctaaaaggtggagaaatagtagaaagagaggagagagaaggagatagagctgccttttgatggtcaccacacaaaattagccccattagcaccccttgaaggggctaatgttttaaggggggctaattcacattagctcaaaattagcccacctgtttgtattcttgagagctaatttgaggctaaaaggtgaggggtaaacattagcccatgaaatcaaacaggggcattcacctgtactgaatcctgcatcctgcaatgcaaaagcttttagggcttattcgtttctaaggaaaaccaaaggatttccaaaacagaggatttgaatcctgtatacagcattcggtttacaggattgagctataggaaatttgaaggaaaatttccttttgtgccagctgtatcggtaaaacataggattttttgcatctagtacgacctcttggaaattttcctggcgcgaaaagagcgcgccacgagcgcaccgcgcgcgtaatcttttcgctctcacgacaaaaaaggtaggtaccggcgctgaaaggaaaataaaaaaaaatcacagggggcaaacagactcgcatagaagccatcgcctttgatcccatctcctctaccacttcctctcctggctccatgattgggtactggacctcctctcccacatcgatcgccggcaccggatgcaccttcgccgcccaggtgacaggacgcaacggcaacaacgagaagagccacggcagagatcggcaaggacgcgttgattgcaggtttggtgcctcctcttgcgttgttatgcgtagatctgatgccccctgctgcttccttgcatataccttagcatttgggtcgccgcgaatggggtcgcagctgtaacacacaagggttcatagcgcctgcccaatggcaatcttgtttggttcagagaagttgttgccggcgggcggcggcgatgagcagcaacaagtagtatttgcataaccagcatctacgagataaaatttaccaccaggaacttgaaaaccatgattaagtgcattatgtaaaactcttgcatctgaagctgatccctcccatccaggatgtatatgcacaaacttcaaatcaaaatcacaagcaaccatacaattctgagagattgtttgcttcctatttctatatggctcttgctcatccaatggaagtttcatagggatatgagtaccatctatagcaccaatacaattctacacagaaacaagacatgtcaaagttatttttgtccagttcatgaaaaattaggatattcaaaatatgaaatcagaacaacttaacaagtggccatgcctgaaaaaaggggtaaaattgtggtttcctcaagattggatgtgggtgtagggatggtgcacgaatgtagacagatgtgagatttgtgattgcttccagcactgctttgaaatatctatgtattgtatctggactatgctgaaaccaatcttgaagtgtttcattggttgcattttttgccactgtatataagaatatagcaatatgctcttctactgaaacatatagtgccagttaggtactctttctcacgtaacttattgactagtgcatgaaaaatgtcgacctccatacggaagtttcttttgcataatctttcatgtcctgttaaaatctcatgtacacggcaaccccctgtaagttttgacgtgtgcattggtctcctaatacaagatgattgtgatgaatctcctaaagtaggcagaacaaaatgaatgaactcatcatcactttctgatatacgtcggtagcttggattcatggtgtgcagatgttaccaaactgatgctgtaaactcaaatagaagagagctaaaaatcaagacttttgctgaggaaaaaacaattttggtgcaccagatgaacaagtagtaccttgttgttacacgagcaagtaacgtccagctatggtggctagacgatgagtaaagcttctggaaaaattatgcagatagtgaagagaagagcaaaggatcagcaagcttcttccacagttgatgagcaaatagaaagaacaggggaaaatggtgcacaaggctaacgagggctatttatgcacttcaaagctaacggctagttgagggccgatgtcagttgatgcaaac

SEQ ID NO: 78231 - DNA, 2422 bp, Oryza sativa
cttctcctgcggtatatccgaatgcacactttttttaaattcctgacgtttagcttcccataggattggactccacagctatccctattccttcatttttcctaatcctatgagtgaaaaaatcctttaaaacgagtaagcccttactgtgacgatcagtatttatcgggaacggggtctttccttttcttttggaggctttaacttcttccagcattttgaccgttccgtaccaactaccaagtgagcttctgatggttttgtctaagaaaaccatgatttggcgatggcagcctttattgaaagacataccaagcgctgggtggtcacatctcagggcttgtttggtagaactctaacttataaatttagcttcaagagttgggtctggagtgaagttgtggagctgtctaaacccagctttacctttctagttcattttatgagagaacactagctccgctcccatttcaggtggagctgaaacggtttggttgagctccagctccgggagaggtggagttggagctggagctgtgacaaacaggccctcagttcctagatttgcattgacgctccaacgggaatattcgtgcacaagtaatcgagttttgtatatttaccgacgaatggaatacgcatatttttttttctttacttgaactcccgtgcagtgcactggagatgacatcattagagcatcaccaagagattacatataacctctaaaaatttgtttttttttcataaactcaaaataggaaacaaaataagtaatatcttaaagaaaaacctaaattttattaaaaaaaatataaaagtgagaccttattaaactaccaaaagaatttccattttacttcgtcagcgcacactatctcctggcgctcccctgaagccgcgccaggagaggaggaaggtgggagcagctagattggaagtgggcaaggaagccgctttctcccgtatatcaacagagcaaatatttcgggaaagagaactccaaaaatcatgcaactgagtaagggactcgtttgagtgctttctttcactaaaatccctcaaaattgattttgagatgaaatagggataaaatagaaggactgttggtgatgcttatttattctcctgttttatagggttttaacgaattgagatcaaatacagtagctattaggactgcacacaatctgagccctctatgtctaaatctaacggccaaaaaggatttggcacagtacaattagaacagtacccttccacagtaaaatgctacagtgttttctacagtctcagatgtatctcggacgtccatttttaatcatgcgatgctagtgtgactgcttatcttgcatcacactagctactgcacctgaatcgggtccggtttaaacatgtgaaactcggaaacggctttttagacgaagacagcccacaaactcataggcctacacgccacagcccgagaaacagaagcccagcaatccggcccaaacaagtcactcagcagtcagcaggtctcacaggcccaccagatagtccatgggccttgggccgagcctatccgaccgccttcacgcgtccttccttccgacctatatttctgcctcgccctcctctcgccccttccccttcgcgtttgcgtttcctccgcctcctcactccaattccattcgccttccgccaccaccacccttggctcctcccctccccgcggggcgcgcgacaaaccctagaaccttctagaggctagagcggtagagccatccgcgagggccccgggcgggctaggggcgccgcctacccgaccccgcacgcggcggcgatgccgctcttcatgtcggaggaggagctgcggctcttgggcggtgacgtggccgccgtcgccgagcgggccgacgccgccatccgcgagctccggcagcaggtggacaccgtccgtgccgaggccgacgcggcggccatcgcggcggagcagacgtgcgccctcctcgagcagcgctacgacactctctccgccgaggccgatcgcttccgggccgagctagccgagctcgcggctgcctccgagcgccgcgccgccgatctcgcctcttcccagtccgagatacaccagctccgcatccaagccgtacgaaccctagtttttatttgggttcagctcagtttttcggcttagctgaggtcacactgatcactctgtgctgctgatggggtttgcagattgcgaaggatggcgagattgaacggctgaaagtagaaatctcggaggtgcacaagtccaagtcgcagtcactggaactaattgagcagagggatgcagagataagggagaaggatggcatcatccagaactacctcgataaaatagtaagccatcctgaccattttgtactcccacttctagtgatgcacagcatcc

SEQ ID NO: 78232 - DNA, 568 bp, Oryza sativa
tttctgcttttgggatgtattccggaccgctcggtccgatgatttaagactacgcctgcgggcttatgttgtaataatttgcactagactctcgtgtatgtgcgtttggtatctcggctatgaactcgtgtgtaccagactacttgatccaaggaaatggtactgtttacacgattgattcctgttataaaaacgggggtctacagagctggtatcagagccatacgactgtaggaaaagaccaaaaggcgccccacccccttttctaagttggccaagggagaaattcccatttagtaatactttcaaaaataaaaatgctatgttcacaaaactctatacgattttcatcttactcttaactattttcttcacaaaacaagttttactctcagctgactttgggtttttcttaaacttagatggcagatcaggattcacccgctacctgggatgatgggcgtaccccgctcagagggatacgtcattgagctgcatcggttgatgaggcgtctacggtaccccagatttccgatctaccgagtgagacagtgtggatccgtttggg

SEQ ID NO: 78233 - DNA, 754 bp, Oryza sativa
agcgggcaacgggcagtcccctctcgtgcctaggtgaatccggaaacgacagaggccgtcgcagggcccgccccgctccatcacgcccacctttgcctggatgcgtcgactagatgagagctacactacaagcccagccgttgcccacgctggcttgtggtaagtacgataagttctttcgggcatcccgcgaaccggtccttaactgccatgggtgcgaccagcaaaaccatgcacccacagcccaccatgtgatttattttaattaaccaacaccaaagcggtggcactaatccaacaaaaccattagaaccaacagtctaaacattaataggattttccccattgtgaactagttgaactaagcatggctaagcaattcctagtccaaactctaatcatgttgtaaccccaagctaacaaaggagcatggtatccaaaaagcatagctgtaacaataggtaaccatcccatagtaatattataaaacaatgcaatatttgaaagaaaacaatagagcatttgcaatataggatcaacatgttcaagtgacaagcatgacttgccttgctctgctgctggaggaacctcggcgactatttcgaagtacaccggagcgtcggaggagtggaatctagcgacatacaaagcaaacaatgcaaacaggctataagactactgaaacagggaacaaaaccatttttaatggattctacacattactcttgatttactgagacttgaatgggcttaa

SEQ ID NO: 78234 - DNA, 2075 bp, Oryza sativa
aagttttcctatagagatccttgcctaagggcaaaggggcacctcgacagcgtcgccagaaaggttaccacgctcgaaagtatgaccgtgcccattgctggtctagtgaacactgggctaggctttcgtctgggaccctcttcatccctactgttatggttcgtcgtccccaactccgatactactcgtcaaggcttgcagctaggtatggtctctcgcgctcgcgcccacccgcccctcgtgatgctgccgttcagcgcgtgctcgatgccctactcagcttagctgcagtgtgatgtacgcactcgtatccggctctgtggactgtccttgcttgcacagcgtcttcgatgagttcgatcgatcgatctccagctgctgataattttgcacattcggcgccgttggtttcaacgtgttgtttacagtgaaattcctatgagaaatttgctgcttcccgaggctgattgctgtagtaatttcattttttctttttgttttcttgttgggagtattttgggctaaaattagcgtcaatcaaggtgcgaactgttgatcgtgtacccggaatagatcgaaaaatgtactacatatatatagtgggaatgagctgttatgatgacctaaccagtactccctccgtcctaaaaaaaggcaaaccctgagtttccgtactgacgtttgactattcgtcttatatgaattttttttataattagtattttcatatttgttagatgataaaacatgattaatattttatgcgtgacttatcttcttaattttttttatatttttttcaaataagacgaacggtcaaacgttggacacggaaaccagagtttgttttttttttgacggagggagtacgcaataatttcattaggacgataatgacgacctaaccacttaatgtaactttaagttatttttacgttttcgtacagaaatgacccttaatttctggaccaattctaaaaaaaaagcgaaaatgagaggggagtggattctaatccttcgggattatatcctctcgtgtaccttttcttttaaattttatacaaatagtagtaaacaattatgatttttttagcaatatagggtataataatatctatcgctttaccaaaaatcatgtccaaattcaacctacacgttgagaaaaaaagataaatttagatgtgaatagtacattgctattcatacgttaaatttgtcttttttatcttttttttatcttgacgtgcgagttgagtttagacctaggattttgtggagttgtataaatatattgtataagcgttttcaaatttctttagaatttttcataacagtttggatggtttttaagcaatctagagaacgttcctcgtgggatcagaggagaagaatattctattggagaatatctcttggaaaaagtacaccgaaggtccctcaacttgtcatcgagttacaaaatcgtccctcaaccgcaaaaccagataccggtaaaactagataccgaacatccctcaactaattaaaactggtcacagtagattcttcggtggttttgaccccggttttatcctacgtggcggctgagtcagcatggacccatgtggaccctacatgttaggctgagtcatctatggctcccatcggatggcctattcagccaaagaaaaagccaaattttgaattttcaaacttaattttgacattgattttgagatattttcaacgtagtttctttttcagcattggcttttaagtcaccgagaacacatatataaaagttttacctacaaatttatttttattctctaataagccgttttggcttattaaaagaaaagccaaacgatgagggcatatctctccctctcttctcttctgtgcaggccggtcggtcttcctcggttcctcctctctctctctctctctctatgcagggcggccgctgggcggggcgaggcgggagaggaggacggcgccgcgacggcggtcggcggcggcgacaacggcagcccagcggagctccacggcgtgggcgtgccgcggccgtgcgcgggcgtcgacagggaggcgcg

SEQ ID NO: 78235 - DNA, 713 bp, Oryza sativa
aagcacatcaacttaaacccgatgacgttcaccgggtcatattatcggaatcagctgtatcggctagccccgtccaactcgaactctgccgatcctgaccttagctgatttagactgcagccaatttttactctgtctccgcaacgatcttcatcttggattccacttcgatctgatcttcatctccgatgccaatagtgatagaatttaccaaatttggtcgttaacaacaacataatcttcgatcgcaaccatgcgacctaagatgggctgaggattagtacctcctgctttcctctccgccttttcacggccaggaagggcgccgtcctcctggagcttctttagggtcgcgctggtggaagccgacttgccgagattcatcgctgctgaaagatcgccggagatggacctagagctggcgaagctagggttctttacggcagcggagaaggtgaggagtgctaacaggtggtgtgtttgacggagttggcggacttcaaaacgtgcacccaaaatccctttaaataagcgcacccccaacggtgcgaattccaaggaactgagagaaatccccgctggaaatttctaagtctattacgcgcggcagtttttggacttcagttcaaaattcactcgtgactgttgggcttcaaacgggatgctcgactacacatcaactccgcgattctcgcacccggaatgataacgtt

SEQ ID NO: 78236 - DNA, 552 bp, Oryza sativa
ccttggttgagcaaagaggtgttattatgggctggtttggtttgtggcctgaattggctttgcaaatatttaacaatttcaatagtgtttagtgtctatttagtttgaagccaaattttgacatgtctaaagaaataggctattttaatagtgaaattgggttgttttggcttcaatccgaacacaactttaccttgccaagattaaccataccaaaacttagcaaaatttgatattgacaaaaattggtaagttcaatttaagtcacaaaacaaaccagctctatgttataaatagcactcaaatcaaataacacagcgtacattctactagtcttctctctcgcattcccctcggtcttgcctggcatagacaggcaaccgccggccgtccacgcgactatgatctcgccgaacaccgccaacacggtcctcggcgtcctaggtgcgtcatcgcctcatcggcatcttaattttagctttcttcaaatcccgcgtttcattaactttgtgttgatctttttcctcgatcgatctcatcttgcaggtaatg

SEQ ID NO: 78237 - DNA, 1719 bp, Oryza sativa
gatgtgaatttggttttgaatgatttggcatgtcagatattgttcggacttcggaatgtgatatgatattggatttctaatgcatcattttcttgcattggttccatcgcgtggatctgaataatgtgtttttcctttgctttaccgtcacttgatcaatatggtagttcataaggctgctgcttttttttttttctaatctcagggagacaggtagctactccaccaaggcctgctcaagttaaagtggtggaggagagagcagtttctactttgcccaaaccaagcactgaagtacgtagaccaggaggaaggagaccacttgttcgaccttcacttgaacgagttgaagaaccccaagctgatattgatacaacagtagttgaaggttccacagagaaaggcggcttgttgatggagcgtgaaactcctggtggtgtatctgcgttacagccatcaagtcgtaaacgtctaattccatcaccacaaacgagagatgatgcttcacaaggagagacaacggatgccaatccaccactgaagaaacccaaagaaggatcttcacaatgtactagtgagctaaaaactgaacagtcacctcatgaagatgtcatggcacctgttcctgtgctaccatctacagagttagatgagcaacagcctggagaagagatggacaccgatcagtcttccttgccagttgaagaggttgaggaaacaagggaggatgacttgggtgataaggatgacatggaaacacatatagacgcttcaatggacatccaaggacaagatgcagaaactggtattgataatgatgcaactactgtggaagatgtgccagtcaagtcagaagcggttatggaatcactggaggaagacctgaaaactgaggatgggaaggaagagggtcagtttactgcaaccactgatgttgaagatgagagggaggagggagagttgccagatgaaccagaacaaccagacagcactccccctgtgctggatgttggtgagcaagccggtgattctttcagggcggcatctccagcaggaccaactgaaaagagtgatgttgacatgccagaagaaactggagaaggtgatggtaccatggaatcagaccaaagccctgtaccacaatctggtggagcagatgcgtcaccgagccaaatggctgatgcgtcaccaagccctgcacgtgaaccttctcctaacccagtccaagctggtgcacctcctgaacagcagaatcccacccctcctaacccagtccaagctggtgcatcttctgaacagcagaatcccgccactgcagcagaaggtgttgaaactcgtagtaccagaacaatcaacctaactgagagagcgaggcaaaaccggcaagccaggattcttcgctcagccactcaacagaatgcaaggggccgtggcaaccagtctcttacatacagggtatggttttatactacaagactactgagtttatttctgttgtgttctatttttgttatatccagtgttaattctgatggagaacaatgttttctatgtgcagaaagatggcggccgaggaacacggggtcgtggtgggcgtggtcagtcgtagagaatttaggtttgtctttgctcaagcgcggagactagttttttgcaaaggacatactgaatcagggcggcatcatattcattttgtagcactatcagaattgcgagcgt

SEQ ID NO: 78238 - DNA, 8202 bp, Oryza sativa
atgttagtcggagtaaatgattttgaaccggacgataataagatgaaggctacagtttcacgattgctcatagctaagcagagctagtagactcggggtcaaaagatgaatagattaaagccaataattagatctgaacaatgaaaaatagcctataatcccctacatttgagataagtttgcacccaggatctacaaaagccgcgtcgatctacagcctctagtttggttgtaaaagtaaaatcggatgagacgagccagacacatcagtgtattattaataaatcgaagttctctttcaaaaaaaatccaagttttttttaaaagcatggcaaaagaattttgcctaatatatttatggagtggaagattgataataaatcaaaagattacatcagcaaagaatacattaggagaatttgcatacatgtttcattctgcgctaacaactgggacaacgactttgctactatcattctgttcgattagctatatatattctaatgtacagaagtaacaggccgaggccgtccagtaacgttcacttttttgtgctttaaagaatgggaaacagtataatctccacagaaaaaaaaaagctaataaacccccagccacaagccgcagtagccagccatactgcaagttcttctcctgcatgatacggcctccactccacagtcatcatcggtcctgcatctgtgggtaggtaacacgtctggtacatggcatgcactctcccacggggagccaacgctttgccggaaaatcgtttctggacaaacttgagacgacaatgcgctcacacggaagggttggctgtcatcctgaagataagtttttggtatcattgttcatgcaagtaaggaggaactgggaacagaaactgggatattaccttaacgaatgtccagttgctgggaacatgcgttgtcgggattatctcgtgccatgtgctccttattggaagggggtgaccctccgtggtaaatatgtaattttggttcctcaagaatgaatcatcgtagagaagaaaaagatatttgcagctgcaaataatttgtcatgtgactcagtcgtcagtaccagtgatgactaaatacttagtaccagcttttaagaaataattggaagggagcaacagcttacgtttctgaaagaaagaagctatgttgatgatcttcaagtttcattgtcgaaacatccctgacactagcaaaacctccatccactttagtatagtaattaagggatccaatgatagcttcaccaacttctagataccaaggatctacaggaagagcatatgtcagcctggggaaggagaatgagggaacagaaaaggagaagagctaatggcttctatgtataggaaatctagctagatataatggctgcaatttggcttttcttgttgagcaaacctttagttgcttgataaagataaaatgtagactcagcaaactctggacgtaaaggataatacttctctgtaggatgcaacattccgaagtccaaaagatatctgcaaaatacagtccgaaacttgtgtcagtacagtttagtatcaatcttgaagcaactttttgccttatcacttaaataataagtctttccccccattaaagatgatggtactaatatgtgggaaaaacagtaaatggtacctttccggcagaacaccaaacctttgccatacattgtaaaattcacgatgtgatatatttgcagcagcaacatctcctagaagtgtctggtcatgatcacaggagtagataaacaatgcatgattaaaatcctgcaataaggtgactgtccatcaatttatggaattcagcaaacctgaagacctggccagaaggcttgaaggctagttagttgccagtgtgttgcttctccggtcctcatatcagctcatgatacctatcatgccagatgatcattagtgcttggtacaatcacaacacagtgacaggccagttagctgagatgaaatgccaagaaaaataaaagggtgcaccatgggccatgtcggaaatacttctgcactgcaaggtaagctgaatgaaacatatcccagtattcttcgcttccgaaaagaacatacgctttaatcaaatactcataaaatgaatcaactcctgcaaacatgatacaaatgaatcattattatgtctcaaaagtatgttgtgcagtgacaagatgcttaccgcaggatacaaacacatgatcagtaaatcacatgggaaaatgtaaagagtagtaccagcaccaatgcctgacgaatattcaatccacttgccagtcaagacatcaagggttgtgcctacaagatttagtgaacttctcatgctccacaacttacgaagagcacgaagagctgcagcctcatatctagaatcacccgtcaaacgtgataatgcacccatttcaagaatcagagaacctgtaaaaatgtatattacaaaatagtaagatataactaagagtaatgcatttcccctggaatacagtagaacattctatcacccaccacaccctgatgtgcttgtctcagttgtttcattttccatcactccatactggaaaaaatagttacatggtcatggaattagaagaaactctcgataacatataatatagtaaaattataatacacgacttgtggaaaacatttcgtggttgtagcttgacactgatgttctttgcaagactcgtactcattcagtcatttgttttttggcatgaactgaagcatcctgattggttagttcttctaaagtagttattatcaatactgtacatgatgagcatcactgatttagctagaaatattccttctgtaaattggagtaaaaactaaacgcatttcgtttgctgagctgtgagctattgcctccaaaacccaaaggttcctttctcaatctgatatcttctacgatggttttcaagtagccttgcgtaaaaatacaaactgaaatttgccagtattaaaattctaatattgcctaccctgattaaccacctttgaaatagcaagatcagaggatttgtaaatgaaccttaagattgatccatgcgtatggcaatccagtaggtgtctcaaaagctggtagaaaacgacttcctaaattttcagcaagatgtagtaactggtcctgatatggtccatctttaagatgactgctgtgctcctttgcaagaatatgaccagaaataagccccccaagaagtcttatgttgcactgcataagattaagagaaaatgcatgtgtaactcagtgtcctgaggccaacatgtcatttttaggtgaaaacctgtggtagtaaccagctagcattacctcaaaaagatttattcgagcatcaacatcaaatgttaggttctctgaaagccagagaactcctctttcaaactccgtgaggttacctaagacaacaagactgcatgagccaaacagagaggcattacctatcaaccttgcgaataatagtgttttctgaagaaactatatcatcattcacattctgaacagcaaagacagaagtacagaaccaaattcaaagtagtgaaaaacattacaacttcataaactgtaccttgacaacgattcgactagtgtaagtgcagatccattgtaatcatttggcaaatgttcaagctacaagttggaacaaagtgatgacatcatgacctgctatctcaaagcttttaaaatttcaattaaaatttgcaaacttgttgatactttaatacatttaggttgccaagctcactaagggagtcagtgaaacttttggttagaggcttcaattcatcatgctgaaaagataaagagaataatgttagcttgtactatttcatgtgcgtttaatcgaactgaacattgtgtgagaattcttaagatagctgatggacatactggaaatgcataagtcatatagttgtcataagcatggtaaaacctgaaaagaatggtagtgaatcagtaatagaaaataaacattgcaagacgcagtaatgtgcaaatggtggattaggtgatctaagtatagcgccacaatactaatgtatgatcatactgagctgagatcctaccttcgcatgcttttgtatgtggatagaaaattttatgctggcattattttgtgctaaccttcatatgcagagcattcaggctgaacactttggtgaggcgcatgcatggttcaaaccgtctcagtttgagacaccaaatataatagaataacttaagcatcataaataacgccaatgctcctaggagcaattttgttttccctgttggacagtcagggcaactatactctgccttgtaaatgcaaagttagactagattttcagcatttccctattttacagagttaatgcagtgatttgttgataaaaggttcaggaaataccttggtaactcgagataacatcagataaacaatacaccaaccaaagcaatccttggtaactcgagatgacaactttctcataattgttttataacatgaaactttttaatacttaacaacttgggcacacacacattatccaatcaaaaaccccattctcaatccttctatagcaaacccgtgccttctttacaattacaggcttaagttcgaagtgggggcattcgtctcaacacattgaacaaagctttgcatcctttcaactaaatttacgacgaatttatcgtagacctcgcgaacaagtggagacgaggcttaacaaaagtgcggagatgtcttcgttctccgcgatgtagccacaaccaaaaagaaaaaaaaatctaaccaatcgaccgcgcaacgaaagagagaaaagtcaagagagcatctgagcatgtagcttatggcatgtcgagcacactcacatctccaggaccttgttcctcatgtacagcctcctgccgcgcccgtacccatcgccggcgatggcggcgcccgccgcggctcccccggcgagagccgagaggaggaccgcagcggcgacgagccgcgccggcactgggcggcgcggccggggaggaggtcgcatggggttttcgcgcggggtgcggtgccgtggggcgtgaggatggtgttggatggggatcgggcccgggcgagttcgttcgatccgaaccagacagctcgttgcttccgagattttgctacagggcaccggtctctctctctctccctctctccctctctttttccgcgagggtaatagtctgccacagaaaaaggtagggaaacgctatactcgctcctccgtaaaaaaaaaaaaaaaaaactcaatctaaaattaagatggtacataatctactataaacatgttcagatttattgtactagattatggccatgtttggttccatggactaattattagcccccaccttttagccctgaattagggctcaagaatccaaacaggtgggctaatttgaggctaaagtgaattagtcctcctcaaaacattagcctctccaagagatgctaatggggttaattttatgtaaggaccataaaaaagcagctatctctcctctctttctactctctctccaccttttagctttgaattagcccatggatccaaaaataccaccctagactaatgtttaacctaccaattcatgactaaacattagctctcaaaattagccatgggcaaattttccaaacagggctaattaagtacttttggagacggagtggccggagacggagtggccgagtgggtacttcctctctaccaaaaaaaaaacaatatctttcacaactacacaactacagtacattatactgtacatattcattttcttaaagttgatcttagtgaaagttaatatttaatgaaatatatacgtgctaaaaaactatactaatatattttcgaaattcattatgctccataaggggatgtgttttttcttattacacagtagatgcatacacacaccattatacagacaacattgcgctcacacaccggcgaactctttgcatgtcatgtagatgtttatgaaaattaaaatttgataacatagataattgtataatatattgctcaggaaagtattctaaactcttgaggtgaaagtttaaagtcgacctaaccagttgaaaataagcgaatataactatgaataatgtacttgtattactcattgtgtaatttatatgtttgtttgtttcttattctatatattacatctcaattggccttttcgagagtatcaatattgttaatcttttcagacttttataactatttgattggtgtttttttgacttacaagacgaacaaatgagaaaaaaaaaagttccccctaataaatagtagtactccacagttcataaatattttctagtgttgaccagaataattttaattatgatcattaatatttttgaactgtctaggctaggatgatcgaaaggttaacgattattatatttagaataggacacaccgtcttttaagaattttcaggtctcttatacaatggtatattacatgtgttgtgtaaactgttgtggaacaagatatatgatctcattcatatatatggatagatcggcaaccaactcagggacacgacagttgtgtcatgccccacgtcttctcactctcgtggcgatcctggcaatgggcgcaatgtttctcaaaccatcgtgtctccagttatcgcctctctctcccccctatatattgtaaccactgtgatcgataaagaatcgctcgctcattcgctctattgtgtcgtcaattctctctcgctccaatcaatttcatccactttcaacataaaccttgtgcagttagcattgtgccgccttaggaaatacagtgacgcaacttctacagaaaccaaccaatcaaaagaacgtgcacattctgacgtggatgtattgcaggcgacaatggtctggtctaccagaggaagtatataagttgccacatcagatttgtgcttgcgtggaggagagatgagaggagagagaacataagcgggctacagatttgtagccaactgcagcacgagctccaataaattatatgagagagatgtgtggattatacattaatgatgtagtatatttctgcagctaactattgtatgagtgaactatattagattgactataaataatgttttaaattttgaagctagtagtgagctatattattaaacttgctctcatgaaaaactttgatttgtccatttgaactaatatcattttgcctggtgtgtcatcgaaaaatactttgtcttctaaacaatggtttatattgctacaaactcaaatggaactttgattcaaaagcaatgtgatacaggagaaatcaatccagagaaaggggaaaaagaaacagcttgtacaaataaacaacacgcacgcacatagagagtgacctccagttctcgtacgagcagaaattaaattactgaatcgaacaggaaactcgagtactcgacacaaatctagcttattcacgaatgttaacaaaccaacgatgaaaaataagtcacgcacgcaaaacaaaaaaatacaaatacaaaaacgaacgaaaaacaatcgatttagcgaatcacttaattatgatatgacgatcatatcgtcctcgtaaaccgggcgcgcgcgagcgggcgatcgatcgatcgatcgatggatcggatcagatcagatcagatcatcacttgggcatgggcccgtggttgtaggtgtcgcagcgccgcctgatctcgccggcggcgccggtcttgacgccgaagaggctgagcttgtcgatggcgcgggagaagtcgtcgaagaaggcggtggggttggacgcgtagagcttcacgaacggctgggtgcgcttgtccgaccacatctcctcgtccgtggcgaggaggccgagccctcgctccaggttcacgaagtacatgttgtcgaacttcccgggcgtcatcacgtcgttgaacgccgcgatcgtcgggtccttgaggtactccttgcacgccgtctgcaagcccttgctcagcaccgggttcatcgtcgggtccacgttcccgggcttcccctggtagtcgtagatcctctgcgcgaactccttgcagtgcgagaatcccagcgtgtggccgccggacagcgccaccatctcctgcaccgtgaaacccttgtcctggaacaacttgatcacctggtccatgg

SEQ ID NO: 78239 - DNA, 1433 bp, Oryza sativa
caagagttataacttataagtcaaactttgtgatagatcatagatgtagcaaaatattattacttctaagaactgaagaccgacttaatattaagattctatcagcaattttttgctaggatcatttttgttgaaattgtttaagttacattattaatttgcactttataagctattatcgtgacatatttaaagcaccagttactcacacttgtcttgacttatttctatgtatatctatatatgcaattgaaggttaaaatgccaagttcaaggtgtcatgccaacttggtatgcagtttgttatttgagtataggttgttgggatgagttttgttgaagtttctagtatacaatccaatgcaatgaagttagatgcatggtgctgatgtttgaatatgtaatctatttagtgagttctgtctgttcttgaacaagtttcacactatcattaatattagtcttacaatctgatgtgcttcctggtgcatggaaagtttcatagctgagcattttgttaattggcaataagagttttaaactttatttgttgacaaacacaggaaattgttggtaatccataatccaaatccataaatggtctgttatacacttacactgaaagcatgggtcttttaaactatgcttcacattgctttctctttctgtttgtttttagtaatccatacatcaagtgatcaaagtacttagatcttatctttaaatttttgacaccttacctcataaatgtggaatctctgtttttctactaaaaacaaatctcttttttttttttgtaggggatgttgagggacctatcaaaagcacctcccacacctattcaagttgtggcatcagttaatgatggtgtaagtcattttcccccattagctgcacatctatttacatactttttgaggattctaattttcacaataagttgaaagtgaaatgactctttggctcagatgagttgaatccttgtttcgttatctagcttactgatgattgtagccatttttaagcagttgctgaaaattttggagaaattaatcaaaatattggtccacaatggcttctcaatattttcttaacttttatgaaggttaaacaagttatggtccattgccaagggattaaaaaactgtggctctagctattccattctaaatttgaggatattagatagtgtgatatactgatattgtttcctgttatactggtcactggtgtgactggttgactttcaatccatagttgtaaacttaaaatcatgacacataattggtttagctatgggaagatttaatgctgacggttgggcatctttgcatgttattttcttctctccttggtattcaaaatatgaaagctgtcctataactgtggcttttgtttactgccggttaaatatgaacttgttttcctttatt

SEQ ID NO: 78240 - DNA, 778 bp, Oryza sativa
tatatggactttttccggcctttgccggtcggcccatggccaccttgcgcgcgggcgagcgccccctcccctcccccaggccgcaacctgggcctgggccgggaaagccgccgccgcgcgctccccacttgggccgatttcggtccggccgccgccggccgtccgatcttagggtttgcgatcggacggccgggcgccgaaaacggggatcaaaacccctcgtgccccggccggccgccgaaaccctagcttctcctctctttctctctctcgggcgggcgcggtcgcgccgagcggcgtcgccgacgccggcggccctcgcgccgctgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcgacgacggccggcgacgaggtaagaattagggttagggtttttggttcttttgatccgtgcggatcttgtgcttttctttctttggatttctttccccgaaacgatctaaacactagggttgctctgataccattgttagactttgctctaggatcacctaggttagatctagtcgggtggttctatttgggtttgatgaacgacattgtagatgaaagggagagggtttagataccgatcgg

SEQ ID NO: 78241 - DNA, 2639 bp, Oryza sativa
agcttgtcgccccccaacggctgccccgacggcttctcgcccaccaacggctgccccggcaccacggctgccccggcggcttctcgcccaccaacggctgccccggcaacggctgccccggcaacgattgccctggcaacggctgccccggcaacggttgccccggcggcttctcgcccaccaaaggctgccccggcaacgattgccctggcaacggctgccccggcaacggctgccccggcaacgattgccctggcaacggttgccccggcaacggctgccccggcaacggctgccccggcggcttctcgcccggcaacagctgccccggcagattctcgcccgccaacggcggccccgcgcgcgccccgccggccaagacgccggcaaacacgacgaggaggaggaggaaggacggacgcatggctgctgctgctgcttcttggtttctcagctgggaagtcgattgtttcccttccctcacatagagtttgaggcgcgcgcgggtgtggaatggcaggtcgaagaaatgcgaggagaggaggggggaggagttgggtttgctgttcttggaggcggtggagaagaggaaatggagggggagggagcggcgggaagaggtcgtagagaggaggaagaagaggagaggtacgtactatttctggatcaacgtgcaatgctggtttgccctttaagtaggggtgttagtgtccgtttgcccttcagtagcagcctctggttgtaaacgtgtggtgtgattgttttttctatttctggctatagcattttagggttatagactttaaattttttttccctgctctatcaatagaaacgttgcactaatgtacgggttgcttcaaaaaacgtgcagtgctggttcaaaacctgtcccttgcattgccgttttcagctccattaacgttcctcgagttaaccatggacgttcatttgtaactccgggtttttcactttttcgtaaatgcaatgattattaattagctcggcagttgttgagtatgttgatggagaaaccagccaaactgaatctctctatgacatgtagctaaatcagaaatgtgtaacttcacaagataggaaaggaagttctgttagaaacttttcactgcctccgtttcaaattacttgatgttctatgtttgttataaatcaaatattttaatctttgatcatgaatttctataaatttatataatttaacatcgtatcgtttatatttttagattcagcataagcaatacttacataatatataattgaaatactgttaaactatacagattttaaaaattaatgatcaaagataaagataagacatatttaacttaggataaatctagaatggtaagtaatttaaatgaagtaatgaaaacagagttgctgaagaagttatgctaagcatatcataattcatgacatgcccatgcaaaatggtcaattattgatgtttaatcgattgcgtagatataagatcataacttgcccatttccctaagtgccaggtagtaaaagatcaacgtagccatcacctaaaaatttgaacgaatctgaattggattctggctgcagtgtacaacataagacagtttcttgaagctgtatacacacatcattaaccattttggttccgggtgaacggatacagcgccagtaagatccccaaaagaacactacatgtaatattttacatcatttctgaaactgccgaggctcctgacttttcaggaaacaaaatgttacgtcacaggagaaaaaataatttgcgagggtgtctttccgaatgtcaaactgagattcctgcctatttgatcccatggagtggacgacaaagaaaaagatatttcttctcggagcaactcccttgggttccatttcctgggagtagtaacttgcagggaatacctaaagatcacagaggaagataactaaatactgcagaagctacctcaaatcaaaatatgttattatcaaataacacactaccttcctcagcagggtcttctcttgtctactttcaaatggatgttgaaccatttcttccttcgaagtcgttccttaggtttcttttcctttctaggaccatcatcatcacttctggatccctccatggacttgctcttcgatttcttttcctttttcacagtttggtcatcatcacttttggactctttagaggatgttttccctttgttgctactggaactccgttgcagagttgtgttgttggtgtaggatgcatgaattgcattcctttccttgagaagctcgtcgatctataaagaaaacatgatatcagaacaaggtcagaagcagaaatgaactaggagtatttcacaaatacaaacagtaccgtctgcatttcttgagcgtatctgctggtcatctcggtgaacttcgctaagacctgaaaatttcagctattaacaaaactatctcttggatttgcggacacaaacaatttaaaaggttggattatacctctctatactcagactcaaatttagacagctcagatcgttttgcaagtatctttgcctccacgcatcgtagtttcaccttttcagtacaaaagggttcagcacatacaacctctatattataggttgcactcttgaaga

SEQ ID NO: 78242 - DNA, 1297 bp, Oryza sativa
gggagaaaaggcggcgggtattttttggggcggtggttggtttggtgggggggaatggttataaaagggtgagaatctggtttgcgcttttttggcgaccgcacctcctatcgtcttggcggctgtgccatcactgccgtcgccgtctccctctccagagagaacgacagcgttgccactgacatatgggctatgaaggtgggactcacctataagagcaagggcaatagtatagccaattaatagttctaattcatttatagtcaatctaatagctcattcatataatagttacatactgcactattaatacccggtcccacttatcatacacacagtgcgtcttggaatccgtgctacagctggctacaaatctacaatagcagactataagccagttgcaaatatattttaagaagataaataagaagagagaagagcagcgtgctacagatttgtagctagctgtagcacagactacaagacgcagtgtatatatgacaggtgggaccagatattaatagtgtattactgtgtaattattgtatggacgagctattagattggctataaatgaattgaagctagtagttggctataccattaaacttgctctaaggaatccacactaactttacgttagaggagctcgctccccaaagatgctacttcctcctccctcaagttcatttagaattgttttattttctactccatccgtttcaaaatataattctttttagacctgacacggtctactagatgctactttgaccaataatatgtcaatatctataaaagtaagatgttttaaatgaaaaaaagttatatatattataataatttgtttaatgataaacatagtaacattaattttatatgattgatctttttatttttttattaatggtcaaagttaaaaatatttgacttgctactgtactaaaaattgcttatattttaggacgtagggagtaccatttattttaaaacaagtttatttttattgtaattactgtattggagtttataaaaatatagaataattatattgggagtatataaaatataaaaatagttgtattgggatatgatataactgaggtattctaattcattttgtgtttattggcatgtgtgatattgtgagatggctgacaaatgaatttatttcaggatggggttagtaacttctatatgtatgaaatacagtttgaaatgtgtgctaatgaaaatcaaggtaaaatctatatcttaattagaacaaaaggggatcttaggtcatcatttttttttc

SEQ ID NO: 78243 - DNA, 15737 bp, Oryza sativa
gatcctttgcagcagcaacctggcagtaactagagctggtaaagaggcaccaaaaacaaaaacatagagaggtagccagacaatagcttgcatactcactgaattattttgttcaaagcgatagactggaaagccaagaaagaacattccagcagaagtaactttccctgtctttacactgtcttcctgcactaacatgatacattagctgaaaccatgcccaaaacatcaaaagactagcacaataaaaatatcaaatccttgtcattgggtactggatagaatgaaaattggatgaaaaagcagtattggtgcaaagcaacatgttaatagtcaatcccacagaccagaatttatttcaaagggaataatataacttggaaggccttcggcaaaagatgtcagttgcggatgtttgaatacagcacgcagacataaccaggattaatcccgtttcattacctgaatttgtcatgctagtgtcttttcaagtgctctgctaatttaaactaatcttctatggtgcataaaaccacatataaacaagaagcatctttccaggttaagctaaacagagaaaagctttttaatgtcgaggaccctggattcctaaaggcatcattaggcagtaaatattttgtatcgtacaggccatccttgcaacattgactacacaaaatcataatattcgaagtttactagttatgccaatatggaaagttttccatctatattatgagaatgaaggctcacttaagtattttatttacagaaagaatagtcaccaaatacatctaccaagaggctttctgagtttgtcttgctccacagttgtgatggaacaatagtttgtcaactgttactagtggagtagtggtgcactcaagattacaggaaaattcacagaaaaagaagtgccagccaattgtaacatagggttaggaatggttctaaaaaagggaggtatatctctggcttgtgcaaaaaatagagtaaatagttcaaacttgtcaattaaccagaatgtgctgtggattatattgcataaacactttacaggatgaccccgtgacaaaacaatatccaactcagtgtgttttggattttcatgctagaaacttacgcagataataagctagtcccaaataggagtattttttgtaacccatttttagtttgtttctaggactagcaaaatataagaacagactatacatacctgtaaagcaaggcttaacccaccattttcttcaggctcgaaatatagcaactgaaagaaagagaaacttaccttagaatctgtgcatggcaaaactttctaaacttacagtataattatacatgtatcaagtacttgattgtttttactttcgaatatcataattagatatcatggcaatctcagaagaaacagacagacggctaaaccaagttcattattatagcaattaacattgccacctttggccgtaaaaagtttttcaagaacaacagctcacatcacaaccacatttcttgttgttgagaagagaaaatagaaagtaacagctaaagtcagctaagcttttcaacatacaactaggaggcggcaatgctcatcagacaaagttgtataatggagtagttactgtcgaaagatcataacggacaaacactaacaacaagttagcaactaaccttgaatttacttttagcagttgattgaactctacacactaaccccattttggcttctttatctgttatgtccacagaataaaagtgagctgattgcttttccacctgccaatatgtgaaatctgaaacattattcactgacaggaaaaaaatggaaagtaaattatgggagatagttgaataccttcctaaagacggactggccaagctcgagttgggaaattcccaccgacccattcaatgcttcctctaaaactgttgcagaaactgtggtcttgattggtacacctagcttgctacacaaacataagcataattaaataatcgattaagtaagatcaaagtaaatggctatccttaacaacctacctaaacagggcagcaaacactgtatttacagtgttcagacttgacaggtccaactccagttcctgactatctgcttcaatggcctgaaagataacaaaagcattacaggcagacaaaatcaagcagatcaaacatcatgcttttgtatgccataaattacctcgaatcccgaggaatcatactgccgcctcttatcgggatctgacagtatgttgtaagagaatgtggcttcttgaaacttgtccgaggcaacagggtcgtctgcattcttgtctggatggtacctgcagtaccaaaaagcagaaaaaaaaaactcacttcattatcgctcagtcgttctgcaacaattaccacacaagcaaagcaaagtaccagcatactaccaactttttgaacgtaaggtaggagaaggcttttttttttctttttgagcaagggctcgaggcccccatttccattaccagaaatgagacaggagaagccttggtttggtgtttgaatctaatacacggttctaaaagctcagtgaacagctcttgtgctggtgttacaggagatgaatttattcaaagtgagccaatttgaccaaaaagtgcactccgttcttcagaaatttgaacaaaatccttccctcccgaacataacaacagcactcaaaagtgaccaaatccaagaagctttacttacttgagggccatgcggcggaaggcgctcttgatctcctgctcggtggcattacgccccaccccaagcacctcgtatgggtccctcctctgcgccgccgctccggcccccgccgccgcccccgccgagctccccttctccgacttgaacgacccaaacttcgaccccgccatgaaccccctccgcggcgccgccgcaacaccaaacaaaccccggcaacaaccctaatcccacccccaaaacctcagatcttactgcttgttgaaccggtcgtcgtcaggccctgccccaccacccgccgcggccggccggcggcgagcggcggcgcagcctctagggtttcccccgcggtctctcctcgaagagcgcgcgaggccagctcctcctcggcgcggacgtgcgcgtgcgcgtggtgcgcggcttctgctaatttggggaggtggcgagggaggagtccaggactcgagagaggccgacgaaatggggggaggagaaggcgaggaggagagggagaagagaccaagacgaaattattttggtgccgacatgtgggccccaccgcgcagtggcctcgtcgtcgtcgtcgggcggtgaggtggcggcgggtgcggtgcttcgctcgagtatactcctatgtgtgctcctgattaaccgttaactactctactcatcggctcatcgctcgcaccgatttgatttcgaaatttcgaataaatatagggtggcccacatctggtggggcacacccgtcagtgagatgactgcagggtcgaaatggtagctgaagaaagagttttttcgtcgttcccgcgtaaggattatcaatttgtggaaatgtgggttgttattgaagtgttgattacgctgtactctctgtggccgaggtggggatgggacggtgacaggtgtgggaccagagaatgtggatttagtgctcaggcccagtggccagtgagtgagaggacctgcatttaggatgcagcttcggagtatctgaccggttacattttcgttggcattaccaccgttgaagctaaaaatcatgcgcgcagtagaccatttctccaccatcacaccaaacgtgtaataacctttttgaccactgaaacaattcacagcttttagtcagttttttttaagtggaagcggcaaatattacaaaatagagttgaccctgtttataagaaaaaccggaccaaaaactatacaactatacggtttgctaaagtaaaaccgataaaaaccttacacatagagacacagaaagcctgaaggcaaaaacgactacggaccgcagaaggccgagggaagagcaaaaaccctaagacgaagcctccaaggaggtgaacaacgacataagccgttgtcgacacccgcccatcagctggactaagttttcacacaaggaggggagagtccacaaggcaacacctccaaggaggaaacagcaccggcaggcgtcgatattgccgatcccggacgactaagcagggcttttgcccccggactcactcaaaagtgcaggacctccaagaagtaagaggaaacaactctcgcaccatagaggtaagcacaccgcttcaaaattggcgcttcaacaagttcacacagccagcaccaacgaggcctaagagccctaactacagacagacaagaccaacaccgcggacgaacaaactcctcaagcaccgaaagagcactgccagatctgtaagcaaatagccaatggagggggcaccaaggaggcatggtcggcctggagaggaactgagatatgaagagagggcacatagacatcggtgtcaaccatatttccggcgaagaactccgggcttcgcgggacaaaccaatcaacttcagcgaccacctgcgacttcaccaccaccacagagagatgagcactagggggaggggaaggaagagagaaaggaaggcagagagaaaggaagagaagaatggtggtttcataggggcgtgggaggtggggaggggtggcggaagaaccgacgccccccccaagctggtcgacgcgctgccgactcgaagccggaagccgctgcccaccatcagccgccacccaagcgctagactgccggccaccacgagccgcatcgaccatgccgctacgcgccggacacgccgcctctacatcgcgtctaccgccgccgtcatcggagaagatcttatggctgcggggccggatctaccactgccggcgaacgtcgcttcccccgcgccgcatcgtggaggccctgttaccgccatcctagctttgccggtggcggtagggttttgcccccgtgtcgcttgcgcatgagtgacgcggggggccgggggcgggaccattaactgaattatgtttaattagttactccatccgtccaaaaaaaacccaatcctgggtttgaatctggatatagtgtatgtccagattcaaacctagaattaggttttttttgagacggagggagtagttcttaacaatatatgattgatgatttcaccaagtacctcgtatcaatcacatcgagtaattcctaacgacgaaggccttttatactttcattataaaagatcactttacttgcaaacatccacctgaacaccgacgagtggttaactaacacgtagtaaagcagttctctttttttcatcgataccatgttcaactccccaagcaaagcattcaatcatggatagctcaagatgtcctccaaaaggctgttacctcgcatcagatcagatgttcccgcaaacaaaatagtacatgagcaaggccctaaaacaagctcagaaacagtagccagacgcacactattcagctacagcaagatcaggacacgcattgcaggctgtacagattgatcaaaggccccactgcctgcctgtgaaattgtccggttacacaaccccaattgcatatgatgatactatgaagcatcagatcttgaaatgattggcatcgatgtggtccacggatcatcaggcagacaaaaacacgagaccacatcaaacgggcgccttccacggacaccagcagaggcagcagcgcccgagagcattgggcccagcgagaaatcgcccgtgggccgacgtcacatgccgatcccgtttcggcctaaattgccccgcatgtatgttcgtggaaaaagtatacttggactccctcaactatcgaccgagtatgattcacgtcccctaaccaaaaaaccgggtatatggacttctccaactattaaaattggtgcaaacaatatccctcggtggttttggggtggttttggctgacatggcacctacgtggccggtcttgaccaagtttttgtcctacgtggcgcttacgtggtattagaataaaaaaataaaaacatatgtgggacctatatgtcattctattaacagtgaaatttggtaagcccagagtagtcatcggcttagagtcagcatcggcttcgaagtcctgagattagccgatgagagttttcaagtcgtcagttgtcggattcttgctatattcggttaaggaaattgatctactaaaggaagtttatccagaagagaccgagttcaaagagaatgcggcatggcaagttatttattaattaggaatagtttgttagtttcttttatctttaggaaagtgtgtttagtgtcctataaggactttatcttttccttttatctttaggaaagtttctttcttgtccgacaaggacttgtatcaacccataggtataaatatgtatacccggggtctatgtaatctatcgctacgatcaatacaattcggcgcatcgccaccttttaccttttctactttattttatcgttcggcgggacttggcacctgacgtggggctgcatcggtgttcgatctccagctaaggggtaagtccaatgttccgccggtccagacaattgtatcgtttacgtcggcatcgttcaagactgcatcaggacattcgacctcttcgattactctggtttggataatatatttgcctagctatttatcatatgtctatgttaatctagtcctagcatctcaatttagctctatcggctgtctctcgctttagggtttctgccggtatcggctaaatcgtcttgctagattagattagcctaggcatctaccacccttaaaatcagtcaacggcttaattgtctagatattatgtttcttttcatacttagtgctgcatcagttaagtttgatctactaagtcgtgcttagaaccattatctccaacctgtttcttgattgccaataagggtttcatcggggtttcagccgatgagttatctggacgttgcatcggcttacaaggattgcatacatattggatttagccgatcgcaataagatttaattgtttaatataatcttgtggattttatgacatcggacctccagccgatgtatgctttaacctttggatcagtgcttattatatattgtttctagccgattggtttctactcgattatattgttattttattacatcagccgattgcctttatatcatcatctacattggacatatagccgattgcttaaaccctatcgctattggctggtatcggcatcggctggaatcactacatcggcttgtcagccgatcggctattttgtctgctgtttacatatcttgtcagttgcaagatcaaactgactggcacgcccgcatctcatcaatctttggacctgcagaggagttaagcagatctcccaggccggtgtgttcaatttttttcgtcaacacattcacacaaaaaaaatatagtgggacccacatgtcattctccctctcctttccttcttcctccccctctctctctcccttatctctctctcccctctaggcctttctcttggccaaagcgtgggggagagcggcggcggcggtggcggtggcggtgaggagcggcggtggaggcggtcaggagcggggacgggtcaaggacctccagtccctcctcgtcccaaagggcgcccaccacccaccgcatgccgcgttgtcctcctctccctgtcgccgccgcacgtcttccaccgcatccgcgtcaccgcgtgcgcgctgcgcgtcctccacacctccaacccgcagggtagcagccgcaagctggggccgccatgtggagcaagcctgttgatggctatgggccttaggtgttgctgtactacatgtcgctccgtgggacctacgaggactaccacgccgtgcgcaccatcctgtgggggctccgcgccgccatcgacgagcgggacctctccatggactcggccttcctcctggagctcgccgcgctcctcccccaacgccgccacgtgaccctcccccagatgttcgtcaacggccgccacctcgccgctcccgaccgccgccgctgtcgctccccgccgccaccgctcccctccgcctcgtccccatcggccaccgctaccgctgccgctcctgagtcctgagaaagagagataagggagggagagagagagaaggggaggaagaaggggagggaggatgacatgtgggtcccacatattttttatttttgtttttaatctagtgccacgtaagcgcaaagacccggtcaaaaccaccacgtgggcgccacgtcagccaaaaccaccgagggttgttgtttgcaccgattttgatggttggaagagtcgatatacccggttttatggttggtggtcatgaatcatattcgggagatagttgagggagtcaaagtatacctttttcctatcttcgttcacattgccgttttgggccaactcgtccggtaggttcgtgtgtataccatgacagttggcccaagaagcgttcgcaagctggactcggcttgttgctcgcaaccacggcgacttgtctgttcggcggtcgcctgtcggtttgagaaagcaatactcctgttgcgagatgtgaagacacggagagagaacgacggcgttcgtttcttgctcccgggctggcccatgtcttctccgtgtcattgtacatggctacatctacatgtactatattctcatcatagtctcgtttaattggatcggtaagtgtggccctacggctacgtctacgggtaataatagagttagacacgagaggagcgaaggacgccaacacttgcacgatcgacgacccagcatgagcgccaacgcacgtaagtcgtaaagccggataacacgtacgcctgactccagccaagggccataggtttgtgcgaaggcgcgtcgcatgcatgttccgttttgacgatcgagagattgctgaagaagcttattaaagacgaggttggcacttggcagggaaagggggagacagacggctgttgtccgagagagagcttatttagtggagatgaacgatgtgagaaacaggctacccgtaggtgacggcatgatgtttcatgtttgttactgaaaaaaccaaaaatatgactaaaaaatggtcttaaaaaatgtatggtcgtaggtagatcgtgaggagaattggtggtggtgcatcatccttaagagacgtggacagaatttacaataaccgtccacagaggacaacgaacacgaactagctacaaacatggaataaacacgctccagatcttcacatctccatccagggctccgctgcaaacgagggcagaagatccctccgacgagcacgatccatcgtcgtcgcgtccgccgcgcaccaatgccaggctcttcacggccgcgccatggctttccatgacggcgaggcaagtgtagccgttgttctccgcacctcccctcctccacaccctgaccgtcctgtccgccgagccgctgcacaccagctcgccggccgccgccaggcaaagtatcgctctcgcgtgccctctgagcgtgcccgtggcctccatgccgccgtcgccgccgccggcgctctcccagacgacaacggagcggtcgcacgcgccggagtagagcaccttgccgttggctccgagagcgagcgcgttcaccgccgacctgtggcgctccatcgtgccgaccagcgcgtgcttcctctgcccggggccgcgggtccacgccttgatcttcttgtcggccgagcccgtgtacacgcgcccgtcgggggagaccgcgagcgcgttgatggcgtcgtcgtgcgccgccgcgatggactccacgcaccggaagccgggcaggctccacaccttgatgctccggtcccacgacgcggagtagaggagcgcgccgtccggggacaccgcgagcgcggtgaccgcgtccacgtggtgcacccaggtgcacctcctgtgccgccggatctccacgtagctccacggcagcaggcacgtccggaggcggtccacggcggtcgggagcaccgcgcgcaggacgagctgcggccgtgtctcgccgtccctccgccggctaccggcacgccacgccctgatcttgccgtcctggtgggagctcaggaggagcccgccattgcccgtggcgaggagagacttgacggagctgtcggtgtcggcgaccgtcgtgctgctgctgctgctgctgcaaccgtcatcctgctgctgctcctcctgacttctccttgcgccgtccagtgcccacagcctgatgctcccgtccgacgaggcgatgtacagcgagtcaccgtcgacggcgagagcggagacgtacgccgacgccgacgagtggcctttgatcgtggcgatgaattggtggagcgaagggcttgtgttcaggtcatggacgtcaagggaaggaagggaacggaggctcggctgcgacgcgagcgacatggctcccgagagcatgctaccttctgcagcctcatgttggatttggcttccttcctgctcaccagaagaggatttcatggaacgggagaccctactagaccagaaaatcaaatcttctccagggaaacgatccaaacacaagctagagtttcatgcaatataataagaagcggctactcagatagcatgctaggatggatcatatagtttttttattattattatttttgcgcctggttttaaacaggaaaatgaccccataggccatagaccaacacaaaaaccaaataatcaaaaatgcatgatagaagctcaaactcatgtttaaaggcaaaagggacaacctagagcgctctagatcacgatcgagatcgaaatcttggtagagtgtcagtatcagataatcagatagagagaaaactagcagcagtcaaaagtaaaatgatcagaagttcataaccctggaggattcaatcctcgcacactagcctttactgtggagagttcaggtagacgtcatacgcgcacagtgttgtccaataagcaaagatcgctctagctagtggggtaacaattgccaccgttcgcgtgcagctaagcgtccgtatccatggatgttacctaacaccagcatctgccctaccatttttggagctcatcaatcttccttttctatgacactttatccactgtgcttgcatatgcattctttgaatctattctagtacaattctacacaaaggtagtcttgtaatgatatctcacccaatccgccttttatttcgttcccatccagcgcatgtgctgccgtgtccccttaacgttctaagcaatagttatatctatagcgctacatttttcatcgaagataatcaaatcgtttttacattgtatattaactatatttactgttggaggtcgtcgtaggcagtagctttgcaggttccgaagatgtcactcgttgccgaacgatgaacagcagcttcacgccggcggcgctgtcttcaaggagattcacgccctcgccgaggtgcacgagacggacagcggctctcctccaagatacaatgatctcgtatccttagccgtgcactcggccaagaacgaaccagtggactttcgtgggatgtaattctctctatgcaaaacaagcagatggatgtgggcaaaaacttcgtgcaacaaatacagcagcagtacgtgacttatatagccttgtatagcaacaagaaaatcttatccctaagccggataacaaacaaacaatagattgatttccgtcggcctgaaaatctggaacgataaagacttatcttccacatacagctcaaaaaaccaacaatatcaaaactgaaaaccgaaatctgaagataaggcaaaagttcagatatatttatctgaaccaaactgaagaatcgctggtacaaaatgaacagaaccatagagataaaatctgaacaaccatcaaatatcgtttgtgactttcattcaaatataatcagaaggaaaaccaactgaattccaacatttacaccctaagtttcaataaatacactgaaatttttaatacacaccatataagagaattatggttaaaaataattgattaaaaaaacgcgaacgcgcaaaagaattgcacgtcaatatattagaagaaaagaaattttgttacacgatgcaatcagccaaaccggcttatgccaagaaaagggggaaaaacataaccaaagaaaaggaagagactactacgatagctaaacgcaactccaatcagctgggacgagggcagaaccccgctacactcccaagaaatcccaaaaaaaaagcaaagccagctaatgaccacagacgacccttcaagaggatggactctagaaccactgagaccgaagagagtgcatagtcgaaaaaaattgattacatatagcaaaaatcattacaaagagaaaaaggtgactgaaatcaagtaaaataatatggtgccgtttttttagcaaaacctataatagttgcttgcttccctgtcagccttatcaatgtgtgtaggtaaaaaaggacaaaaaaagagaaagagagaaagaaatacaataaggatttttttttttggttctgagtaggcatgctaaattagtatctgaattcatcatgacaacagtttcagcaccaagatgggacgaatccccagctgttttctgaagaataattcagcaccgacatagtcgctcgattggtaccgtgcaattgtgctgcagtactgcaagcgacaacacacttatccaacattgtctgggagaaactccatcccaaaatcctgaacctctatgtgatgctgcggaatcaacttgtacgtgcaaacaagcattattgggttgtgtggttctatgctccgagtgaaaccgagcgatggcgcacatgttgtactgtgttgctgtgatcgcactcgataacaacaattatcaattggataatggaattgaatcacacatgctgaaatcagtgataaggttgttcctctgtcataattctgacagttgatattcttccttcggaacagagggcgtaaatgagcaggaatatgccggtcgtgtcaatagcaacgcgagcggtagactcgcattcggtgttcccttgctgggccagaggaaatcccatgctgaacatgaggagacaagcagaaagcttagccctagtagaagccaaagccagcattgtcgttgtaactgcgattacgtctgccctgcttatagacaaatcaaaggaaggtagcctggtagatcaactgggaccaatatggagtatcttcgaacaggacactgcgtctgcgtgcctatgaattgtgaggcactagttctgtgccctggtgaatggtgattgttcagagaatcagagctcaaattgcagatagttttctgattgtttctgggtagttccttcgccggcccggcaaaaaacaggattgttcctgatcagtacacttctccgtgaaagctaaggacgatccttctctgtgcccgtatgtgtcgctttcctgataatacgatctttttgctaggcaagttgcagactcgcggtatcatttttttacaagcgggccgccattcttgtcgtctcgagatgatcttttgtctgtactgtagctgataagtcagaccactattctggtaaagaacttgtccgtagcatttgtaggaggttagatactgaaatattctaatcgccagttgataagcaaattgctcctgaactatcgaagaatatctttgtctcgtcactgacagttccagttctaactgctgatatgcctgtcttgtaagtctattactggtccttggaccttaacaactgggccttcaggggaaatctgtgaatccggcccataaggtcaatgggccgaaattgatcacctctggccggtcggcacgggtttgatttcagcccaataaaatttgaagctggaaattttgcttggaaacagtcagaaagagagtagaacacctccctttgtgatgaccgcatcttcggctttcccatttgtttgtcttcgctgaggtggtgaaactttgtgaaatagggcaaaaggcgtatcttaggcagcccagctaagagatatggcttcctcaactgaatcaaggccacctaaatacctacttcaatcacctgtcgaatagtcgaacacctgtattgcatgttcaactgctcagagccgggtcagtgttttggttcttgctttgttcatttgtacactactaaattatttctttgtttatactttgtatttcgcggatggttcaaagccgagatagcagttatcaacttgtcatggaaagagaaaattgatttagaatgtagaccattcgtgaggacaaggtatatcagaacattctttttccacttttcactcgtcgtgtttaaatgagaaaaatcgagattccaactgccttgagaagagcatctcgctttggaacaaccgaaccccctgcattcccactttgtacgccatggtttctcgatttcttcctccctttcttaaatggagcaaatataaagaaacaatggcatgggctaaaatgcttcctgtcccaagtcaagctagccagaagattatgtttccctacattctgattggcaagttggttattccttttctgattggttaggttggtgattcagagatgtcgagacgtgtgttcttttgcatctcgtgtatgctttggtggtgcagttggaagagatggcgtctctggtctaatatctgaaaacggcactgatgacaataattgctggccatggtttcagcctacgacccttctataatcgtcagattatctcttgcgtgttgcgtgtagctcaccggaaaacaacccgatagaagcttcttgccaggtcagactgtaagcataaagaatccaatcacgaactctttgttattttgaattgacaaaaggtgcttgaattctaaacacgtcctatcatgtcacgtagataatatgacacgagttgacaacaacatgaaacagacgcaagaccacacacacacatacacatccgctgataatctcttgaccaaaccgatccaaacctaccaaacacgcgctaatttttatttagacatttcgttcgacgtaacctgcggcgacgagcgagcgttcccgcctcctggccggctgctgaccaggcaatccgtgtcgtagtggtggactccattgaaaatccttaaatcttacgtgacagcagctggattttgcaccgatcgcaccacgtctccgtctgtttgcggctcaaggtttcagcgatgggcgcctccacctcgcctcgtctcgccttgctagtagtggtcgcggcggcggcgttcgtcttcgtctcgccggcgatggctttcccgatgggattgccggcgacggcgaacccgttcccgaacccgtggtccgctttccagaacctctctgggtgccacgccggcgaggagagggaggggctagggaggctcaaggattacctcagccacttcggctacctcccgccgccgccgtcgtcgtcgccgtacagcgacgcgttcgacgactccctggaggccgccatcgccgcgtaccagcgcaacttcggcctcaacgcgacgggggagctggacacggacaccgtggaccagatggtcgccccgcgctgcggcgtccccgacgtcatcaacgggacatccaccatggacaggaactcgtc

SEQ ID NO: 78244 - DNA, 18749 bp, Oryza sativa
gggcccctgccgccccaccagagagcggcaagggttttcctgcaaaaaaccctccctccgtcaccgcccgttcctcccccgtttgccacgtcagcttgccgccccagaggtgggcggcagggtctatttttgtaatttttttggccgacagattatttctgtaaatatttttttaaaaaaatctaaaaccgaaaaaattcggctgtggcataggcacccccaccccttccccacctcctcctccccccccaaaatcatcagatccgcgtccgcctcctcctcctccacctcctcccaccccctcgccgatccagatccatcgccggggaggcgccagccatggccggcggcgggggcgccggcggcatgtcggagtcggtgctccgcaaggtgctcctctcctactgctacgtcggcgtctggatcttcctctccttcgccgtcatcgtctacaacaagtacatcctcgaccccaagatgtacaactggcccttcccgatctccctcaccatggtccacatggccttctgctcctccctcgccgtcgccctcgtccgcctcctccgcgtcgtcgagccgccctcgtcgcccgccatgaccccgcagctctacacctcctccgttgttcccatcggcgcgctctacgccatgtcgctgtggttctccaactcggcctacatctacctctccgtgtccttcatccagatgctcaaggcgctcatgcccgtcgccgtgtactccatcggggtgctcttcaagaaggagaccttcaggtcgtcctccatgctcaacatgctctccatctcgttcggcgtcgccatcgccgcatacggcgaggcgcgcttcgatgttcggggtgtcgcgctgcagctcgccgcggtggcgttcgaggccacgcggctcgtgctcatccagatcctgctcacctccaagggcatctcgctcaacccaatcacctctctgtactacgtcgcgccgtgctgcctcggcttcctgctcgtgccgtgggtgttcgtcgagctgcccaggctgcgcgccgtcggcacgttccgcccggacttcttcgtgttcgggaccaactcgctctgcgccttcgcgctgaatctggcggtgttcttgctcgtcggcaagacctccgcgctcaccatgaacgtcgccggggtggtcaaggactggctgctgatcgccttctcgtggtccgtgatccgggacacggtcacgccgatcaacctgttcggctacgggatcgccttcttgggggtggcatactacaaccacgtcaagctgcaggcgctcaaggcgaaggaggcgcagaagaagatcagccaggctgatgaggaggctggctcgctgttgcaggagcgcgatgggcacagtgatcgcaagagcgataaccaggcatagagccaccaccagatctgatcctggcacacacaaattggttgttctaaatccggctgtgttatctcttttggttgcactctcaatgtgtttgttctttaccttgatccgttgtaggagagcaataaattatggagtaaaatgtgatcttttacatttaatagatggaaaaatgtgcgatcttttatagtttacacacctgtatttttttatttattactgagatgctacatatgtttactggagtactagagaagtgtaaacatatactatctgaaatgctttgttgcaacagcctttgtagtctatataatcactatatccacttagttgcaactaagaaagcttgggccctatgtaatgttgcgtgaggcattgctaaagtactcttgaatgttgttcacttccttggtatgtatccctttgttctaattatgttggatgttgtgcagggtatctggtgcaaagtgcaaaagactgtagtttggttggtctacggttgctttcaaggaggtggacaccagtttgttctttcacttatttaactttagttggatctggagggcaaatcaagggaatttattggtttaggaaaatacttgcacttgcacctactttctggaggactagagtaaactttcatgttaccctgttatttattcagctatttttgttccagagaaagacagcctcgttgcctctctcgctcattgcctaaaatttatttgttctactagtagcctaggtactaaaaatgtacttctacatattggtattttggtggttatcttctatatataatgagcttactgtaatattataatctactgctgtgtatttctaccttttcaatttgaatggtttatcaacttgatgcatccatccgtcaactgtttcttggtcatttcatagatggcgctttttgttagtaacttgtatgctgttagtgctttcatagtgcactgtactgagtagtgaacacacacataattctgtttttcactagatgattggtggtcttattgattagtcttcagcatcacttgcgttgtactgaaattcagaaccatagcattggaaaaatagggttgcattggcatatgcctgttcaattgagcgctgaatcagctgtataagctgttttgctctttatatatgaataatttcactgattaattgtcattcagaaccacctcaatagctttggaataatgatagtagtacatttttgtaccttttagtagatttgatccaccaacatagctaggttggtggacatattaagcttagttgcattgattgtgtgctgtgcaatggtttcaatcacttcttagctatcaatcatagcagcaattaggtgtgatgatgggttctcttgtcttcataaatgaagtcgtagtatgaaatttcagttgtttgatcttgttcgtactggagggaagctcactgaagtcgacatattgataaattttggtttggtttagaatagcaatcaaatgtgttaaggctgagactttcaagaatgctgggatcctggcacgtgttcgtcctggacattgaccttgatttggtgcatcaactacgcaagaatgtttgggtgttgttgctcactcaatgcttgtatatacagccatggggatctgtatgtcgtttacttggttgttaattccttagtttaggagttgtatcttgttaaacatggttacctgatgcaacacgaccattgataattgggttgcttcagacagcgagaaggaacggtgaattgctggcctcttgtttgatccttgtttgttgtttccgaagcacacgagattgtttagcagcaaatctcttgtattcttgtttggacgctacgcaagtgccgcgatttttgtcatgcttgtgaacgggaccatatggaatggcatgtgcagtgaggctagtttgggctagtctatgctctatcccttcgaacacaaggcaaatcctgtgaagtatagtactactatgtttttttactgttaaattgttacaggagtgaaatccttgttacatgctgatgagatgagcgagacttgaccctagagcattgttcagtgtagtagtaatgctaatcatttacagtcaagtagtcaaactaatcccttcaaacataaggcaaacgaccgatgtgtattcactcagtgtcagtgaactacttgtactgttgaaattgctgtgcgactcaaattcttctcatgctaatgagaccgatgtgtttattcactcagtgtcagtgaactacttgtactgtagaaattgttgtgcgactcaaattcttgtctcatgctaacgagtgagccaattcttgtctcatgctaacgagtgagatagccttgacccatcttttctgcatgccttggtgtagtagcagcacatatcatttccagtcagccataattggcagtggtgttcgttgttaagagacatgttagatggtcgggcgcctatgcacctcttgtctgttgtctgtacagcattgtactgtacaaatcaacaactactttagtactgtatcatcatcatgtactactgcaatggagtagtacttctacctctgttacaggattcaagtcgttttacccctctgcgacttacagggagcagtatctaacatacaaatgactctccctgtttataactccctagtaatccattaccgtgatctaacagacaaatctcgagctaaattgctgtgcagtgctgactcgagcaatgttaacacaactgtacacaatacatcagagaaaaatacatctatgctatgcagctgccagtcagaaaccgctcgatcgagaaggatctcatcccgaattgcaagtattgtgcaggcacctcgtcatctgaaatgcgccgtgccaaacatcacgcgggaatcagatcgtcccgagcaaaagtggagcgatgccatatgctctcgcacgccgcgcccactacgcgattaggaactaatcaacgtacaactacatgtgaagtgaaaggcacaattcacaaaaggcgcaaagcacagtgcaatcctcctgatctgcttctgatccggtaaaaacagctgacctgagctgcgtaaacagtgaaaaaatggaggtaaaaaaaaaaactaccggtattgcttcacatggcgggcctgcctcggaggcgccgggctggcacgcggccggctggaggaagtgggaggctcacgtcggcggcggcgaatgtctcgtcgtcgctgtggttggagtcggagtcggcgctgcgctcgccgtcgctggaggaggaggaggaggagaggcgggcgagccagcagctgccgtggaggtggccgctgacgcagacgaagtactcgagacggccctcgttggcgccgagccagcggcacgcgctgcgcggcgcgagccccgcggcggtcatgctccacacgcgggcgccgcagtaggggcagcggacgcgcggttccagcggggcgcggtggccaacaaggaaggcgcgcgtccgcgaccgcatgaacccgcggtacacgccgcggtacgcgcccacgacgtcgtcgtcggacgcggcgccggcggcgtgctcgcacgggtccgacacgaacagcaggtcccccgcgcaccgccgcgacaggaagctccggcccgacgtcttggagaaccgcgacacgggcgcgaagtggcccggcacggcggcgcccgccgcgccgcagcagaagaagagcagcttcgccatcgccggccagcctcccccgatgcgccccgccgccgccgccaccgccgcggtcgggcccgacagcgccgacaccatccgcggcgccctcgacacgcagagctcccgccacagcacccgctccgccaccgcccgcagccgccggctcaccctcgccaccacgcacagctccctcgggtcccagttcagcgcccggaacaccagctccagcaccttctcgtccatgatccccgcgttcacccccctcatcctccccgcaatgccaccaccatcccactctccggccactgccgcgccgccgccggcattgccgctgcccaaccgcctcatactcatacgcgtgcgccgccgccgtgacacgctctctcgctctcgtcggcgactgcctcgccacgacacggtcgccttactcctatccaaagacgaaccggttatatcctcgtgcggtgtcaggtcggcccggaccggacgcacccgatcccgaccgcgccctccaccacgcgacaaatggaccactcctcgttaacccccaataattagcggctcgccgaagcgactaaacccgcgattacacgctaaacacctcgctaatcactcgcttaatcctgcctgcctaggaggaatcacacgctcgccgccgccgctgttgcagaggcgagtacactggacaaaaatatcttctcatttttgcgaagtccaatccgtgttgcgtcacgcggggctttgcttgacgcttctgtaaaaccgaaaccgccttcgacgacggagcgggaggacacgtgtcccccgcgcggtgcggtagcgcgccacgtggctcgtttcttggggacacgtgtcgggcatcggggtgatttccgtcgtctcggatttaaatccgttccggatttctttgatcccttcttccggtggtggtccggtgccggcgaggccgacacgtggactccggcgagaagcggtggggcccaccccggtggaaatatctcgggggaacgtggcggggcaagtgtttggtttgtgggacacgtggcgcgctgaaagggtggagagagatttgggggcccctgatgggccgtggtgacgggacatggggagatccgggccgaacacgtggtgcggttgttagcattagcttattgtgcgttttgcttttcttttcagctaatcacatcctgcgctttggagcagccgtcactttgatgggcgtgtttcaagaaaaaaaaagagtttcaatgcttattttaagaaaaataatttcttcgatattttgacataaccatttctgaaaaattgaagaaaactttggtcaaacgtcatggttagcattcctctgtcccataataaatttacttttagcttcttctttatttaaaaaataagtttgtttttaaagtaattattgaattagagttttgtaaaagtcataagtaattgtattagaatagataaaataaaaaaaattgtattgaggtttgataaaatagttgtattttagtttttttattggatatatatgggaaaattttattttaagacggaggtaacagcaacctctagcccgtgcttgttccagctgataatctgaaactttcttttttgttaatttcgtgtcataatcccttcgtttttggtgaaggccgagagctggggaggggtaatcatttgctcgtggttttactctcccgaagaagacaaatttggctgtgtttggaggtgagtgttgggaacccatctctcatacacagaaaacggagcggttcattaacacgtgattaattaagtattagctaaagtttttttaaaaatagatcaatatgatttttttaaacaatttttgtatagaaacttttttaaaaaaacgtaccatttagcagtttgaaaagtgtgtacgcagaaaacgagagggggtgttgggaacttggtcttgcaaaaacaccctacacgttgctttggtcgattggcaagttgggaaaggaacctgaaagtgtcgctggtgtccggacaggcacaacgacgcgcacgcttcctgaaatggtaatgccatgtggtggactggtggtgccggaagctacagcgtgcaggaagcatctagcggtgcgctgtacaggttgccgttgccgttgccgtcaggtggtgcacacagaactcgggattgggtaccgaggtagtaaaaataaattttttagatgtcatatcgaatgtttgaccatatattagaagggtttttcagacacggataaaagaaaataattttataactcgcctaaaaaccgcgagacgaatctttaaagaaaataattaatccgtcattagcatatgtggattactgtagcacttatggctaatcatggataattagactcaaaagattcgtctcgcgattacccccaaccgtgcaattagtttttttatttatctatatattaatactttatgtatgtatccaaagattcgatgtgatgtttttgggaaaaaaatttgagaactaaacggggcctaagtgatgcccggcatggttgctgggtgagtttaatatgataataatatataaagtagataaatgatataagcttacatacgtttgattatttagatgtatatacaataatgatcaaatgtcaaactaaggtgatgcgtttttatgagaaataaaagaaatttggataataattaattatttaagagctataaacaattcattatggtatgacttaatgagagaagatagaaataatattataaaaagtgatggagagatgtaattaaatattatatgaattatgtaggattacaatttaacatgtttgcattttaaagctcgaaattttaataatctatataactatagatgatatattatgcttgcatgatgtttaagatataatagtcgtttgtggatgatgatgtgtcatatttgcatgcatagctgtagaatttagtaggttacaactttatagcaagatagcatagagcttgttcaaattgatatcatttcaatggtaataaaattaaatatgttgatgcgtttagtttgttattaaactttgatagtgcgtaaggaattttggtaacatcacatttagtttatgttatcaaaacttgataatcctgctaagttttcaaaattttggtattgccaaattttggaaagattcattttgacagtaatccgaacaagctcctagttgttttgatttgaagtcaaattatggcattgttaatgaacaatttggtatttttaggttccagtgaaagtttttgctttttcattggtatcgagtcaaatacatctttatcttgccataattaatggtgtgaaattttattttagattttagcactatcgatatttttcgatattttggtatggcactaaacaaaatagatcgagaatttgatgagatggtatagttgtgctgccacttttgcagggaagtgcaggcgtagctttcaagcacaaaccaacagtggtggtagactgagtgatcgtcggctcgtcgcttggttatgacgtgcactagtacttttctttttggtttttgctgtgctgaattggtctcgtatctcgcgtgcttcgcagtatcgcatattcgcatagaataaagatggaaattttcaagttctcaagatgctacgaacgaaagtagttaagtagaacctgtgatggatccaacacctcaaggcatacttgccgtgcacagcttcattgttccggcccggaagtagtgacaaaccccacggtccagtccattctggctaagccggtacatccaaaagttggcccaagaatacccactagaccactagattctgaagaattgcactaaatacggcccagcaaaaggtggagaaaaaaaacttgttcagcgagcttggtaggttagctccgctcttaaataaagtaaaaatagtctttcgaatggtagaggaaaatataacatacgatagaaaattgatttcgaagaaaacttgataaaaacttttctagccgccaaaccaatgcgtcaaacttggccggtgaggtaaccatcgaatgtttttcacaaaatacaccgtttagtacattctctatcttagaataaataaatatgaacctgcctcaatctttattaggtaaatctggatctgtctctcgcatttcatattaggtttatttattttggaatggagcgagtagattgaaaaaacatattaataaaggctaagataaaatatgtatcttacctaaaataagagtggaattgaataaggccctgtttagatcccatcataaaaattttcatcctgtcacatcgaacgttagaacatatgtgtcgttcgaacatatgtgtctaggttatggataccacatacctaatagtaatcaactaagctcggcagggcccaccacatatcatgtcttatacgaaaacaaatctcgtatatataaggagttccggataaggaagaatgagtagagttctatatggaaacgacaaggactactcggattgtatccatatttatctctctagttctacttaaataaggggttatctatgggtagaaatacaaaccccctaggaggagagaggggacacccaccatagacgccacaaagccacaagccaacacacgttgccagatcttgacatcagagattagcctagccataccccatccgatgtctacggaagccggcaagagggatctagtgccatctctgatctcgacgggttcatactcgaggaggaaggctaccctgtcgtcgattatgagttggttatctagccgctaagtcgacgacgattagataagttatcccaattgttgtacttcgtggttttctatataaatcccatataaacaggatgtaggactattatctgtaagataaggggcccaaacctgtataaaaatcactgtctccatcttttttacctcaatctcacatataccctggtaccaacgatccccatactatccaccaacgatcttcataccattcaaataccatagtcgcgatatcaaacgtcgacaacatgcatgaagtattattaaatataggcttaaaaaataactaattgtacatattgcgactaatttgcgagacaaatctttcaagcctaattgctccattatttaacatcgtggtgctacagtaaatatttgctaataatggattaattagacttaataaattcgttttgtggtttactgacggattctgtaatttattttattattaattgtttttattattagactgcgtttaatactttaaatatgtgtccgtatatccgatatgacacggtaaacacagactaaagtgctcttccggaaaatattaaccaggctgtgtttagatccaaagtttagatctaaacttcagtccttttccatcacatcaacctgtcatacacacaactagtcacatcatgtccaatttcaaccaaaatccaaaatttggatccaactaaacacagcccaagaggcaggggcaccagtgcgcgcggcaccatccttcattccttcttgcggcgcggccgtgcgggtgttgacggcaacgcgacgcaaccaacacccccaccccggtagcgcgcggctgcgcacgcacggcgactactactactactcggcgagctcgtgacgtgacgtcgtgagccacgaccacgagggacgaagagacggccatgtgagcttgtgttgtgtgttggcccccactaggagcaagcaaagcgaggcacagatcggagggaaagagggggaaaaaaatctccgagctctcttggaagctatagcccccccgatccgcgggggagagggcccgatcggatccttgggaatggcgacgtcggcggcggaggaggaggcggtgcctgtggcggaggcgcgggcgcaggccgagaagcgcgctgcggcggaggatggcgagggggcggaggcggaggaggaggggaacgagatgcccgagccgaagcggcggcgcgcgtgcgtggcggcgctcgagggcgtgcgacgcgccgcggcggacgcggccgaagagaacggcgacggcggcggcggcggcgcgggcgggcctgcggcggacggggggtcgtcgttctcgttccacgcgcgcagcttctccggggtggagacgacgcccaaattcgggtccttcaaccccgccgacgacctcctcgtcgccttccagctcaagcctccgcctcccccgatggatgcgccggcgaaggaggagccccccgccgccgccgccggcgacgacgacgacgaggaggagcacgaagcaacagctgaggagggcaatgacgggatttcacaacagcttggggtagtagaccagtgaagtgctcaagtgagcgacggttttgacttggtgcgacttcgcttctccgttaggcactgtactcctactttgataacggtagcttttgatttgtgtagtagtaatcttgtactactatctcatcgtgtcaatgcctcagtggttctgtgttgtgttgtacaatccgattcctaatgataagattagcgaataataaaaatgatttttgctggtgtaatcaaggtgtttaactgccgccaaatgattcttatatctgcttaacaagtactgtactgtactaacaaccctgctgccccactgtgcagttgctccataccatcaccaattcagctcatagttttgaaccaaatgttcatcttctcactctctcacagtactctcttctcacggtactcccccggaaggtctcttgaagacagattataacagggctgatatgttcctcgaaaaatactggatgatgttgtcctaaaccaactaatgtgtgatggcatcaatcacgtactgagagcatccgcaatgtctaagatgcatagagactacaaggtggaagtaactgacatttttctaatagtaaagctacaatggttatggtctcctcttgactttaaggtaggatccacatgaaaaaaaaaactattcaccctttgatgtacaagatttaaagacccacatgcatactacaaaggtacaaaatgattttcttttcttatggtttagttttaagcttaaggtgaatcatagcaacattattcattttctcatcttctaatgcataaagcaacaacacaaatactactttattttttaaggtcatctttacatgcacactgttgttatcctggcgcaagatactccctccgcaacaactaaatcgttttctggctacaacttacacataacctatgtttgtgagcgaatgacaatcattatcactaagtttataatcactaagtttctgacttttttataatggtttttgttctgacctttgtttaaataaactaaaatcaatcataacaacaattgcagatcgaaagacttaatacatctccattcgtcccataatatagcaatttagtaccggacgagacacttcatagaagtgtactgtgaagtatcttatccggtcataggtagctatattatgagacggagggagtattagttgttttgccaatccatgaagggtcgaactactagctgaaaccgaatgatcgggacaataattaggccttatttgtttaggcttataagctaacttataagccaaaaaatctaagtctaaacaaacaagcaacttatttgtttgatttttttgaagccataagccactctaatactattaagccaaaagctaggttggagaaacttttttggcttatgtgaggttgatgtatgacttcactactaaacttaggacattaaatccaccggtttatacatcatataagctaacaagttgacttaaaagtctaagccagtaagcttaaagcctaaacaaagagggccttagagcaggtacaataacatgctataagccagctgcaaacatattttaaggagataaatcaggagagagaagagcagcgggctacagatttatagctagctgtagtacggactccaagacgcagtgtgtctatgacaggtgggactaggtattaatagtgtagcatataactattgtatgaataagctattagattggctataaatgaattggagccagtagttggctatactattgaacttactcttagaagataagaggaggaaaagaggaataactagtgattttttttcatggatgcgtgctgtaccttcttcacggttgtgtgaggaattactagctggcaacggtgttgtgtttatttttttataatatccatgattgtaatcctgtatttttctctgtctattgatataaaaattcacactgtatggtgcggtcgttatgaaaaaaaaacatttgttgatttgtacgattgaatatttatcgcaattcatttatctagtcatcattccattaaattctgcaggcacacttcacctgatgtttgtgcggtcacaatcagtgtctaaaccctaaaaaaataaattactactccctccgtcccataatataagggattttgagtttttgcttgtaacgtttgaccactcgtcttattcaaagttttttgaaattattatttattttattggtgacttactttattatctacagtattttaaatacaacttttcgttttttaagtactttaagttcaactttattatctacagtgtgatcatctttgtttaggctaaaacttactggcttaagcccacagttaaatgctctaatatcatttttcttagaaatcggcatacaattttcaaaaactatatattcctccttggtggaacgcgaaatgttatactgacccttgattgcataccatttaaaagggaaacttcttctaacactaaaatatgcaacaattgcaggggcctaaacgaaagaaaccaccaaaatctctccttacttaacaaatccccttcccgttcccactgcacactcctcgccgccatccccaaacctcccgacgatcccaccgcctcgaacgtgccgccgttccagcctagggttcgcgggctctccggctgccggattcgcctcctcgccggcgggtaaggcggctgagggggagtgccggggcgctccgcatcgctccctccctccctcccgtcgtcgtcgccggcggcgtcgggtcgggcccggcggtatcgtcccgcggaaaccctagatttcgccgccgcacgcgtggagcaatcgtgcggctcctggtgtccctctatggctatgtaaggaggggattccacctccccccttgtgaggctctctcggcataaccgctctcgcgttctagggtttgcgccgcctcgactgcaatgggtggtcgcacggtgctctccgacgaggaaggtacgcggtttcttcgcctgttttgtgcggtttcgtgctgattggttattccagcggaggggtttcgtgcgcgtttgctgatggagagattgttcgtctgttcgaactctgtcagatgaaatcgaggaggaagaggaggaggagaatccgcggccttcgcggagaggaagggacaatatggatcgggacgatgatgatgacgaggaggacgaagaaggttagagattttttctacgtttcttttccaaattgcgctagtttcctccccccatctgtgaacaccaccgattcggatgtttatatcgtgctatgcttagttgtttttttttctgtctgatttggataactccttttcgtgtattgaatgttatgacacgttctaccaatttcattgagtttatagaaatggccctatttcaatatattatttgtatgcccgagtagtgggttataattgttcatgtgcattcatgtgacaactgacaaggcaatttagttttttaaaattcttttatatgtttgaatcccctgtgatactcgagttagctttggtaatgggatgtaactgctttggtacagacgagggtcaggacgaatatgagaaggatggcttcatagtagatgatgcagatgaggaagaggaggaggaggatgagagggaaagtgatgatgagaggcggaagaagaagaggaaaaagaagaagaaaaggttgcttttgatccctcaacgagatagaaatatcaaataccgtattctcttctttagaagttactgaaacacatatttgtgcacagggaatcagaagggttcatgctggatgaggatgactatgagttgcttcaggataataacatcactggcattcaacgtcctaagcctgtatgcttaaagatactttggtgctgtcattaacttttttagcatgtttttgaattatggctcttctaatttactgcagggaaacaaatttaagcgcttgaagaaggccggaagggaatctgaaatggatgagcgctctggcttttcagatgatgatgggtcaggaaaaaggcgtactgctgaggaaagagtccagtactccttatttggcgaccatcaaggtagctgcatccaaaaatacttctctttagcttgtgtgatacagcaggaagtagtttatctaattttcttatttgctgcaatgcaatttcctcagatgcgtctattgaggaggacattgttgaggaggatcagcaggcagatgaagatgaggatggtgatcctgaagatgaaatggcaggtttcattgtcgatgaagatgaaattgatgcaaatggtcaagttgtaaagtatggccttatttttcacatttgtgccaacttcttttatacaactttactggatcttgtttgctagagttacatacaagtactgtttgcaattgcagaaggaagaagggtaaagcaagaccacgccgaccggctgcaggggtatcatcatctgccttgcaagaggcccacgatatatttggtgatgttgatgaactattagcactgagaaagcaagagcttgagagggatgctgctaattctggtgagttgagaggaaacagacttgaagatgagtttgagccatttattctggctgagaagtatatgacaccgaaagatgaacaaataagagagaatgatgtacctgagaggatacaggtaaaagtttgacactcttcttaggcatttttgttttagttatcgtgcatgtctgatttgtagctccttttgccagctgtctgaagaactaactgggtatcctccaacggacaccacaatgatagaggaagaaagtgtatggatacatagccaactgacgggtgatgggtttctgtcattctttaacaatgagcatgtgaacaaggacattgaccagaaggacattgcaagtgtattgaccatgttacatgtcaacaaatttgaagtaagtaaatgcagacaagctctgtgcatgtttcttttatgcttatttttcttacataacttctattacctgccagattcccttcattgctatgtataggaaggagaattgcccgagtctgttaaaagatcttgatgccaatgaacagaccaatgaagaacatagtgatgaagaagatcaacgcaagatgatgtggcacaaggtgacctatcactatgcatatgttgttcctcagagccaatttatcaatgttattcagttattgactccattgatgtcttccttttagatgctttgggctgttcagacattggacaaaaagtggctgcttcttcagaagcgcaaggttgctttggagatgtactatgataaaagatttgatgatgagaatcgaagaatagatgatgtcacacgccaggcattaaaccgtcagctttatagctccattattgaagcactgaaggatgcaaaatctgagaaagaggtggaggatgttgatgcaaagttcaatctgcatttccctcctggagaagttgaagaagaaggacaatttaagcggccaaaaaggaaatcattgtacagtatttgtcacaaggcagggttatggcaggttgcaaaccaatttggtcggagtgctgagcagttaggtcaccatctcacattgacgaagatacccgtacgtgcactaagccgacaccttgtgttacctttctttaaacaatattactaggacattgcaagcaatccatttacatttgtatatttcaggaagcaggagaacttgatagtgggaaagattctcctgaagaggttgctgcaaatttcacatgtgcaatgtttgaaacaccacaagatgttcttcggggcgccagacacatggtactacttagtatatttcacaatgctactctacccctaataaattatcaggccttgttcggttaatccccagaagggagggatttgaggggattgagggggtggaataaatcccctcaatccccttgtgggagggattacccgaacaaggcctcagggtagaaaccacacttagttaggttcatctcatctcactgatatgaaccgttctacctttatcatcttaccaggcggcagttgagattgggtgtgagcctattgtaagaaagcatatccgtagcatcttcatgaataaagctgtggtctcaacatgcccgactgctgaaggaaatttaatcatagatccctatcatcaactatcaggtgttaagtggctgcgtgacaaaccattaaacaagtttgttgatgcacaatggctgcttattcagaaagcagaagaagaaaagctcctcaaggttactataaaactgccagaagatgcaaagaaagagctcatgtctgaggctcgtgaaaattacttaagtgactgtgtcagcaaatctgcacaactgtgggatgagcaacggaagatgattctggatgatgccttcttcaatttccttcttccatcaatggaaaaggaagctcgatctctgttgacagcgaaagccaaaaattggcttaatatggaatacgggaagcaattgtggaacaaggtatctgtggctccttggaagaagaaggatgcagacaagaaggattctgatattgatctcgatgatgaatccgagttgagggttatggcctgttgctggggacctgggaagccagcaaccacttttgtaatgcttgactcatctggagaattggttgatgttctatatgcgggttctatcagtattagatctcaaggtgttgctgagcagcagcggaagaagaatgaccagcagcgagttttgaagtttatgactgaccatcagcctcatgttgtatgtgtaggagcatcaaactataattgcagacaactcaaggatgacatttatgaggtatttttcgattctattcatttgcaacttctttcttcacataaggttacatgttcagttaacctgtacaaagttatatcctccagcagcatggcttgtttagttgctagtagtatgtcaccagaagcagcattcatgagggaccatctgcagagaatttcttgcagcctgtgctataatgaacaccaattaagctcaccttgctgttggatgcttgtgattggttgagtcttttctttatacctgctggtcatttgtgaaggcaattgtactttgtttaaggcccggtttagttggcaaaaatttttattttagggtgtcgcatcggatatacggacacacatttgaagtattaaacgttgtctaataacaaaacaaattatagattccgccatggaaactgcgagacgaatttattaagcctaattaatccatcattagcaaatgtttactgtagcaccacactgtcaaatc

SEQ ID NO: 78245 - DNA, 695 bp, Oryza sativa
ctgcagccctcctccctgatataaacgatcgacatgcctcacaatgaactatcgggtcaccgctatactttacatgcgaaagtctcctgcaaacgaactgcgcaaatctgtgacgcgcgcacacaagcagtgaagcaaaaacatcacaaaatttcagatttaacagcatacttcctcccgaaacccgataattagggtagaaacagccgagtcaccccgtcccaacgcgcagagcctttgatccccaattccccataccacaaacagtacacaactacacatataatacaggcaaaatactaagcaggagggaggacaaaatggcaaagcaggagagggggcagatgccataccggtggagaaagccctggggaaggaggagatccgaaggtaggaggcggtgcggcaagcccagagcgcccttgaggcggcggcggcggcggccatgatcgagcgagctgttccaccgccgagctcttcgagtggaccaaccccgccgccaccttggagagagaaagagaaaataatgggctttctcttaatgggcttttgttagtgggctgtagtttaagcccatgttgaattgggctaaactgggttggttaccagtttgcctctgacagcttgaagagatattggaaaaagtacaccgaaggtccctcaacttgtcatcgagatacaaaatcgtcccccaa

SEQ ID NO: 78246 - DNA, 1138 bp, Oryza sativa
ttcaacttatgcaatcgacttactgggtcaaaattacaccctctgagacccaaaaatagcctaatgtttgtcatcattacacccttgaccttgagacaaagacatgtatgtatatatatattcagaaaagcatgatgatgatgtatgtatatagtacacggttgctgtttgtgtagcattttctgagttacatgttagtagcatttctgcaatctccctgtatatgtctttgccatttcctttcccggccagcctaatttaatcaacaaattccccaacatcatgcacatatgtatgtgcgtggtcggtacgagtggaaccggcaataatagatactccctccatcccaaaatatttgacgttgttgacttttaaaaaatgtttgaccgttcgtcttatttaaaaaaattaagtaattattaattcttttcctatcatttgatttattgttaaatatacttttatatatacatatagttttacacattttataaaaaattttgaataagacgaacggttaaacatgtttaaaaaaatcaacagcgtcaaatatttagggaaggaaggagtaatagctagtatcctaatatctgatatcaacaagttgaagtcgattagagaaataattatatctctctgcatattaaagatttaaagtcagcgaatgctgctaccttgtttcaggctttcagctagcccaagtggctctccgtgaacatatcaacaaggaactgacagaaatgatagattcaaaggtacatacacatagtggacttgcaaggactatatatgaacaacacattgtatatatacatttgattaatctgttcgtcggcatcgtgagttttcagctgaggagagatatctagcctactaaacccaacctgatccaagcccattgtaaagaaagaaaacaaaatcaactttacaccttttcacacaagagttcaacttatgcaactgaattctcttagagtcaaattaattacacatatgatacaaagcctcatgtttgtcaaaattacacccctaggacaaagacatgtatgtgtgtatattatatatagtaagcccgaattcatctgcgccgtccgtgtgtgtcaagatgtgtgctgctgaatcttacgttccacccaca

SEQ ID NO: 78247 - DNA, 1424 bp, Oryza sativa
ggtttcttttgacgaacccaggccacttggattcaaattctagatttgatatggatgctcgcacttacgcgtggtgacttcgtcaatctcaagatatatcgctccagtcttccggaggtgctcataagggtaaggtaagtgtgtgtgcgctataataagcgtctatgtttgtaccgtgtttctaatcctatcttactataaagttatctcccactaattccttaagcttaacatgtaaagatgacacatcatctttcactaacaagatgccgcatcatcatccactaattaacaaaatgccacatcatcatccactaacaatcatcacatttaaacatcatgcaaacatgctatatttttatagtttttataatttaagagcttttcaaatacaaacatgttaaattatcgtccaacataattaacataatgtttcaatgtatatatttattatgttttatgatatcctatatacttatatagtttatccttatttagttagtgcttaaatgattaatctacggtccaaattatctttctcctttttttcctctaattaagccatatcacatcaattgtttgtagcctttagatgattaatctacggtccaaactatcttcctattttttttcttccataaaatcataccaccttaccttttacgtttgaatcaccattccacatactatttgaatttaaattatcataaatcacattaatttacttaatctgatattatctagctatcttacacgttatttttttttgttatcagacgaaattcccgcagcaatgcgcggggtttcacctagtaaaaaaacaaaataagtgcaaaatatttggaaccatcaatccaagtctagaaaaaggaataacgaacaacaggtgaaaaatgcaaaagaattttgcctcacgtccccactggccccacctgccagctacacagcttcacatgtctctcccccgtctacggacgcaggctagaggtggccaaacgggcggcccggcccggcacggcacgggcacgggtccggcacggcccgtttcggcacggcccgttaggcacggctgatgaaacgggccgtgccgtgtcggcccacgtgccgagccgccggcccaagcacggcccgtggatggccgggccgtgcccgtgccggcacggcacgcccgcggcccacgggccgttcggggcacggcggcccgtgaaggcaggccgccagcccacagtgcatgcacagtgtttttttttttaaaaaaaggaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaat

SEQ ID NO: 78248 - DNA, 29597 bp, Oryza sativa
gcactcaccattcctgcagcaacttagctaatacacttatgcacctctgcttagtaaattaattaagcaggaaactgcaaaagttacagtagtgcagaagctaagtgcagtgactagtagtgtgacatcgtcggaggcgaccggccggaactgaagaataatgaaggcgaccgcggcgatggtggtggtcgtgctgctcgtcgcggcagcgtcgttgcatgccgccgacggagccgcggcggcgccgcgccgcgtgctgggagctgacggcggcggcggtgatcagtcggagagcaaggtggaacataaatccggctgcacgaacaacgataacacacccccttctggtgtctgcccgccgaacgcgccggggccgtgattaatttgttcagctacacgtcgtcgcccgcatcgcaaaattaatactcctatataaattaattaatcagtataaattaatactcctatttggctgatgaattaattccttcttggccttgatgaactatattttttccgtaaataaaagtaagttcaggtgtgtacttgttgcatcgcgtttgatgcacgcaacacgtttaattgattcaacgaatgttgatttgttcagtatactcattgggctcttcctgtaaaagtaaatgatgaattttgttttggtgttttgttttgtgtgccccgcttgaatctgcacaatacattttggaataattatattaaggatgtcggtctgaacaaacacccatgttaaatacagtaaatacaaacgtcatctctctctatctaatctacctatctaaaaaacgagaaaaaacaaacagagacatacaaggatttgaaccgtttagacgtacacattgttatctagacatgtggccacgatcctgctttcttatatactccctccgttatgagatatatgacatttctgacagcatcgacgaaattaagtatacaacggtgaagtgaacatggcttaactagttaactagttatgttttttttaaacaacccacgtacctaggttcatgacctagactagaaatggattctcgtatttacgactaattattttttcagcgctagccgacatacccgtcaacatcgaggtgcccatggtgacttcgtcaatctcaaaatatctcaacatagtctttcggatgtgctaatagggtagggtgtatatgtgtgttcatatatatgagtgagcatgggcgtattgtgagcacttgcatttgcactgtgtgtgtttttttttaaaaaaagtatagagcgaatttactattttaccctttattcctcttcatcgatgtgtttgtccatgccgctgcgtcgccaaagccttggacgacgaggaggaccgagggggtttccgtctcccttcacgccggctcgttcgccatctctcccaagccacctcgaagctggctcactcgccgtctcccacatgccacttctcgtgaccacagtgtttagaatagaaaaatatggatctcacaatgcttagagagaaaataaatgtgggcgtgccagtgtatctaaatacacaaaatataaaacatgtacaacatatacagatacacgtgatctttattaattgaattaataagatatagttttcgtgtataatataaaaatcatgcaccattgcttgtcgttgggcagatcttgacatcagcgatgtgatcttctggttctcaggacctcgagaggctactggttattacctccataggttagaacctattggagaacctccgaataaactgcttgtgatcatctttttgtcttaacttcgtgttcttcatgcataatgataagatgggtgttgatgtagatgtgtgtgggtgccaacaacatatccacggcttcgtcggttcgtgcgccggtatcggtgacaagccttcatatagtctcgatccgcccgccattattgttcaacctcatcggtcttgaacaacgtgtaagtgtagtttgttggtgaagacatgatttgcgtagcttgaatagctcgatgtcacaatagttgcatcgagattatattagaaagggagaagccattggagaccgtccgtgttgatgatagcctaattaatcgtggcttggcacctcctacggattacgacggctctataattatgtaagaactagaggttggttgcattgaaattattacttcacgactgttaactagcattagcatatgaatctaaactgcaattttattaattatttgcatgcaatacattaatatgaacaatagcatactgaaattatgcactgccttgcaatatttgatgattatttaaaaaattaaaatatgacacactcaatttccaattgtcagttcctcattaattatttgaatagagaaaaaagtataaaatggatttaatatttacctgaaaccagcttgacctgaatacgcctgtaggtggtagctagttctggtgatcgatcagattgtgtgatccaaatggccgctagctcaggttatccgtgacgtcataggaggaaacttcatatgcattacatcatcagattaattaattgatcggtcattctatattatcccaggcaattcaacgaagtcacgattcaattcaactattcaagcagtctttgcgtcaaaaatgaaaatattcaagctgtcaatttgatcaggggctgtcagtatatttactgtacatattcttgtgacaattcagttctcaactggtatcgtacgcaaagaatgctagctggcacgtacatacatgtgcgaccgttattccaacagacatggcagtcaaccgggtcacatcatgtaaactagctgcatttaattgtatgtttagttccatgctaaaattaaaagtttgactaaaattgaaagtttgaagaaaaaagttgaaagtttatatgcgtagaaaaattttgatgtgatggaaaagttagaagtttgaagaaaaagttaggaactaaacaagggctaaaaactggatgaaagacttacaaaaaagagagagagagagaacatttgtatgtacgtagagagtctattttaaactctcaggagacttcccttggttacttgcatgttactcgaatagttatgaaaatttttttgagtagatgtattaatatgtgatattaatatcactctacaaacattcaacttttaactctataaacattcaacttttacatgtcgccacgaaaaaaacattttgattgtgaacatatcactgctagagaaaccatctttggtcggtcggccaaaatttacaatagtcctggttctaataaaaatcaggactaaaaacatattaatttagccccggtttaaaagctcaggggtactttttgacaccaacgggactaaagatcatttttagtcccggttcaaaaaaaacagcaggcggggttagacacctatattttttttagtcccggttggtgttaccaaccggaactaaagatctatttgtagtactggttgacggttggtaacaccaaccaggaaaaaagatcggcatacgcggagattgagaatgaggtgtgtgcgtagattggatcgaggaggcatgcgcacgcggtttctatctcctcttccctcccgggtctatctcctcctcctctcctttatctcctctcctcactcacccttctcttcctctccttctcctccccctcccccctcctccccctcctccccacttctctggcaggcggcggcggcctcgcgtggcggcggtggccgggcggcggctggcggtggaggccggcgcgccggcgaggaggccatggcggtggccagcggtggaggcgggcgtggccctgtatgattttttcttttttcctttttgattcgatctgtgtgattcgatgtgttgatttgatctgtgagaatgaactatattgttgtgaatgattttgagaatgaactatgtgttattgtgaatgatttgagatgattatgtttttgtggatgatttgagatcgatggtgagagatgatattttttaatgatttggagatattgggtgcgagatatgaaaaaaagaaaaaaaacctgttaccaactagaattaaaaataggcatctttagtcctggttgtataaccaggactataggggattacgaaccgggagtagaaagcctttctccagtatgttaactatttgtagtttaatttgctttttttcattgcgacatgcagaaagctgaattttaagtttgtcgagtgatatatcacatataaataaatcttcttagagcttttattaactatttaaaaatgacatgcaaacaactgtaagcatcctctgttcagaatagtttccctatgtatgtacatacattacagagcttatcagttcggctttatcgtgattcatgatttcaaagtgttaaacggaatattttatatattagtaaagttttttcttaaaacgttatataattttatttttgaagaaaaaaaaccatcatatagctacacgaagatatatatagttgaagaaactttgaagctatatatactatgcaaaatgaatcgatccatgcaaccatttggattttcaacgtagaaaacggagaaaaatataaacaaatgctatcgatcaatgttggacccgcagtctcgtatgaaatgaacgattggagaaattttacaacgtttttcccacataatctattgcacgaaaaagctaaggtaatctcctgcttcgactcgagacacaggagactagctagtcaaacgtttcgcagtgaaaaacaaccgctgggaaaggagtgatgctgaacattctttgtttgactagcttgacgcgactctagctagctagctgaacgatcagtacacacgcgttttgttcatctgtgatgcgatgcttaaattaaacaggtcgtctcttagctaccctccgttttaggttataagataatttgactttggttaaagttaaattattttaagtttgactaagtttttacacaaatatagtaatatttacattaccaaattagttttattaaattaataattaaatatatttttataataaatttatcttggatcaaaaatattactattttttttataaagttagttaaatttgaagcagtttgactttgaccaaaattaaaatatcttatacgctatctcgatcagtacgttgccagaccaagcatgcacaacgtttattatattttcgcctctttttcttacgtaacatccatgtcatcatctagccttagctttcatgaattaatgatgaattcatcagtgtttttcttcatccggctggccggtggtctcatcattaattcatgcatgcagcgtacccttagctttcccagaaattctcggtttaattcctcgatatatcgatctcaaccatgcgtgcttcagaagctgttttttagatgacagattcagctttgaaaggaaagcccaagaatgaaacatatatatagtctggccgaaagcgatcgagttgatctcatcaagacatcaaccatatatagggacatcacgtgttcatcaaattaatcttcagtcagttcttgaaagttgaatcttggactcaaaacttacctccaccgttttacaatgtaagactttctagcattgcctatattcatatagatgttaatgaatctaagagaccttttgcagcacttggaaggtacccaaggtacctctcctcaacttaaacatccaccgttgattctcaaagagtagattaggaattgaattaacataaacatgggcagtttagtaattgttctttagccatcgtaatcaaccgttctttattcttttgctatatctttctgcacacctggatgtaatttttcgatccatccagccgcacacatacccctatataatggatgactcaaatttcaaaactaggttttatacatccatccatctttattgtctttagaaagtaatccatacaaagagacggaggcgcatcaatcaatttttcgtttggaaatcttcagagtcacatgcaaatctcatgcggatatatggaaagacgcgtggatcaattacttagttctaatcatcaattatgtggtcttcaattagcatctagttacacgatctgcaaacattaatcaagtactcctagacgccgtagttagtttcttcattagttatacagattaggtgcaagccgtgtgcagtggcatcaacagactgaagacgttatcatctctctgcgctccggccgccggagcagcagaaaagtttcccgtttagttcttcctctctttatgaaatatagaaaccaaattacatatctaacctttttcaagtaatgcctggcccacatatttaagtaccttttcacatgtatgtggatcgttagattggaagccatgaacagatttgacgcactccaaacacagtagaaaatctctgaatatatatatatatatatatatgtctagattcattaacatttatataaatatgaaaaatgctagaaagtgtcacattattaaatggagggagtagtacttcttcatcagaaaccatgcataccaattcttccagtttgatccgtcaagaacgctgtcgatcaatcgtgcagctaggaaacttcaccctattttttctcttgatcgcgtttgaacggcgagataatctcgatcgagcttggactgggagctactagtatatattataagtacatctcatatgctcgatcaccacacctgcagcaattaataacctagcgcatatcaacaagcttagccaagctgaagcgaactgcaagatagctagctaattaaggaagattaagccggaactaattaatcaagattgatgaaggcgaccgcggtgatgatggtgctcgtgctgctcgtcacggcggcggcgtcgctgcatgccgccgacgccgccgctgcggtggcgccgccgcgccgcctgctggccggagctgatgccggcggcgccgttgagtcgccgccgccgccgccgccgctggtgtctgcgagcaagacgtcatcgggggcttccgactgcacgcacaaccctactaagccctccactggtccatgcccgccgaacgccccgtgattaattaactaattgaccagctacacatatctattaattaattccttcgtggcgttgattgatacagtagtactacattatactccaaatatttactcatatatatatgtagtatatatattatggttcattaactatagttggttgtcgtaaatactattataggttcagttcgttaattaattagttgttcttgggttgtcgtcaataataccagtaggcaaacagtgccacacatatatacaagtgtcaccgtgtcgtagcttgctgatgcgaaccttagatattgctgtagtttgatttgttctgttgatttatgtacgtatacctcacaataaagacaaacaaattagtccattaatttgttcagtatttgttgggttctgtacttctgtctgtaaattaagagcatgtacaatagtaaactataagccaactataaccatatatcgagaagaaaagagaggagagagaagaaagtgtgctatagatttatagccggctgcaacacggactccaaaacgttgtgtgtgtatgagaggtgggaccgagtattaatggtgtaatatatttttatagttaactattgtatgaatgggttattatattaattatagttgttttggagccaacagttgactatattattaaacttgctctaaatgacgatgaatattttttctttcgccaccacgaattgaattccctgatgatttttgtttggtgtcgtgtactcgtgttccccgcataaatttgcacaatagatttgggaattattaaggatgcctatcctgaacaaacacccatatgcatatatactagaatcagtataaatacagtcgccatctctcagtctccctctcggcatgcatgtggacacaacccacggctttcttgtgtgtccttttcccaacattcaaatagaatctgttttcaagttttattgtatttttatttacattcctacatttttttggttagtcaattaatttgttttatatgacccaagtcaaagcaggttgcataagcaaccactacccagaaattggactattcctgatggcaggaaaaccatcactactggagaattgataattctccggatggatggtaaaaattacattagtttcggttcaaatagaaagcaggattaatttttaggttcaaaagccaacgaaacttttttatctttagtcccggttgataacatcaatcgggactaaagatcattttaggcccggttcaataactgtcaggccgtgtcaggccatatatttaatcaaatatctctctcacacatccttatctttatttctcgtccttatctaccgggcgcgcctctctcgcctcacctctctcgatctttctctcttgctcgctctctcaagaagctagcggcagcggcggcgccctggcggcgaaagctgtagtggcggtggctgcaccctcccctccgccagatccagctggaggggaggcggcacgatgggaggccgggcggcgtccgggctgcggaagtagcggcaatgggagtttcctgtcaggagacatttgtcctgatggccacggttaacccaagcaaccataagagataaggtccgagatgatatatatacagctatatacaatactcggtggactataatcctcaaatatcctctcatttttgcaggacgagatagaaaaagataaacatgcaaattgaaattcaacatatcctcaaatatcctctcattcataaaatattaagaaaaagataagatagattattatgttatatatcattctataaacatgcaaattgaaattcaacatatacatgtaggaaaaaaataaatttaactgtgaatagtacttgtgtacactactacataaatactcatctatgcaggatgagaacccctcatcagtaccggttcctcaaccaaaactacaacgttgacactgatgagtgggtggcaccaatgctggtcttggacttggcactcattgtttgttggttttgttatacgatgaatgaatgaattactccttggtcttgatgcaaaaagaaatagggcttagacttttggacggagggagtacttgttgaatggaaaatttgaatgagattattcatgaattaatgatgaaattcatcagtgttttttttttcatccggcttggccggtcgtcttatcatgcattcatgcatgcaaccccttagctttcccagaaaatctcggtttaattcctcgatatatctcaacgatgcgtactttagaagctgttttttagattaacagattaggctttgaaaggaaaacccaagaatggaattaaacatagtctttgccgaaagcgagtcgatctctcatcagtcatcatcaaccacagggacatcacatgttcatcagcttcatattcagtcatgctcttgaaagttgaatcttggactcttaaaaaccaagtatagttcttcagaaaccatgcataccaagtcttccagtttgatccgtcaagaacgctgtcgatcaatcgtgcaggaaacttcgccctaatttaattttctctcgttttgaacggccggcgagatcgatcgatcgagcttggactgggagctattataagtagctcttcatatccagatatacctgcagcaattaacctctagcaagctgatcagttaattaagctgaaacgagctgcaagctaatcaagctctaagagagtgcgacctgcgacgtcggcgattaattaagccggaattactgatgaagatgaagccggcggccgcggtgatgatgatggtggttgtgctgctcgtcgcggcggcgtcgctgcatgccgccggcgccgctgccgtggcgccgccgcgccgcctgcttggagctgatgcatgcgccgccaccgccggcggtgtccgagagcaagccgtcctccggctgcacatatggccctaacttgccacctggtatttgcccgccgaacacgccgtagctaattaaccagctatacacgtacgtacgtcgtcgacgtcgagcatcgcatcgcatacaagcaaaagatttgggctgattaattcattccttcctttgatttgtagctagcgttgattgatatatatatagatcatatgtgcatatatgttactacctgtcatgaatatattggttgtccaaaataaaagttttagttagttattagttagttgctgcatattgttgatgcacgcaacaacgcccaagcatagtacgtggtagtgctggcagtagcttgttgaccttacagactactgtagtattttaatttcttctgtagatttatgtatgccccaggagggtggtttcacgatataaataagagggaaaatgctgatttgtttagtcttcattaattgggttctgttgtgctgtaattaaatgatgattttttttctttcgccacgaattgaattccctggtgatgtttgtctaggtgccgtgtctacatgccccgttcccgtggcatgaatcttgcacaataaagtttggaataattgggatatatgtcaagttttaatcaactattcaaaatagattattaaatacaccgtaacactggatcatggaggagcgtccatatataatttgtgtcatagggatgtcggtttcggctgaatcttgttaataatatcgtgccctagtgtgttgtcgtgtttctgttcttgttatcgatgcgctatcatatataacagggctctagtggacctactctaaaaatacactctttagggggaaaatgtttaggttaaaattacactccgagggagagtagaatttatctaacagtatctctttaaaataatagaatttatgatattcgctttaaagaagctacaaccaattattacaaatgttgtagatcgagactgtcacctataaaatcacaacttaaaacaagagaactacatataactccaacaaaaaatagataagaaaaactttcatctagagttagtgaggaatcgcataaaacaattgtttcgcagaagattacaagttatgtagcatcttcctcaaatcaggaaatcgtatccccgaaattagcgtccgatcatttttccgattgaatttcgctcacatcaccatcgatgactgaaatcgaaccgaaacggaagataccgttggagagaaactcactaatcaatatgtcattcgcatgcagttgccactgtaatagccatcaaagtcgatccaaaaattaccaatgtcacacaaagcctccaaaacgatgccttcatgaaggacacaacggagacatcgttacgacttgtctgaaaaaatgccccagctagcggtggtgagtcgtttgcacgtcgtccatggcgcgcttcgtcaattggtctctgtgcaaaaaatgttatacgttgatcattcttggatgagatagtactactcaaaagatattcagactgaagatcagttatgctgcctcctgtcctgagtgagtaagagtgcgacacagataaataaagttaattgttcatttataccaacaaattaacagatgaatcagcgcatagctaattaactacatatatacatacattattctgcaacttgctagctctgaaacgatcaattattctacgcgtaaaatttatactattataatttataaacatcagcaattcatcggaagtgtacgtgtagacagtgtagtgatatgtatacatatcaatcacggcatttttggtggcgcgcagggacgtccagaaatatgggggtcgttgctgcagccagaaggccctgacgacgccttgctgacggacaccagcggaggcggctgctgacggcggccgccgccatcctctccgagacggcgcgccgccgcgaccgcgacgccggcgttcagagacgccgcgacgagcagcagaaccagcagcgccgccgcaccttttcctcctccctccatgtcgcaagttcagcctgaaattaagcctcggttcttcgttgctaactaataagcagctagtagctagattgaatgcttgatcaagttggtgtttctatggatgcaaatcaaactgtaggatatgtgggtatttataggtttcagatgagtatgatcgaccaagttgatgatatttttccgcgaaattaactgtgcaatctgacgcagaagacgtttttgacggattaaactggtgtcttattcaatttatcggtgaattttacgcgcattgtgcagatctgtgatgtcctgaaatcaaagttctgctggtttctgtactggactgaagattgatcattgaaaatgaacaaagctgcgacaaaattctttacgtcgcagctttgttcaagttcacctgggtaatggacacatgatcctcttctggaaagacaattggctgcaagaaggttgcgttcgatctattgccccttccatctacgtacgatcatgttccggcccacgtgcgctggcatcggacggtggcagaagcgctgctggatcgcagatggatcagagacatatgtggggcgttgggtatccaggccatcccggactacctcaagctttggtcgcttgttcaatctgttgatcgcagtaccaccaacccagattcactcagttggaaatgggagagtttgggccaatacaattccagatcaacctatatataaggccatgttcttcggtcctttctctcagccccaatctggaaatcgctcgccccgcctcaacgtcatttcttcatatggttggtagctatgaacagatgctagacaaccgatcgttttacgcaaccgtgggttgccacacctggatcgttgtgtcctctgcgatcagcaagatgaaagcattgaccatattttggtagcttgctcggaatcaaaggcaactttggtggtagacgttgagagcgatagagcatccagactgcttgcctctaaacgagacatctttccacctctgactttgcagaagccgaatgaagattcctaagtcacatcaccgaggatttgacactgtcgcaacgctggtggcttggacgatttgaaaaagaatgaaacaatcgggtattcgatcaacagaacaggccttgggtcgaggtggcaaagggaaaggttgaggaagcggtgctttggtgagcagcaaactcaacgattcccttcattttgccgttgcgaggtcgtggtagccaacttatttttcttcttgtttgcttctcatgttttggtctcctgctgatttttaatttactttgtatataacttttatttctcttaatgaaaaaaaatgcgtttcttgtgtattcctgaaaaaacttgaacaaagcattgtaaaaagtttgaatccgtacaatatatacttgactgaaagttaatcagctggtatgcataacccatttgacggctaagtatatgttggaattttgatggaatataacgagaaatttagctagtcaacaagtgcccaagtcattggttgatcacggtaggcgcaaatctccagtcgtgatcgatcaggacagtccagataccacagaatattcagagcaaatctttgccatggttgaaatgttgacagccttgatggcagacagtgatctggttcgctggcccaataggagtatccgttttttaatagatgacgccgttaactttttctcacatatttgaccattcgtcttatttaaaaattttatacaaatgtataagatataaatcacacttaaagtactatgagtgataaaacaactcataataaaataaattataattacgtaatttttttttgaataagacgaatggttaaacatgtgagaaaaagtcagcggcgtcatcaattaaaaaatggagggagtactaactaattaattagtcgtatgtaggagtaagaaaatatgtacaagtaatgacaacttatgcacgcaaaggtcccataaacaacacagagaatttacttgacgacgatgttcttttcagttacctggaaagcaaaaagtatatacgtactgtagccttgtttctggatcttccatggtttctcgacattgacatgtatgacaaggatatatgcattgttcaatactttgatgaagatgtcctgctagtcgtaggtctagtcttctacactgactataaatgtactagactgaatgcaaaaacattctcaatcgttgtcgatgtttcagagaattttacacatggatatgcaggtttgtaatatagaatgataccggtttgacttgaatatacctgaccgactatatatatatatatatattaaatttgtttggtgctccatggtgcccgggtaccattgttgaaattgagtatatacccaattcaaatgagtatgaatctttttcaattacttaggtattaacattaactactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattattataactaggtatatactcacaatttaaaattttgaaaattttgagtgattttgtgcattagataccatggtgccccatatgagtgtcctatatatatatatatatatatatatatatatatatatatatatatatatatatatgatgcgagtcacacgcataattggactgatttgaagccctagaaactagcttgacttttcaatagtagaaaaaaaaaagttcgacttaactgaatggatcgtacgtaagaggatgcatggaccgacttgcgcttaattgatcatagacaagtcaaaagcttaagttttcatatttttttagtgaaaaaagcttaagtttagtgtaattttaccgtccttcagaagacactggacctactaaattttcaagtgtaaaatttttgtacgtctaattaagtactaattaaacatctgttttatgtaaaatttagtaatctcgagatattttctcgaagaaacataaaaattctcttctcgttgtatctcatcactcatcagtcgttttgtccgtgacgtcacaacaggaaacttcgtgcatcacgtcagattcgatattgtacattgttacggcaatttttcaatggatgccgtacgcaaaataggatctggcacgtacttacgtttattacgtgcgtgcgttccaatagacttggccgtgaagctgggtcatgcatatatgctagctgcgtttacctttcaaacattcaagtgagaaatttgaccaacgaatttctagcaaagatttgtatatatcaaaagggtataccatttccttcactgttttactgttttagtacttaccgtaacatatatagagttacacttaaataaccattcaaaacttcagttttatttgacgatagaactataaaactccgtgataaggcgcggagtgccaactaatagtactacatacacacactcttacccttgcctcaactttcgagttgtagtcttattggactaaaaaaaccatttttctatatgatagcttttttttctagacaagtatggacatggagcgaaaatgccgcctacgaaaatggtaaccccgtgtaagtttgtagcccgccatcaaagataggtttttgcaagtggaccacataagggcgccgcctgcaaatcatctttggcaggacattaattaatacataaataatatcttaatattatttatgcattaattaattatttaattacaacattattgataaaaaattattactaaaaaattggcaggaaattttaaattttggcgcgcacaatttcctaggcgccggggccttcttatcgtaggtggcccctacctttttcccatgtggtgcgtcgtgctcccttccacctaggaaaatcatcttcccgagcggaccgactggccgcctgcgaaaatcaattattttcgtaggcctttgcctacaggtggaatctctatccacctggaaagaccgttttcggccgcctgcaaaaatatttttcctagtagtgccaggtcattggtttttcttcaatttcatcttcgtccactatgactggttgccaactgtttgtctccaatcctcttctagtactatctttatttttcactagcgtaagtcaaatttaaacttcaaaattttcaggatagtacatatgtacattgaatgtcagtttttttcaaacaaaactgtaacaatttgtatgtattttgagaaattgaggggacgtccaactcaagtcaagggagaagagatacttaatttcctcatggaaaatgctctttgttggttgtccagaatggtccaaagtctgcaatgcaaactggtttgacttgaatgtctaaaccggttacaatggctttttccttgtcagttctctgcagccaggtttttccttgttttttcctttttgaaaagtaaccaagggcaccctgcaactcagcaacttgcaggctgaagagcgctaaccgtgtggaaatacatatgcagcttgtgagagtattgtttgcctgaaaaaactgagggcctgtttagttcccaaacaaaatttttcaagctgccacatcgactatttagacacatgcatggagtattaaatatagacaaaaaaaaaaccaattacacagtttgacaggaaattgcgagacgaatcttttaagcctaattgcgccatgctttaacaatgtgatgctacaataaaatatttgttaatgatagattaattagacttaataaattcattttgcagtttcctggcggaatctgtaatttgttttgttattaaactacgtttaatactttaaatgtgtgtccgtatatccgatctgacatgcaggggcaaaattttgtgccaactaaacaggccctgaaatggtgaactaaacaagatttgtcaacaagaacctgcagcagtatttgaaggtagaccaaacaatttcctatggaaagttctgaatatctagtatccccagatcacatatcagtcgaccaaacaatttcctatgtatgaaagttctgtataccatatatttccctttaaatttctttgctgcggcagtaactctgtaaatctgtatggccgtcaaacaggttaggatacagactagatctagaatatatttctcgttctatatactctagatgctctgcttgtctgctagtcccagatctcaacaagaagaatagtcatcgaatcagaactattagacgaagactagctagttacctagttcacgcttgaaaaattctggagtttacacatgcattatagtattaatagcgcagataatacattgccttgcatggatgaattcagggaaaaaaacttgaggaatatccatgttaattagctccccattaattaaggagaatatagtttgcagcgagaaaaaactgttctaaaacacgtgcattattaaactgatttgaataccagaaaccagcttgacttgaatggacgtgtgtaattcgccagagacaagtcaaaagctttaaattgtagatcaaattgtagtagtagcagcatctcaaattgtagatcaaattatagtactgtacattcctatgacaatttgatatagtactgtacattcttatgacaattctcaactgtagtcgtcgtacgcaaagaatgacggttattccaacagacttggccgtcaacagggtcaaatatcctgcattcaccttttattccagtttgatatatactcatgtattatgcacttttggaagtaataattgcaattaaagcttgttccagcaggtttgaatatttaaagatataccgtacttgctaactcatgggttgcatgcgctattattgttgttattatggattgaaaaaattatgctaaatatgttactccctccgggttgataatatttatcgtttagacaaaagcacagtctccaaaaaaacaactttaactattattttccattataatatgtataaaagtgttaacaaatatatgattttattaaagtacattttaagactaatctatacatgtaatcatcatatttgaaagataaatcttttaaaaataattcataatcaaagattctaaagtttaacctcaccctagtaaaacgacaagtattatcagcctggaggaagtacttattattttctaaattaaatataacagttttggattaaaagaagagtgaatgtcaattacaacttggtaagtaatgattttaaatttcaaaattaatttaatagaataataaactgagagtcctaaatgggaacatatacaaccccatatttattgattccagaatcatttctaaattatagcagactagcttgaacttaccatgtaaataaagtttcaactcgctaattactaattttgaatttgataattaaattgatataaaaagcactaagttgagagtacatgatggttagtacaacatatttactgatttcgaatttttagaattattatatattgggaaaaaaaaagtccatgttatctctaattgtaaactccgtctatcccataatataaggcatgatcaaactcggtctctaaaactaatttttagcttatagtttctcatatactacaggtttacagtaattaacaaaattataaccatatgaaactaaatttaaatgtcaatccaatgatattatttttagcaaataaaatttaattcatattgtactaattgttggtcaaatgttttaagagttgaatcttagtgtgtgccttatattatgagatggatggagtattttatctaacacggattctggatacaaactagtactagttagatcatttttaacttaacacgaaagattactcagattgcacaattaggtttagttattatataatacaatgaagtttaaagagtaatatgtaaaaaactataacgataaaggtggggtgacatattcactatcacctgtcactattagaatttttttcaaaggagtatagaaagctagaaagttcatgatacttaatggtatatgttttatttaattactacgaatacaatttatagttgtgattatatgatccatataatcaatggccgaataatgttcttggtgggaactccctcaaattgtccaattactaaacggacggatattaattcctggttagcgtgggagctttttcaaagtgtctccaattactatagtactccctccttccctaaatgttagacgccgttgatttttttaaacatgtttgaccgttcgtcttattccaaaacttttgtgaaatgtgcaaaactatacgtataaaaaaagtatatttaacaataaatcaaatgataggaaaagaattaataattacttaaattttttgaataagacgaacggtcaaacattttgggatggagggagcatatatcatcaccggtttaatccatcaaaaaagtttacaacatagtcgacgctcgacggtcttgatatcgtctgacatacatctctatatatgtatccatgtgacatcgagctcaggtagctgtatataagtagccagcactgcgccctttctatcgatacaacaagctatagtgaacggcaacaacgtatacacacacagagagattttcagccatcaaaagcacacacgcaccaaaaatacacaacattctagtactacacatatgatgatgaagcagggaggaggaaattgcaacggcggcggcgcggctggcgggagggccacggccacggcggcgctgctggtgtcgctgctgctcgtcgtcgcagcatcgcagccgcacgccggcgtcgcggcggcccgcctcctcgcgccgcagccgccggtgctggcgacggcggcggcccagtcgtcgtccccgctggcgacgtctgcagccggcagcagcaaatcatgcccgagtaactgcaccaataaccccaacaatccttccggttgtgtttgcccagcaccgccggcataacgagctgagaaatccacctacgtacacaacaaattgctgcagaatgtaccaagtcgcttcgatcgagttgttaattaattaatttgttttacagaagtagccgagaccgcgagacgagtgtatatatgcacacgttactaataaattgtttgtcatgagattctcatgcatgaataatgtagaaacctagctccgattctagctaggattaagccaatataattaaagttgcatttctgattgttttaggaataaaggctattatagagtatctgcagtttgtatatctttaatttcatttgtgtagctttgtcgctggagtggtttcttcgtttgtacacatactgcttacagagctatatatattttcaaaaagtctgtcacgaggtgtactaattctgcgtggttaattcgttcatcttaccatctagagaccccgagtttattattctgtcaccgagaaaagtaattccaatatgtaccacccactactactaggatgaaaacggatcgaatacggtcggaaactagctctatcatatttgttttcatattttttttcggaatcggtatcggaattggaaacccggatatgaaaacggaatcgaatattatcgaatacaaatacggagcaaatacgaagcgaaacaaatacggtgacggatattaatcggaatataaaaaaccctcaaactaagcatcacaagtcaacgaacaaatataactcgttatttttttaataggacatcagccatgttagtcgttcacccttaaacgacagtcacaactcaaaattgccctccagaaaattaatcctatgacctccatttcctgcgcttgtgtttgttcagaccggatcgagatgtttgcacggtcgccggtgtccactccactggtctgcaatatagctgcaggtgtgccactaccggcgggctgcaacctccgccagcttgcccggatcgaagccctagtgctccgtcgtcctcgtgctcctcgtcttcctcgtctcttccaggcgctacagcagcagcgccatggtccagttcgtcctatggggcgccttcgcggtgtcctacccgctcgccgccggcctcatgcggcggcgccggaggctgtggcgggcgaggaggcggcgccgacgaagaggcggcggctgtggtgatgggagacgagacggcggcggcagcgaaggggcgaggcagcggtgggcagtggcggcggccgcctagatgcgtgggggatttgggaggcagcggctgttgtgttgcctgttgctagctagctaggtttagttgaaactttacataacacagtacacacatagttgggttgggttgggctccttgggctgattcatatgaatggctgatgcagtactccggatatccgaaaaaaaatcccggatagtttccgaccattttccgattccgtcggatatcacccttactgtattcgttttcgtatccgagaaaaaaaatccgaattcgtttccgaatccgagaaattccggacagttccgaccgaatttttccgaatcctaaaattggtccggacggacggaaactatccgaaccagtttcatccctaactactacacaataggatgtcctcacatatatggcaattagatctacaagcggtgcatacacttgtccagatacatggtaaaaaaaggttttttttaatagagggtgtaagacattttcagtccacatactgagcctcatagaaggctaaaatttaaaaccggcacatataaaagaaattatattaccaccttacaatttgcatgtcttcttttttctttaaaaaccaacacatatgtgatattatatgtactggttcttaaacacatacttcctccgtcccaaaaaaagacaaatccttggttttcgtgtccaacatttgactgtccgttttatatgaaatttttttataattagtattttcattgttattagatgataaaacatgattaatactttatgcgtgacttatctttttaatttttttcatatttttttcaaataatacgggcggttaaacgttggacacggaaacccagggtttgtcttttttttttggaacggagggagtatactattacatgatatgtaccggtttagaaaaaactgggaaaagaaatcgagccgagatgggaccttttaatcaagcggaggctatagtctctagaactccagataagtccatatcaatctcctccatcacacacacacacacactctctctctctctctctcatacacacacacattctctccctccttgcctcctacctgtcctcgctcgcatcttcgcactctccccctactcaccacctcccactccgcctacaacacgcgactacctcatcttcatcttcaatgcactcctcgtcctcttcccggaccacccgacacgccacctctttcattggctggatccatttgtagctactagtgcatcaagaatcttgagggttgctggatccaggttttgtgaggtcgatggccgccgcatcggtcgaattcaagctcgtgacagctagatccttcatcgtgcaagcttgagggttgctccatggcgacgccgagtgtaggcagctagcgggaggcacataaacccacatcagcttatttggagtggaaattaaatcatgaattacccactatggtacaacttcaatttaattatcatgttacatcctcaatgaggccatcagattatatctatacatttaacgtctttgcaatattctttgtcataatttatagataaagtttatatataaatcataatttatatcataaattgttaccacattttcacaactctctagatgacacgaagagagcgaggggacatacagtagtccaaagcgttgttatatatggcatactcgcgcggttgtaatctatcagtctcctaattgattccataagaaatatcatagttagatttttcaacatacataacagaagagagacattttatcggtcaatgttgaaaatgagaatcaacgttcaatcggatggagtacgtatcacctgtcgctaattttcgtttggaacaataataatcaattaatgctgaacattctttgtttgagtcatgttgacgcgaccggctgatcatcagtccacatgtgttttcttcgtctgcgaagcgacgcttaaagccggcgccatctgctagtcgtccaaactcgaaacgatcgatcgttgactaaccaagagtgactttcttctgggtaatatgtactccatccgtttctaaatatttgcgccgttaacttttttaaatatgtttaaccgttcgtcttattcaaaaaatttaaagtaattattaactatttttctatcatttaattcattgttaaatatacttatataaatacatatggttaaatatacttatataaatacatatagttttacatatttcataaaagtttttaataaaacaaacggtcaaacatgtgctagaaaattaacggtgtcaaatatttagaaacggagggagtactacgtaataagtgacccagcacaacgtttaatttagtcgtgcgtgtacttcgtcgttttttgcttacgtaattacgatgtaatcagcaattcagcatgtgctgcctgaccgatctttgctatagttaactctgaataatgtattgttgtaaatgcacatattctgcatgcatgcaacgccgctggtatatgaaaatgtgaattagtcattctatttaaagtcaatttttaattctactttttatataggttaaattttaattaatttatatatttatagagtgatatatcatatatttatctatattttttagaaaaaatatgtttctgtagacgacttgtaaacaaggggaggtttcctcgagggacgaattgcacactttttaaaaaaagaattggccatgccctcataatatatatggtttcaacatttttcaccactctctcttgatgtcatgaacaaaacgagtatgtattgcgtactcgctcgtttctcatccgtcctaattgatttcaaaagaaggatcttagaacattacattaatatatggagtatactaaacgttacattaataaaagtaatatgcaaaattgaaagatctcatgtatatacagagagttagatttgccaacatccaaaatagaaaaaagaagacaaaaatattattgatcaatgttgaacacatgagagtcagcgtttgtcactcgcagacaatccgatggagtactacgtcctagtacaatgaatctaacaaagtgtcacatcaactctcaggccccctttgattcaaaagaaattcataggaattttagaggatttcattcctataggaatttttcctacaaagccctttgaatcaaaggaatgaaccctatggaataatatgaaattcttatggaatgcctcttcccatacaagttttggaagaattttaacaagaggtagaacctcatgaaagaaatcctttgagtttttatctctcctcaaattcctgtatttttcctgtggtccaatcaaacggtcattcctatatttttcctgtgttttgcaatcctctgttttacacttatattccagtcagaatcctatgtttttccaattcctccgttttttcattcctgtgattcaaatggcccttaggttggctttttttgacggagggagtatctcctgtcgctaattttcgtttggaataataatcaacgaattaatgctgaacgtccattcgtttttctcactcgtttgacacgactagctgatcatcactgtggccacgtgttatatatgttcatcggtgatgcgacactcaaagccggccgtctcctagtcgtcgaaactactggtcttcctcgttgactacaatatgaccaagagagtttacttccgggttatatatatgtacatgccaaattaccagcacaatatatgttcatttttgcttacgtaatagtattgatgtaatcagcaattcgatcagcatgcaagctggcccggccggtcttaatttgctagttaaatctgaatattactacaatgtactataaatgcacatatattaattcttcagtgcatgcaacgacgcaggtatatatgtaggaacggaagtgtgaattgaactatgtgttttattcagagccaaatttattatttttaactctattaatgttggttaaattttggagtgatatattacacattgatttaatttttttcaatttttaaataattttaagaggacatgaaaaacgagggggagacgttctcgaggggcaaatttaagagactttcgcatgcatgcatttatgtctacaactagctgggtttttctatctgaaaacgtgtgatgactggagttgtggactaccggtcgatctcactagctttcgatggtcggtcggttcatacttgttgggtgcattaatcgtatcctccaagaataacgtagtagctgcaggaaacgattgttttattgctgccctaagttgaacaatattcccagaaaattcccagttaattcctcgatcaatctcgcatatatgcgtgcgtgcatgtagctaggcagctgccagtatataaacacctccgtgctttcatgtttgagctcatcgaatccacacaggcaatatagagatctctatctccctcgatcgatcgatcacctgtattaactatatattaatccagctataactaattagctgcagtctcctgcacgtacacgtcggcagcgatggcaagatcgtcggcggtgatgagggtgatcatggcggcactcgccgtggcggcgatcatcctctcggcgacgctgcacgaggcggcggcggccaggccggtgcacggctggaacccacaggcgaagggagcggcggcggcggcgacgactcggcacggcggcttcgccgccgttcagctcgccggctctgtcccgtcctgctgcaccaacggcggcggcgccgggaattgcccaccgggtgtcacgtgcccgtaagtccggccggccggccgacacggccgccgtagctggaggagatgatcgagttatgcaatgcaagctgcggaatctgcagagtacagggggattaatattaagcacacgcttcaattgattttttaattttgttcgtcaggttcgaataaattggccaggccgtatataagttacaacggcattacagatttactaaagttcattggttcatcaacaatgatcattttgtatcatatgtatcgatcgatgtcatgacattaattagaagcattgattaattcttcggtatggatggatagatgtgtcatgtaagtatatatgctttgaattaatactctatgcaacaagcttgttgtgtacactctgtgcatgccaactaacaaattttacagaaaattctaaaaaaaatggacacatatatgtgtcaaatcttatcttcaaatccattataacaaaaaaaattctaacaaatttttactcttaaacctgttagattttttttcacttttctggtacggttaaaatataatgaatttaaatataagactttccaaataagtttaatactattaggagcagatgtccacttttttatataatttttcgtgatatttactagtgtgcacggaaatattgtgtgcataggatatgttctcatacatatacattgtctttctcaaactatgaaagcagcgtctctgaaaccagtggctgattctttgttgatcaaatttcactcctatcatcgtcggcgaactaacgggaaaaatcaaatatcccctcatttttttacatgttacttaaaagacataaaaaaattagtaggttagatcaatatgtcatatgtctcttcacaaatatgcaaattcaaattcaacttatacaagtaaaaacaaaaataataaatttaattatggatagaacgcgtaattaatggtcaaatttgtttttttttttgaattgtataagtcgaattttaactcgcatctttacgaaaagatatatcatatattgatctatcttgataatttttttaaatttttaataactttttagacgacacgcacaaaacgagaggatgtcccctagagggacaaaaatccacttccgaactaatgtcaaactaaagcggaagaaaacattgggagttagctgaattgtagaacagacattctcctggaacttaccaccataattaccattgaacccgatccgacaaggaggctgtcacaaggacattgcactaatagagaacctccatattaattcgacgacttcaaaaaaaattacgatattttgaatgttcatcatcgctattccggacatccaaaacaaggttttctcctcttgatggttcacccataggacagatgagagaagggacgtcaccacgccggtatatcatgtctaggaaggtgtatgatactcacaggtatcaccgatgttagtactcagatcaaacagaagcacaggtgcgacgacaaaggccgaccgactcaacgtatcctaactgattggacggtctatttatttggccgtcaaatgggttgtaattatgcatacctgctgcatcaggtttcatccaatcactaaacatttcagtatttgcgtgatctagactggtcacatatgcacgcaattgcatcaaaaaagaaaaatctagatgcatgcatgtgctacaaaagtaaattaccagtgccatgcttgttaataattagtaccacaggttgaattgctaacccctccgtcaagtacgttgcttataggcagaaacacatccattaatccatcgaaattaaactataaatagccatgcatgcgaggttagattaccacactggtggagaaaccctttgtagtcccggttccgtaacccccctttagtcccggtttctaaaccgggagtaccaatccaggactaaagatcgctatctttagtcccgggtgaaataaccgggagtaaagatcgatctttagtcccggttggtaacaccaaccgggactgccggctgagtcatctttagtcccagttggtgttaccaaccgggactaaagatcgagctgaccgttttttttttttgcatggccctgttgctgcatggtttatatatatatatatataacccatgcatatatatgtttcaatacatatatatgcatacatatatatatatgtatatatatatatattatattatattatatgtatatacatgcataatatatatgtatttatacatatatatatatgttatgcaaatgcatatgtatatagatatatatatatgaccaaaatatatttacattatagaaaatgtgtacacatgcatatagaaacatatgtagtcatgtattaattacaatccattatatgtcatagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacataatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttaggaagttcgtacgggaatgaaatttggtatgtaggaagacagtaaaattaaactaactctgtgttgtatagcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcatgatagagac

SEQ ID NO: 78249 - DNA, 10650 bp, Oryza sativa
ttgtcaattttaatagtgtttattgtttatttggtttggagccaaattttggcatgcctaagaaaataggccacttcaacatttaatttaggctattttggcttcaatccaaacacaattttacctttatcaaaattagtcatgccaaaagttgtcaaaatttgacattgacaaaaattggtaaggccaatttatgccacaaaccaaaccagccctttattcatctaaattttttttcctagtgcagctcacaatacacaagaagttagaatgaacctgtttataaacttaagttaaatgagtctacatttagcatatatgggcgagtcatatactatgatcacattgtatataagattaattccaatataattatgtgggccaataacttacaaagtcgatcatgtaaataaacccaactattccaccatgtgcttgatcggcgcaaaaaatgcatatacatataaatataaattctagtatatctcaataacttacaaagtcgatcatgtaaataaacccaactattccaccatgtgcttgatcggcgcaaaaaatgcatatacatataaatataaattctagtatatctcaattaatttctctattgtgtttcatcatagttatccttggcaccatttcacatcagtaattccccatcacacgcagcataaatacttttcacattaaattaaagaaataccataatataatatataaatattgtatgatgtcctccctactgataatacttctcattttaagcaaggatgaggtcaaactttagaatatttaattatgaatcatttttaaaatatttgtcttttaaatatggtggccacatatatagattagtcttaaaaaatattttaataaaatcacatatttgttaatacttttatatattttataataaaaaataatggttaaagttattttttttgagaccgtgtccttatttaaaatgacaagtattatcaatccgaagggagtataaaaataagtcctacatcaatacgctcagataccctcccttaatcccggagatacttaccacggattcctccacgacactaatcccaaccagaatcacctctgccccctaatttgccactaatgacaagcttatacaatatgtggtcaaagccgcgaccggtctgaccacgtcccttcgccgttgatcgagtcgacgtggctttcctgacgccgtcgacgatcgatcgagcaggccatcgatctggtcgtccgtaattcatctactaaccgcttgcggctgcaggttcgcgcgcacgcacgcacgcgttgcatttgcctagtccttcgggttggtgtggcttctgaaaccgactcctcccccactcttctcccacgcaaatctgaaattgtgaagtgagcggtttgcctttaggcttatatatacggagaccttaacaccacgcagagagagagggaggagacgcgcgcgcgcaggttcagatagtttcaggcttgggaggaaggaaggagaggcagagagagaatttttgtctgagagaattcagatttcagagagataattttcgtctgaagaattgtgtatcgatcgatgtctggtggtgtgatcagcatggtggtcgcgccatggattctcgcttgcgggttcttgctctgctcatcctccttcctcggtgagaacagttctcagttcattggttcatctttctgttttttttttcaggttttttaccttgcttgcaatttcttctgttttctttacctcaagggtgatcggttagcttcaatctatacatgagttcatctgaggtttagaattacgtttaatctcttatagtagattatagtgtatgaatggttacagcatgtttctcatagctagagtcgcagtttcttcaatctgttcttgacgtctagctagctactttcatcgcgttctgttcatagcagtttttttttctttttttgaagaacgttcatagctaggttggttttgtctcccatcacgtcttgttttgtttcttgatttgagcttatactgccattagggtaaaggattttcttttaactttgagggatcctttgggataaagatggcgccaaatgtctgcttcgataattaattatcgattgcaggtagagccgtataggtggttgccaggcttattctttgtgttcttggttaggtttcttaaagaaagaaatccatcctgctgaggaaacactgcatgattggtttcaggaggaatgctgcgactgtagctatatttattttgtgggttttcaattttttaattacccatttatcgtactggacaaaacttcggtaatactccagtatttaggagaaggaaaaggataacaacaatattgacatcagcatcctgattggacagatttcgattacagtacaaatatatttcgtatggttcagaaaaataactgtatctagtccactgggcctatgatgcgttcttacttccttagaccagttctgttctttcagtaaaagtttggctaaacctacctaaataatttaaataggtcatatctgccattatttattagatgttacatctcaaccaaaatatatatcttattctgccaatagtttttctgattgacgaaatgaaaaagggtaacacttttgcattgatgtttaaatcaaactaaactgatgttgatatcgttgtcatctcaatatgacataacacaccgtcactggataggattatgtcttttcttaatcttgtagttttttttttcaacatcagacaacctaaaccaccatttttgctgttatctttgattccagtgcatctttgactctttgtatatcttatccagtgtgctttgatgaaacaactataattaggcagacctagatgatgctgtaaacctagataagatataatccattaccatatgaacgtatctaaacagcatcacattgtctacaattacaacaaaaaagacattgctgcggttttaatatctttgtttatttctggttgaaagcgatgtacttggatatatttgactccatggacattgacgtttactgtttgctccttgacgccaagtagaaaatggtttgtgcattttgcatcttattttttgtagtgtgaatgacggaattggacctgtgtagtacgttctataagtccttaggttggaaacttggaatagccagcagaaaagacgtatagtgatgtggagttgtgcacgggcttcacttggaaaattttatctggtcccaactcttctcctgggtttgttggctaaccactcgcctaatctagctaggagttcagtttctgcaagtcaggttacacacctaattcattgttcttcatttcataatgttaacctaaacatgataggtttggcattgcggatgtgaacaaggctaatgattgcaacttctcacaagtccacttaattttctcatctcaaatatatatatatatatatatatatatatatatatatatatatatatatatatatatttgctccaaagttgaaacaaatataaattgatcatttgactaatgtaaattgtatcatacaccctccatcccacaaaatatggcatcttctagtacaacgaatctgaataaagatatttagattcgttgtacttgtgtgatctcttctaggttgatttttttttatagatggagtagctgtataatgaatgaaaattactgaaaaaaaaagttgtaagttgtaactcatccgtgtggcaaaatgatgcaggagctgaaggcgccattggtgtgaactacggcatgctggggaacaacctgccgtcgccggcgcaggtgatctccatgtacaaggccaagaacatcaactacgtccgcctcttccacccggacaccgccgtcctcgccgcgctccgcaactccggcatcggcgtcgtcctcggcacgtacaacgaggacctcgcccgcctcgcctccgacccctcgtttgccgcctcctgggtcagctcctacgtccagcccttcgccggcgccgtcagcttccgctacatcaacgccggcaacgaggtcatccccggcgaccccgccgccaacgtcctcccggccatgcgcaacctcgacgccgcgctcaaggccgccgggatcagcggcatcccggtcaccaccgccgtcgccacgtccgtgctcggcgtctcgtacccgccgtcgcagggcgcgttctcggaggcggcgtcgccgtacatggcgccgatcgtcgcctacctcgcgtccaggggcgcgccgctgctggtgaacgtgtacccctacttcgcgtacgccgcggacgcggagcgcgtgcagctcgggtacgcgctgctgtcggcgtcgcagtcggcgtcggtgaccgacggcggcgtgacatacaccaacatgttcgacgcgatcgtggacgcggcgcacgcggcggtggagaaggcgacgggcgggcaggcggtggagctggtggtgtcggagaccggctggccgtccggtggcggcggcgtgggcgccaccgtggagaacgcggcggcgtacaacaacaacctgatccgccacgtctccggcggcgccgggacgccgcggcggccggggaagccggtggagacgtacctgttcgccatgttcaacgagaaccagaagcccgagggcgtggagcagcatttcggcctcttccagcccgacatgaccgaagtctaccatgtcgacttcgcggcctccagctagattaggcccggcccatttcacatttctttctttcagctgctgctactattttattatttgtcggatacagtattttcgtagtttcggttcgatctcatgtcaccggtgctctgatttggattcattgttcatttgttgtcgatgcacattggagtatgatttattcaaacgcacgaattttacgagaagatatgcagacaatttccactagatgaatgctgatctggatttaaaaacaaacaccatgtcaaaaactgagtgaaatttaatcgttgcgaagaaactaattctgcgccgattgcttttgcggaactatggtggaccggaaatgcgatacttacgggccgtttacccgtagactcggtcaaagccttttggacgcttatgggccggacgtgggcccacgaaggtaccagcgatgatgccacgtgccactttttgtggcacacgtggcgatccaatccgagaggactagccgctggtgtgtagtagtactagcgagttcttcctcggcgagttggcggcgtagagggaacgagaagaggcgagttcttgacccttccaccgttgcgcgcttcgtctgagttttgcgcctctcctcgagaccggtgagtgcgatcacgcgatttgttttaacatctgttccgtagtttggttgagtccgatgcttagggttacttcgtgttggctatggttcttgggtggaatctttgatcgatcgcgttagggtttgctttcagcaaaatgggtttattttctagcgaattagcgtgctttggttggtaccatgtaatcaggaatcaggcaaaggaggagggtaggaaactagggattcaggtacgagttattttgtgcgtgttccccatgtggccatgtgcgaggctgaaggggagattaggattactctgtttgatagaagtaggaagttttggtggttcatcaagtggaaatgcaattgagtctctagcagattcctctcggtgattgtaacaatcttatagttgtagtgagctagaaatgattcacaagtcgattagcctgattttgagattccacgcaaaaaccgagtaaatttgagacccactggcagatcctttccaacttatgttattgtactccaataaagtggctaaggtgatgcccttttgtgtagatttgtttcgaagttgctaaagccaactttaactcattcgctctagtaccacttgatgcctggtaaatgtgaagattgtaggagcagactagttaaatccaggagcaatgcttctacaagaacagcttagttatgcctttttccctttttttttcccctggaagcatcttcagttgtattttgctgatgcttagtgtattgggtccaaaaatggattgtatgggaaagatgtgacagttttctatggcattctttatctatttttagataattgatagaaatatggcctcctatatccacaagtggatatacacagctaaaagatacatgatacatgagttcttaggctccaagtctcaaaactgaggacaaaataaaaaggaaaaaagctagacaactacgaaagagaactagaagactttgtttggaacttcctaaagatttcgtaatagtatgactaatctttgtcaatacattctgttagcatattgctgtgtatgctgtgtggttcttctcttggagtcttacatctagtaattcataccaggcatggatgcaaagaacttaggcaacagacgacaaaatcatgagaagagtacaatgacagaagatgcacggagccgagatcaggagaccttgcagcggtttgcagattcagatattactgtgagtccagtcaacagtcatgaatctggagatgtgaacatggaagctgccatctctgctgaggatgtcttgcgagctggtggtttcggagcaaaagatgacatcggcagcctccttcccacagccgtagattcgactgatttcgaggcctcgctacgggatgctcgcgactttgaaggcgagagtgaaaaaccatcgcatcctggactaggatacaaagcaaatgaaactgacagtggaggcaaaccatcagatgtgcagcagcagcagcagcagcagtgatccttagtgttctcttctcctccatgcaattttagctttggataacatgacattcgccgcgttcctctagtgctccgaagacctatcctgttctgactttgtgctaaggtatgtggcatttctgttgtttccctgatgtaccatgtatgaacgtgaccatgatgattctgctgtatgaaccagatcgtttcaccttgtatacctaagtattagtggtagtagtttgtgccagttttttcatcatgagttgattatctgctggtgattgtggtcacaggatgcagaggagagctgatatattttggaacgaaacgcatgcaaattttgcatggtaggtacttgataggaggcataaaggatcatctgaacacttatgtatgatcagaaatcaaacattaaaacaatagaaatcaactaagttgacattaaaaccaacagaaatcaactaagtctggatctcgacacaagaacagaacaacagagcaggtctgtcattcactgtgaggctctttgtgagttaagatgatagacaatcgtcgtcgtcgtcgtcgtcagcatcacgaaacttttgcccttcggccttgttgacgtgaagcctcttcttcttctgccctggcttcttcttgccggcgtcggccgccttctcggccttgagcttctcgttggccaccgtcgtcatggacgacacgatctccttcacgctcgtcgacgtcagcgacgccacggcgagcttgttcatcgccttcataagaccaatgtaatggtagcttttctgaaacgaagaaagaaacaaccaaacattagaccccaaattctccttgcaattatttcacggacaagaatatgagacgagaatgcaaatacctcgtaaggtctaagaagatctttcgcgatgcgctcggcgtactcggcgaattccttctccgattttgggacgaacttctcgatgggttcgtcgtcgtcaggctgcttctgagctatctcagcagcggcattcgaggtagaggtttcactcggtgttgcgtctgctgcttctgccttcgccttcgcgttggcctggctcttcttccctttggttgcaggaggtttcgtgctcgccgccgtggcggccgtctccttcccaggtttaacgtcgtcgtcgtcgtcccacgtgtccttcaccgcggcgaagtcgtcgccggcgtcttcgtcctcccaaagcctttttcccatagactgttcttcctcatcggaaaattcatcgtcatctgcagcgagaaacgcacgggcaatgtcagaacaaaaaatggatcaaaattacagtttgataaaaaaaagtgatatcgagaaggaaaaggggagttttactatggaccatcgacggcaacttaccccaactcgccatctttgatgccgtacttgatgatccgtgcaagaacatcaacaaattaactatcaaaagcagggatttatagcctttttctccaaaacccaagaaaacaccaagagggcttcgattgtcgagtgaaattcgagggctgcaaaatcgagccggtgcacgagaatttttgaagtttttcttgcgaccgagaagtgctcgccaaattgcgatggctatccgtggatgcacgggacaatccaggtatatagaggaaacggagggccgtcttcttgtcagagtcggacgaggaagagcatactagagtactggattcctagtccgattcatgatccgagtttctgctgccgtggggcgcagcagccaattgctgatacaggcattgatgaactggaatcggcttaaatatgccacgttttattaagagagttttgagcgttcgacaccacaaaatctgcgatccaaactaatgaactcatggctcgacaaccagaagaaaaatgtagtgatgaggtttgtctgaattctgatgcggcaggatgaacattgattggatcattggaagcactgcacgtccagatccgatgcggagtttgttgaagtatatagatgtgacaggagtttatacatgaatgctcaaatgtccatggttaatgcaaatatcttgaagaaatttcatgggcataaaatgtgatgatgtttcactttcagtgatcagtttctggttgcacacccttcatctgaattttgagctgaatccagtgtgcgcatccagcatgcaaatacatgatcaaatgctcacaatggattatgaaaatctccaaggtgtctgtttgttccggaatccagcatgaactcctgccatgccatgattcactaattttcaatggatacatctactttcaacagtcgactgcccaggcaccctaaagtttgcttctctgccaaagaaaaaaaaacgcaaataaaacatacttacccagcaaattagcaaaagaaaaaaaaaagatgatgagagaaagttctgggggaaacaacgtaaggtattgataattatgtttcctgaggtaaggtatatccaacaaacacaaaatgctgggaagttattcaaacgatttccagcatctctataaaacattggtctcttacatttcgagtggttgaagaggtgcgagaaaggagtagaatatagcaagtttagaatggtacatgaagaagatgcaacaaaatgaaacttagcctcatacggccacagtgacagcttcatcaagtgcaatgactccaggaagttcctttccttccaacagctccaagctagcaccacctcccgttgaaatgtggctcataacatctgcaactcccaccttctcaacagcggcaacagaatcacctcctccaataatggttgtaacacccttgccgctaaggtctgccaacttctttgcaatagcctgcaaaagagagctcacagttaagcttgttttcgcaattccgttaagtttgttttggcaattccatctgtaatcaaaccgaatgagagcattggcacaggccatcacctcagttcctactgcaaacttgtcaaattcgaagacacccataggtccattccaaatgactgtctgtgttgtttccagggtagagctgaatgacgcgactgaatctggaccaatatccagacccatccaaccatcaggaatagcagatgctggaacaacctgtagaacaattcaaagtcaaggtcaggtccagtatatcacttcaccaaactttgagctgctctatatcaagttatcgactagacaatatctatgataatcatcatcagtgattacaaaagaataaaacataacagacctggctgttagcatcaggagcaaacttatcagcaatgataacgtcagatggcaacagaagggagacacccttttcttttgcctttgcaaggagagatgttgcaagctcaagtttgtcttcctcaaccaaggaagaaccaacagagagtccttgtgccttgtaaaatgtgaagatcataccaccacctagaagaaggatatcacatttctccaaaagggattcgataaccccaatcttggatgacacctttgaaccacccacgatggcagcaaatgggcgtttagggcttgaaacagctccaacaaggtagtcaagctcctgtgatttaaattaatgataaacattgaggctcagaactttatattgtttttgaaagaaaagaaagggtactctaaaatttctggtctaggtatagctttcaaaaatttcaagcatcagacttgaaaatgtaaggtgaaacggtagtaaccttctgcaaaaggaatcctgcgacagaaggctttaaaaacttggtaactccctcagttgatgcatgtgctctgtgggctgttccgaatgcatcattgacatagagatctgctaaggag

SEQ ID NO: 78250 - DNA, 880 bp, Oryza sativa
caaccctttgttcattgcttatactttttttagtaccaaccgttggaaacaatagagcacactacactccgttgattgacccttcatggctaactaaatctagaatcatgcacatataacaggccaatgggcatgtagagagtctattgattctgttaataatcatctggtaattgattgctctaaagatagaatgaagtctcctaagcatccataagtacaagagaaaactgctccaaagttgcccaaaagttgaatgccagtagtaacacccaaccttggtccaaatttccaaaaatgattcgcaaaagaaacatgggcataagtcagatctctgatgaaagcggccacacctttggggagcgaagcggcgggagagtcggagaccgtgaggccgcagcaagggtgagcgcctgtgcacaagagacatgtaagaaaaagattggattagatatttagaagtaatatctgcttgactaacactgctgcagtagaccggactcgaaggaagagagagagtgagagctcaccggaggaggagagaggaggcggccgccgtgagcttcgccgccgcggccatggccgccatgagagaagcttcgggagtggtggtgggttgcggccgtgcggctcccaggccgcgtgctgggatagtggtgggtatccgactcgacgaccgtccgatctaacatcgacggcccagatggggtaacctagcatttcgaggcccaacaggccgaggctacaaggctaacccacccacaacgaagcccattaatcctttcccgaatcatccctctcggaaaaaatccccaaatcgatccgcctctctctctctccccccttctcgccggcggccggcgcggcgcggcgaggcgga

SEQ ID NO: 78251 - DNA, 797 bp, Oryza sativa
gacgaatcttttgagtctaattaattcgccattagcacatgtgggttactgtagcacttatagctaatcatagactaattaggctcaaaaatcgcgatttctccctaactgtgcaattagtttttcttttaatctacatttaatgcttcatgcatgtgttcaaagattcgatgtgatgtttttgggaaaaacttttttttaactaaacgaggccttatgggggcattttgtaattacgaaagattaggggggaacttttgtaatttgctcgtactatatataatcagctaaggcgaaataactttctgaaatctccgatagccagcaaacaaagcagggcgggaagcaggaggagagggagagaggaagcggcggccatggagggcgggagaagctggagcatcgagagctacctcaacgagtacttcgacatccccgccaagaaccctcccggcgaggcgcgccgccgatggcgccgcgccgtcggcctcatcgtccgcaaccgccgccgccgcttcggcaggttctccgacgtcgacgccatcgacgaagcccagcgccgcaagatcctggttcgtacgcagccccctctccccctcccccggcgggatcgccattcccccccccatccccgccgccgcggttgccccggcggccggcgagcgtggtagactgcaagtagagtcgtacggctcgtacgactgactgttcgtagcatatcgtgcgggtcgctttcgttgaagcgaggtacaaatttacctattctttctcgaattttgtaagtaattttttgggag

SEQ ID NO: 78252 - DNA, 1335 bp, Oryza sativa
aagcccattattctccctctttctctctcggaataagtttacctgaggtcccttaacttgtcaacgaatccgattttcgtccttcaaccggaagaccagatacaacgggtccctcaactatcaaaaccggtgcaaagcaggtccctcagcggttttgatggtggttttggctgatgtggcgcctacgtggccggttgacttggtcctcgtcctacgtgacggtgatgtagcactagaagcaaaatataaaaataaaaaataaaaacaacaatgtggggctcacatgtcagtcagacaaaaggaaaaaacagtgggacccaccatcctctctatccacggcgacgggagaggagcgaccggcgcgtccttctctctccctcccggccatccttcctcgtcggcaagcgcgcacggagaggggaaaaggcagcggatccactggtcgtttcccgccgttggtgttaaacatgatatttacaatgggatttgatccagtgatagaggtgaatgtaatcaacatgagcatgcttaacgtagaataagcatcaacaatcacataataacgcaatgttgacattgcgatgaacattaacagtaaaacttctaattgaaataatgtaagaaggttatacccaagaatggtcctccgctagagtttgaggcagtgttgcctccgttggtgttgtcgggagcctccttctccttgtctccagtgttgccgttgtctccagtgttcgacatgttggtgaagatgaagtagacattgacgaacaatgagtagtcgcgccttgcgctccccaaaaacctgatcacccgcccgtccgtgcaaacgtcgtagcagtgcatggtttgcatggtttcggaggcctactctcccaacgcgtgtgcacacactcgtcgggatgggattattgtagcagcaacagccttggaaatggatgaaagtgtgtctcacttcttcttagggagatcaaatccattctcattttatagaaggaatggaagatgaagggtaagagtcatggaataattaattctcatcaattagccatcaaccatcctccactacacaaccatcaaccaaccattaatgaggagtaattgatgtaggttaccaatggaataggaagaggaatagagcaactaattgtcatcaactagccatgaaccatcctccactacacaaccatcaaccatccatcaattaggagtaattgatataagttaccaattccctagtcaaatggattaattctcataaactcttcatcccattgatatcccataagaaaatgaatacacatgaattcctagcataattcctagcataatgag

SEQ ID NO: 78253 - DNA, 628 bp, Oryza sativa
aagtatgtttaatcccacaaggaacaaaacaatgaaacccatatccctcacaaacaacacagtcaacagacaacattgttgataagaaacccaacgaatctaagagaatacaaggaaacccaacctaaaccaaatagaaaacaatccatctctaaaacatccagattggaaaaaagaaaaaaaaagaaatacatcactactgctttactttaagcattttctaatttttatcacctaacctaaacaagcaagccctacaatcaacggcatgaatgggaaacaacaggtccggttagatttcatgggaacatacatttataaggcctttactttaccctaatccctaaaatcagtgcaaggcaacgatatctgatgtaaattaggttccgagatcaacttggtctgggcgtttgtgcaaggggaccatgcaactgacgggagatatcgccgtcatcgccatggatgcgggagccagtggtcgggtcgtgccgtgcaacggacgccccccgttcaccgaacaaacgctaaccctaggtaccccaaccccgtggattacctgctcgaggcgtcgccgcggagggggagacgaacgaaccgcacgacatgacggtaatcgcaggttgtaatc

SEQ ID NO: 78254 - DNA, 3664 bp, Oryza sativa
acaaaagtcgccaacttggcgggccagtcgccagctgactgctgacccttgcgcgagtacctgcgaattaatgtgtaatattagtgtgaaacgacagatgttacaaattattgtgaacatgtagattttaatgcaacaacggaaagcgtagtgaaagatcttaccggtgaacagcagctgggacggtggtcggaaacggtactggaaagggctgacggaggccgaactgtcgcatcacgcggaaaggggcgtgaggctcaacgcagatgtcgaagaccatcggaaccgtagtcatctagtacgcctggtccctggtagagagtgtggacagacccaacggcgcacgagcctgggtagccgcggcactgtagggctcccacacgacgtcagtcggcagaaggcggtcgaactccataacaaactcaggatacgaccgcctaacctggacgtgagcccatcggcgctgcaatacgagacgatcgatgtgatgtataatgaacttagcaattaacttaacaatacgataagatcgatgcaacgtacctgacgacgtgtcacgcccagaaattcccgaatagaattccaagcagaatgtgcattaaaatccccgtccaggaccggccggggtacacaaatgacaatgttgacattcagatccacgtcttacaaacatcataaaagtcttacataaatgcagcggaaaaaacgaaagacaacaggagctaagccttgactagaactgcagcgggaacaccactccacatgcatcctcgacggcacggacgaagcctactcctcggagaaaccttcatctgacacatactcgtgctctggggttgggaaaaatagagcaagactgagtactacccactgtactcagcaagtcataccggaatagggatatgatgcagggaattatcaaagaagagctagagtggttcatttgcataaagcgagcatttataaacagaagttgaaagttttaaacggttgtaataattaattaatattaactatccactgtccaacgctatcccacgttgcaacaggcccaaccaggcacctaaactatccaaaaacaaaagattacactagggtgagactaatcacggtgaatctggttgaccgcccataactgcgggcacggctattcgaatagttttactctgatcagaggtgtacaactgtacccacaagacacagccccacgacacgtttccgtgcgccgacatgtcaccacgacataccggaaagaggccgtgataggacccttcgcataaccccctctaaccaagcacaccacacctcaggtttcacccccactcctcgcaaggcagcgggcagtcccctctcgtgcctaggtgaatccggaagcgacagaggccgtcgcaggacccgccccgctccatcacgcccacccttgcctggatgcgttgactagaggaaagctatactacaagcccagccattgcccacgctggcttgtggtaagtacgataagttcttccagggcatcccgcgaaccggtccttaactgccatgggtgcgaccagcaaaaccatgcacccacagcccaccatgtgatttattttaattaactaacaccaaagcggtggcactaatccaacaagaccattagagccaacagtctaaacattaataagatcttccccattgtgcactagttgaactaagcatggctaagcaatccctagtccaatctctagtcatgttataaccccaagctgacaaagaaacatggtacaacaatagcatggctatgacaataggtaaacaccccatagaaacattataaaacaatgcaatatttgaaagaaaacaatagagcatttgcaatataggatcaacatgttcaagtgacaagcatgacttgccttgctctgttgctggaggaacctcggcgactatttcgaagtacaccggagcgttagaggaaccagaatctagcgacatacaaggcaaacattgcaaacaggctataagactactgaaacagggaacaaaaccatttttaatggattctacacatttttcttgatttactgagacttgaatgggcttaaacggagctcggatgaattagttatgagttttagaagattcactgtgtttattactataaaagaaaaaccttaaatcatttattgcgcaataaatcccagggctgacgtcagcacggagggggagcggcgccgacatgcggggcccaccggtcagcggctcgggagagggaggaaggggcgccggcacgcggggcccactggtcagcggctcgggggggggggaaggaaggggcggcggcgacccggctcggcttggctcaaggccggccgaccggccgcggcgacggcgacggcacgcgcacacgcgaacgcgttgccggcgacggcaaccggcggcggaggcgacggcgcaaaggcgacgcgaaggcggctgcgctaagcgacggctaggaaggagagggaggggaatagatgggagaggatgcctcaccgagggtggccggcgcggaggaagacgatggcgaacggcaacgacaagccacgggaggacgacggcaaccggcggacgggcttcggggtgccctaaggaaggaagagagagattagagagagggagatgaaccacggcgaccggcattcatggccgaaagcggcggtagcggttgaactcaccggagcgcgaggggatgctaattccggcgacgaaactcgacggggaaggggcagccggggtggagcttagcctcgtgaacccgacggcggcgacggcgcggtgcggcggcgaccctagcggcggctagcggcggccggagtagcggaagcggcgtcggcgggtggttgccggcgcgggagcgatggggagcttgggagagttcggcgaaatggggaaaaagcgacagggggcgacggggaagcctaaataggggaggagagccccggacgtggccggtaggggcgaaatttcgccggccaacgtggggagtgggggaggagagagaggcgggattcgaaaatcgaatcccggccatctcgggcgcgggcgcgggcgggagagagaggggagtgggcgcgggagatgcggcgcacgcgcggacgtggctgacgtggcccggagaaggcggaggcgtgggcgcggcggcggttgcgggcgcggcggcgccggctggaggaaggggacgtgtccgacaagtggggcccacctgtcggcgtcccggggagagagggaggggcgacttggctgggcctcggcctgcggccggcccagcagggaggagggagagagaaggagagaatgggccagcggcccattcgaaaaagggagggaaaaagaaaaagaaaaaggagaaaaggattttcctggaattaaaatattgcttgctcaattttagttggttaaaattatttgtagggctctgaaaattccacgaaaaatcctgttagtggatttcgacatgtagaactcaagaaaaattccacatgccacttccgattattatttgcattgatttaaaagggtttactcttgctttgcaccggtattttcttagggtcgcttataaattaaatttttggcttgggaggagaacttcggggtgtgacacgacggcaccacagagtacccatcgtagggtagtcgacct

SEQ ID NO: 78255 - DNA, 607 bp, Oryza sativa
aacacgattcacaggcatgatagttctgtcagaaaagatcgaggacaccattggtgggataaattccgatcatacaggactgacacaagaagcgaggagttctattccctgccgttcaacctgaacaagttcttcccatcagtatgagcataccgtggctaatgcaagagtaggttactgtgtactgtctgtcccttatgaacaggtccctggaagtggcaaactgttggcctgaattctctaggtatgtggaaatcgtagacctttaaacaaaagggaatcctgtggtatgaacaaaaaaatattggtggaattatggcacggatgtatattttaacctatctgggggcaatagtaggaaattttggctactcatttgcacatgaaaatggctcttgattcttacatcatgtgggctatctcacctagaaaggagttgaatggattgacaacgccattttaatactacctctatttttttttgtttgacgttggatgtcaaataaagaaaaatggaggaagtatcattgtatgatcataccagtgaagctaaaatctgtatgtaggctttagtatacaatggaatggtatctaatattgtggttgg

SEQ ID NO: 78256 - DNA, 21591 bp, Oryza sativa
agtatacagcaagataggatcttctaccctttttaacttaaagaagtcaagggggccccttaattgtccaaccatctcggatcatcggggcatctgacctgtaaaagtatcaactagggtattatcgtttatcgggatcaatgatccaccttcagtaggaatgtgacaggaacctttcttgggaggggcaaaatatttatgggtgaaatctttgccttcgggccggcaacgatgcctgtgggtgccgttttcctcttggggcgttgctgcataatctcatctctcccagttactttcttcaggtgaaaacgatgtcctgactccctggggcaggcggtggtaacgctttcggtgttgttcccttcttggaggcgtcgcttcgaagatctttcattcttgtttccgctatcgcggcatgtgttgtcatagacgcgcggtgtggttgttttttttctttccttactatagtttttcaggactatagacttgtatatttctcatgctttatcaatacatgaaactcacactgtcttgtgcaattcgttttaaaaaaatgatccaccttaattgtctggccaacttgaccatcgatttattaatccatccatcacatatttctcaagactaaccatccagcctattgtctaacatggacaaatcatcctgacaatgcaaattttagtatacatctcaattaaatcatacttcgatttatttttacttgaactcttattttggggaaacggattgtttacttcaacctgttattgggcttcaactgactagaattgagctagacaagtctaccgtgaatcattactagataaaggaaaaacaagcctaactgactattgctgcttctgcttttattactttttttggggggaatacgcaaggagcgcatctttgtattaaggagtaataaaagttatttacaggaaaaatacaaatgtggtgaaggggacaagatacaggaagggaaaaaacgaaggaaaataaaatctaatctcgcaaaaaacttctgcttttattactgaaatttatttttgaagtctcgtcaaattacatccacgagtgaaggccaaaaaaacaaggagtgtagttgtgtagatgatagtagtaattccttttgccatcaacggtccccttgagaacataaaattcatgtaggttattttattatttgatagcacaagtagattgtttttgttcttttcttagagatgcttctttttcttgtccagggaaaagttcaggttgtaattaacgtgcacaaggcagcgctgcaatttattgatggtgtggtctcaactaattatttctggtttctgctcttatcataatcacaatatgtcatttcaccttatatctaatgatgtaggtgtaaaacaatatcatctacctcctgaacttattgaagaaggattctgtatcagcccagatgaactagcagcaattgctaacatgcgtgaagattatacaatgctcaggatgcatggtggaatcaatggaatatctagaaaaatcaaagcatcattggaagatggtgccaaggaaacagatatagcaaccagacagatgctgtatggagctaacaggcacgctgagaagccccctagaagcttctggatgtttgtgtgggatgcattgcatgacttgacactgattattctagtggtatgtgctctggtttctatagtggtcggccttgccaccaagggatggccgatgggtatttatgatggttttggcataatactcagcattttgttggtggtactagttactgcaaccagtgattaccaacaagctcggaagtttatggaactggaccgtgagaagcaaaaaatatatatccgtgtaactagagataagaaaacaaaggaggttttagttcatgacttggttgtcggagacatcttgcatctttctataggcgatgtggttcctgcagatggtctgtttatatctggtgactgcctaatgatagatgaatcaagtttgtctggtgagagtgagccagttaatatttctgaagagaggccttttcttcatgctgggaataaagtagtagatggggcagctaagatgcttgttactgccgttggtacgcgtactgagtggggcaaaatcatgggtactctgaatggagatggtgtggatgaaactcctttgcaagttaagcttaatggtgtggctacaataattggccagattggattggtgtttgctgtgctaacatttttggtacttctagcgaggttcttggctgacaagggaatgcatgttggtttgttaaattggtctgcaaatgatgcattgacaatagtcaactacttcgctattgcagtcacaatcattgttgtcgcagtccctgagggtctaccattggctgtgactcttagtctggcatttgctatgaagaagttgatgcatgacaaagcactagttaggcatctcgccgcatgtgaaaccatgggttcagcaagttgcatttgcactgataagacagggactttgaccacgaaccacatgattgttgataaggtttggattggtgatgtcaagtttgttggggacaaaaaaaattctgagctaaaaagcacgatttcagaaagagttatggcgatccttatacaaggcatatttgtgaatactgcgtctgaagtggtgaagggagacgatggaaaaaataccatcttaggcttggctactgaaacggcattattggagtttggcttgagcttggaagaacatttatatgatgactacaataagttgactagaataaaagtagatccttttaattcagttaagaaaaagatgtctgtgacaatacaattacctaatggaggcatcaggaccttctgcaaaggtgcgtcagaaattattctggaacagtgcaataccatccacaatactgatggaaatatagtaccgctgtcagaaatgcagaagcataatgtattaaatataatcaattcgtttgcttctgaggcattgagaacactttgcatcgcatttaaggatatggatgaatttcccaatgatcaacctatatcagatgatggttacacactaatagcagtttttggtataaaggatccagtccgtcctggtgtcaaggatgcagtaaggacctgcatggctgctggtattagagtaagaatggtgacgggagacaacatcaacactgctaaagctattgccaaggaatgtggaatattaacggaggatggaatagcaatagaaggacaacagcttaacaataagagctcagatgaactgaaggaactcctaccaaaaattcaggtttagttgtactctcttgttttcttttcattaattaaatgcgaatataagctaaatctatgtcccaagctcaggtaatagctcgctccttgcctatggacaaatacaaattggtgacaagcctgaaaagtatgtatcaagaggttgttgcggtgactggtgatggaaccaatgatgccccagcactgcacgagtcagatattggactagcaatgggtatcactggaactgaggtatctatgaatgtttttcggtaatttatgttgttttattcctctatgaccttaatatgttcggtttgagcgtgtcttgaagtgagaactgggaaatgccctttagtctaaaccaattttctacaagggcttatctatatcctgacttaataataatattagctgtattttttaaaaacatattcctagatgtttaatattgtcagtgctaaaaaaaggagcaaacggtacaaaaatacaatttaattattttgcataaggtcgatttccttggctgtaacagtattcatcattgtttagtgacatttgattttccgtgtatgatatatctgtggacaagttgtgatgcaagttttatctgtttgcaggttgcaaaagagagcgctgatgttataataatggatgacaatttcgaaaccattgtaaatgttgctagatggggccgtgcagtttacttaaacatccagaagtttgtgcagttccagcttacagttaatattgtggctctgattgtgaattttgtctcagcgtgcatcataggtattagcacacttgctaccactctaatattattgatctaatgatgactgtttgaaatgaatgtgtattgttttctagaataaattcgtatgcattttatttggaatgcatatgcaacttatgatataatatttcctttttgctacacattttaataataaagtcatatatattgttattatggctggaaatagaggattgatagggtagatcgccctcaagtcgctggcttctccggaagaccgaggctttgatctgtttgacttggtgggcaaaatccttaatttctttattgcttaagtccctaatacaatagcaggccccctttatatactaggtgccagtctaatatttaggaaatctaagacaaactaggaataggaaacagaatcctaaaccaactagaattagatatatctactgattattcctattcctattcctatggtatttgattccataacgccggtctataataattgtcctctcttcttccctttacttgaagggagtgcaccacttactgctgttcagttgctatgggtgaacatgattatggatacgttgggagccttggccttagccacagaaccaccaaatgacgaaatgatgaagaggccccctgttaggcgaggagataattttatcactcggattatgtggagaaatattcttggccaaggtttgtatcagctccttgtgctggctactctaatggttattggaaagaaactccttagtattgaaggtcctcaatctgataaaaccatcaatactctcatattcaactctttcgtcttttgccaggtatgtgaactacaagtcccttttacatgcaaatgagtcaattttgttgtttttgtctatggattttatttatgtttgatatttcaagttctcatattataattgacaggctatcatttacattattctcggccatttcagatgtcatgttcactttgtagaggctaagacatttaattctgtgcaaagctcattgacatgtgatatctgataataattttcaatatgccatggactctctgatgacttcagcaaaccatagaaaataatcatgtagtaatcagtatatgtttttccattttcgttagaaaaacgatccagacaaatttaataattttcagaacaaaacaaagctttttccgtgcgcatttcacatatcctgatgctatgattctataaaatgcaagtgcaaagtaaaggcaatattcattaaacaagtgatctattgtggaaattaggaatcagtgctttattttaatggtaattttaccatccttgagaaggtatcgggaggtaacacattttctagtgtaaaatttggtacattcaggtactaaaataccttgagtataaaaaacttttgtgtaaaatttaggtaccttgaggtactttctcaaggaaggtaaaatttctcttattttaacggtaagtttcatctgacatgttaccatgcttccaggttttcaatgaaataaattgtagggagatggaaaagatcaatgtcctccaaggtatcttcagaaactggatctttgttggtatattgacagctactgtcatattccaagtgatcatagtagaatttcttggcacttttgcaaacactgtaccattgagcggggagctgtggctgctcagcgtcgtcattggctcaattagcatgatcatctctgttatcctcaagtgcattccagttgaatttaataagacaaatactaaaccccatggttatgagttgattcctgaaggcccagagattctatagcagtttcacgggaggtgcggaaattccgctcaaactgcggtttctgcggtcagcaacccaatcaatcataatggaaaaggatgcactgtaaggatttctctactgatgtaattttgttgaatatgatcatgtgtttctgaacatgatatactgaagagttgaagtagatgttataaccagcagatatgtgatgaagtatacggaataggaccaatcatgctgcaagatcagacagcctacgggatttatggtgttgattcaagatttcaagtagatatggctgctacatgagaatgtcgcagcaaatgtggactgcttggaggcttcgttgcaaagcgtacagtttgagctggttctgcagagttcagcttgagatttgagcgtacagttttgtaaaattgaactctaggtactaacaactgtcgaaatggtatcatattattacccttcgtgcttttctcttcagcggtgaactgtgtataacgtgtaattattcttttttatgtataataaagcaaattgtgtgtaactattctttttatgtataataaagcaaattgtgcgtaactattctttatgtattctttgtgcataagaatggatgtcctacatgtgaataatgttgtgttctaaggtgaagttgggaaccttcccttccctccccgcacggcaaacgtggtatcattaacacgtgattaattaagtattagttaataaagcttaaaaatgagttatgagcttttaaaataattttcttatatgtatattttttaaaacgtatcgtttagcagttcgagaaaacatacgcaagaaaaaagagggagaagttgggaatatggacaatcgaacatagggatgaaaacggacggaaaccacctttatcattttcgtttttgtcgacgtttgatgtctcgactacggtatttggacagtatggggatcgtcggtgctaggatatatgcgagactaaggtaaaagagatggagacagggatttttatacaggttcgggcccctgagttgtcaggtaataaccctacatcctgttggccgaagccggtattgctcttattcaccataatcacaccagtacaatatgtgggtagcctatctaactgttgtcgacatggcggtctgaaggtctgactcgtagtcgacaacagggtagccttcctcctcgagctcgcgcccgatggaatcaaagacagtgctagatccctacggccggcctctgaaggtaccggatagggtcgatccaggcgtatctctgatgtcgatatccggcggcttgtcttggtgtatgtaggcttctatgttgattgtgttgggagttgattgtctcgtggtgggtgttgatcgtctcatggtgggggttgatcgtgttgatagttttgatcctccatggtgggtgtgtgtccctctgtcctcctaggggggcttgtatttatacccatagatgtccccttgtccaagtagaactagggaaaccaatatggatacaatccgagtagtccttgtcgtttccatgtagaactctgattgtctttccttatccggaactcctcctatatccgaaggttgcttccgtataggacatggtatgtggtgtatcttgccgagatttagtcaactactattaggtatgtagtatccataaccctgacagttttcatattttttttcggaatcagaaatcgtagatataaaaacggaatcgaatattatcgaaactgaaaacggaacgaaaacaaacaggtgcgaatatggtaacaaaattttatcaaaatacaaaacccctcaaactgagcttcaaactttgtcaagttcaattctcaaatctcaatagtaaacaattcatcataaaacacaatcatatcaagtccaattgttaagtctcaacagtacatcataaaacacaatctatgaaataaatgatctatgtctaagagagaaatattgtcgataaatcccaatgcaagaatttaggaattgggccaggctattattgtgttgtatgggctgtgctacaggtatggagggtatggaaattccgagaaaatttttagaaagtttcaactgattccgagttcctacgaaaactgccctaatcatatttgattctgtttccgagaaaatatttcccaattcgtttactttttcgaaaaattctgaccgatagattctgtttttgaaaatagctttggaattcaaaaagtttccgtaccgttttcactcctaatcgaacatggctaaagggttagcgacaacaaaaacaagcgggaaaaactccatagcacaaaaactcgcaggtcatcgactcaccgtgctaagataaaaacaaaactaccaaagaaaattgccaaaaatccatggcgatgagaaatctaaaataacctgaaatagtgaaatgtgatgggagtcaacatggtctgaacagtgcaggagacaagaaagcaagtgtaaactaaaatcttggaccagaaaatgatcaaatcaactcatctaaatttcatcctccatacttctatttggatggccatccaaaaagattcacattctatataacttttcactccaacagattatccatattatatcctacatataccaacatcctatattttactaataattttcaactactacacatttttactcctacttctctcacctttcaccacttaaaaaaatcttggtaagtgggtagttgaggatggagtgaggagagagaaactctatatttggcttgggaagggctagatttggaggacctccaacaatggagtatgtatgtgatggagactctactggagcattgtttttcttctccatactctaaatatcagatggatgactagatagagaagctgctgggatgctctaacaacccaccacaatcaagcttaacctcgctttagaaaacgcttttggatagcatgctgccgctaaacgcaatcacaatcaaaagccaacccttgcacgcccgaattaaatcacccggttggtcacctgtgcagcagctgcaccgccccggctcggaccagccccacctactccaccgccccgccggttcattcatccacgctgacgctgacgcggcgagaaaccacggcggaatccgcgccggctccacctgtcagaaacgtggcgtgggtaagcccaagtttagttccaaaatttttcttgaaacttttaatttttccatcacatcaaaactttcctatacacataaacttccaacttttccgtcacatcgttctaatttgaaccaaacttctaattttggcgtgaacaagggaagaaaacggataatatgcgacttgattcgcgcgatttggataaaataccacccctgtatttgtacatgataaaatatcacttaatatattgtcttccaccttccagtgaaaagctttcgaagaattttagcccaaaaacatccttggttgtggagagagaaggaaaggggagggtcgagccggacgaccgtcgtccccggcggtggcgccgctcgtccgctcgcttctcaccgtcgatctccagcgccgctcgggcgctcacgacttgtcacccattgactaacgcgcgccacccgaccactcactgaacgtcgcctccagccgtctctgtgagtaggactaggtccagcaatatggcacggtcattgtccgaccctccagcgctcctcttttccctctttcttttcacaaaagagagcattttgatctaaaattctttagcgttattttaatcgggaaaaatgtattaagtgatattttatatgatgtattttattatctgtatctacattttatcgaaaccacccatattatccgttttctctacccaacaaggcgggtttacggggtccacctgtcggatgcctgcatccgtcagtccaccggtcacccgctcgtcagaggtaggtcgccgtcgccgcgtccccctccgccgccggctcccgtcgctctccggtctcacgcgccgcgcggccgcagcagcaacaacaacaacaacccgttttgaccgcgccttcctcctccgccggcccgcgcgctcgccgcgcgcggccgccacgggtttctctctagaagccccgcacgaattttatccgttttttcgcattctccccgcctcatctcctccttgacaccgacctctcctcctcggctcggggaattcaaacgcgcggcctcgccgggtggcctcgcctcgcctcgccgcgttccgacagcgagtgccccgctggtgccactatttcttgccgccccaacccctcgcatcgatcccccacacccacatctcgcctcctcttcctcgatcctttgtcttcttgcttagctagctctgccatggtggggagctacgcggcgggagggggacggggagcggcagtggcggcggtggcggaggggaagctggacgagctgcggcggaggatggggaaggcggacggcgacctgctgaggatcgtcggggtggggggcggggcgtgggggagcgccttctgcgcgctgctgcaggacgcgtacgggcggcaccgcgacaaggcgcaggtgcgggtgtggcggaggcccgggcgcgccgtcgaccgcgccaccgccgagcacctcttcgaggtcatcaactcccgggaggacgtcctccgcaggctcatccgccgctgcgcctacctcaagtacgtcgaggcccgcctcggcgaccgcacgctctacgccgacgagatcctccgcgacggcttctgcctcaacatggtcgacacgccgctctgcccgctcaaggtcgtcaccaacctgcaggaggcggtctgggacgccgacatagtcatcaacggcttgccctccaccgagaccagggaggtgttcggggagatcgggaggtattggaaggagaggatcagaccccccgtgatcatctcgctggccaaggggatcgaggcgtcgattgaccccgtgccccggatcattaccccgacacagatgatcagcaatgcaagtaagttctttgctctcgagtgagtttgattatcatatccatttttactaattagtttcaattacagtatcaaatcgattattcggttgctattttactactattttcgttgatcgttgtacttgtgtccttgtgggaataatggacacataaagaaaaggtagttgctgctgaactgggaccaagatacatacctccagaatattcttgataaaatgtgcaggctattcttgatatgcacctaatgtgatgtccttcatgtttattgcaattattatacccaacacaatgtctattgttgaatgttatgagagctagttaaggccttcagtatgtgcccatgtgctatgtttctttgcaattcctttaggggtaatgcatcttatttttagcagagtttatccaaattagtacccagtactgcacgttccgtgtcacgtttctacccagtattaacttctgatatgctcctaagtttttgtttcactgtataattgattttaccatccactggtcttcatctttcctaccatgttgtagcctttaatgttttttgtttcttatgatgggcctattgcagctggagttccattggagaatattctatatcttggaggtcctaacattgcatctgagatatataacaaagaatatgcaaatgctcgcatatgtggagctgacaagtggagaaaacctctagctaaatttctgaggcagcctcattttattgtgtgggataatagtgatctcatcactcatgaagtaatgggcggcttaaagaacatatatgccattggtgctggtaagttccatggtctcatatctgacgttttatgtccatatcaccttgaaaatttttaactgggaaaataaaaccatcatgtggcttttcttgttgaagctcacacacaatgcttggcaaaagtatgaccagttcaaacaacgaagccataaaattgttatgtttgcataatgctgaatgctatctgtcctgtaggaattgtattcagtatacgttgaattgctattatctcttatgtcaaacgcaatgctgctttgacatttcatcaaacctatcatagattagaaagagtaaatcaggtcatcttgggtaatgaggttcccctatgcatacatattcgttataaccttctgcattaatatagaggatcttgatttaagtcatgttgttaaataccttgttatcttgtaggtatggtggctgcactaaccaatgagagtgcaaccagcaaatcggtttacttttcactttgcacgtctgaaatgatatacatcacccatctcctagccgaagaccctgagaaacttgccgggcctttattagccgatacctatgtaacactgctgaaaggtcgtaatgcatggtatgggcagaaattagctaagggtgaactgactcttgaaatgggggacagtatcaagggcaaagggactatccaggttggtgctaccttcttaatgatgtaaatctttccatacttctgggtgtgtttttggtgccgaatagccatgtgctaagatttgctgtgattttatctttagggtgtctctgcagtccatgcattttatgagctcttgagccagagtagcttaagcgtgacacatccagaagtgaagaagcttgttgctccggtcgagctgtgcccaatactaaaaacactttataaaatcctaatcaagaggttggtcagattacctttgttgctgttcctgctagtactaatatatgtgtacaggcttaagttctttgcacatttcacctgcagggagcttgccactgactccattctccaggcaatacgagatgaatcaatgtatgatccacgggagaggattgagatgtctcagcgccagtgtctttaccgaccatctcttcttggcctacctaaagtagatattacccaggcttagatctattcttttttttttctgcagatttgttttgagatttgcaggattctttgatgtattctttgcatagtggtcctcaagatccttccttgtgtgccaagtgcatctcgtgttcgaacactgattccattctctactagagaatttgataatgaggtgttttggttttttattgtcagagttccaaatagtttcacgggctgatgccccccacatgtgtatataaagtacaaccactgttgattcaattgtattgttgctcctttagagcctgttcactttgatgccaaaaaaaaaccttaccaaattttggcattgccgaaattttagcgtagttgccaaaattttagcaacttgccaaaattttggcaagatttcttatatagtcaccaaaatttagtagcaaactaaatataatcactttttttagcaactttaccaaaatttagtaaggtttaaaatggcatcaaagtgaacaggcccttaatatatttcttaccattgcagggaacggatacctgctttcttttcttattacttatatagatacacagaagatgcatacgttcccagttcacctacgcggtggttcatgcgtcttccctgtaatcgaaaggaaaaaaaagggaccatctacaaaaccgctgcaagttttttaaaggaaaaatttttaaatctaactataatatataattgtaatatacttctactataactataatataagtattaaaataatatatgcaacttgatggcctgttctgattgtaaccaaaataaaccttaccaaattttagcaatgctaaaattttggcaagttggcaatattaacaaaattttggcagaatttattatgtatttactaaagtttggtaacaaactaaacgtagacacatttttagcaactatacaaaaaaaaatggtatggttgaaaataacatcaatctgaacagcctctatatctaacttatatagagattataatatagttacaatataactatagtgtaactatagttgcatttgatttttttttcaaaaaaaaaaacttgtgacagttttttagccattctgataaataactactgttcatggtttccttggcccatttacggactgtgaaagcaaaaggaaatgagaacatgaggcccgtttatcggtctatggctagctaatccatccgtaaacaacgttagccggctagcccaactaatggcccattgcgccccgtcaaagacaactttaagtgttttttttctctttttcatctactatctttgtgattaataaataatatcgttgacttttaaataacatttgagtattcattttacttaaaaattttacgtaaatatgctaaagtgtaagttgtacttaagttttatttaatggtaaaacatgtcacaataaattaaatgatatttatataatttttttaatagaacggatgaccatatgttatgtaaaaaatcaatgacgttacctattaaaacccagagggagtattagaagtgagcatgcatagtttcagcagtgcagaaagtaacaaggaaaacaaattaaaacaccatacgactactgaagcctgatttcctaataaccatctgatcatctcctcaggctttacatccaggtgccatcatatcccgtcttagcagctaaaacctgggaggaaaatccacatgagggacataattaaaaagtgatgagcaatgctccggtgctttctacttggagtattatactacaagtaaaattaatctcgaccgttcattttaaagggtagattagtaatctcctaatatatattaggggcaattttggcaggatctattttctctgtctcggtcggtcttggcttgatcgcatcaggtccgacgaaaagcaccgcatctcgcccgacgcacgttgcttatcgctactcctcccggcacgccgtggcgcggtgcggcgaaaccctcaggcgtcccctcctcccacctctcacctgtctatccgttcctcctcctctcctgtattccacgtcggcatcctggttcgccatcgtggccttctgtccgctgcgagtggccttccgcgcgcgtccgattccgccggagcccctgcgcaagacctgagattcttggcagcgcccactttggaggattcaatccattccgccggcgggtagtgatctccattccgtgttgctccgattgtgtgggctgcggccacttgggaggcagctgcgatacattccagcgccgtatccccggtccccctccgtgcgtgcccgagtcttgtggcttgcatcggcgagcacctcctcgaccgcgagcacggcatgagatgcagaatatgcaacagtgtcgctcgctgcgtgttgccgtggaaggcgtcgccggcgaacctgatagaccgcagtgctcagaggtttcagcacatccgtgctcgcggcggcgtcaggacactggatcggacgctgaacgatgcatgtggcatgcccgatctgctagctcaggatggtggccggcgactgtccgcacgctctcctgcgggcatgacttccacgaggattgcaacatcgcgaagtggctccgtgacaacaagaaggcctgcccagttcattctgcttgtaatattcagttgtatggtgtgtcgaatacttcattgactaattgacgagctttgagatactgatgtttattggatcttgtgactgtcccaatatattcattgttcagtaatggtttaagtaaaaaagaaaaggtgaatagtgatggactactagtaatgtcaatgtgttgaccatgtcagtgtgttgtgcattttttttgtgtgcaactgtgatggggtgagatgaatccaagcaatttgaactgaaatatgtcatcctgctcctggatcagtaaacaagttgttttgctcctgaaagagtgagactgaaaaaatctgataaactgcttaaatgagatttttcactatcagagttttgcccatatgtaaattgcatttcagtcagagctgtaattcaggatttgttttatatttcataccatcgaaacatctaactgcattctgtcatattctggcgctctgaatcatcgctacatgattcctttcttgtgctcatatgggggtagctaagccctcaattgccactaaattgattttttttcagtcataggacaatgtctactaatgggggcttagaacatcttgattcactctttgctgcaaactccctggtctactgtcgtgtttatgcaaaagcatttgcattagctccgcggcagcttgtgaagtcatgcacagtccctattcatgtagcatccaaacacctcattcccaagtcccttagccgctcgtacggtcgccggcggcgaccaaatgccaccgcctcactcgagctccgccaccgcacgtcgccggctgccatagctcatttcttggccaatccgagccgtccaccacatccccatactacactcgttcattcccagttgcccattcctcctacctcgccgccgttcgccggaacccgttgaatttcgtccgccgtccaattgcccggcgatctcctgtcttggtcaaagctacatggcaggactagtcgtccgccgtgggcaaggaccttcagcggcttggcgaagaggagaagggccacccttggtcgctggagggggaggagatgtcgatcgcgctggaaatgatggaggcggagagggagatggacaagcgacgaagtcaacgatggatggggtcaggcgcttgagaatggcgaaggtttagagttactgaataataatttacgataatacccttatatgaattattatctatggacaaatatacccctccacgtttctactaccactatgagtggtggtagtagaattagatctcaaccctacgattatatacgatcaacggctcggattattttctactataagtagaaagcaccggagtgaggcacaaaagtgattacacgttcgtcccatataatttcttcacacacaagctaaactagctaattattaaatgcgcgtgatcatcctataattgcacgacaaaattatctatattatcagatcggatggaaaatgaccggatggaaacggacgtgtccatgatgatcagtccatcaaactagctgtttcaatttgcatcgttttcacgtactcacgctcacgctcacgggccctcgcctttttcacagggagaaaactgaaaagaagagctcctggatgtgctcatgtgacgaaccctaatttaatccgacgcgttaaccccaaccaacaagacaaatgcacgcagagtcaatcgcccgatcgaaaacagcttcccgccaagcgcctgaccgatctctgaagcgaaagttgcaccagcagctagctatagctcatttaatcgtttctgcaagaatttgacatttttggggatcgagcagatgaaccttttttttttcctgatgttgtgtgttcacgtgggggaaaaaaacatttggtggggttgatgatcatgtagtgtagtgtttggagagccacagctgtcggatctaattctctcgtaatgtcggtcgcttgtgcctcgagattcatgatacgccctctgttcctttcgtttgtaacttgacatagttggccagtgtgatttttctttttttttttgcaaataaaacttttgaattatgttgtttttatattttcaccttattaggcaccagctgaccagcaacatgagatgatttgcctgccaatctgccatgtatatgttgctgacctgcctagtactccattcgtcccaaaacaagtcaacatcgtactacgatgtgacacatactaatacaaatatagagtatatccagatttattgtactataatatattataacttaatatgatattggtttattttgagacgaataatgtagttgttacgaagagcatttatcatgtctggaattgaattcctgttgcgattttacaactagttagcacacgcaaagttttatatgttcttatgaaaaatcaaatcactcgcagcaatccaaagctttacactgaaactactcctaaaaatctatgaatcgatacgccgcgtctgaatccgaacagctgccgtcttacatatgtcgggctgtcggctggattatctttggatgcaaatatataagttatctctgctgtatcagagagcaagccaagctatctatgttgtccttgcgtgattgtacaatctaactagattagattaaccaagaggaaaattgtccttcgacaagctagctcaccagcagcttaattagctagctccatctgcatcatgggcaatggatgcgttgcgtgcagatattctcaacgacagatcaaaacgaattcgatcgtgtggtagccaaaaagaaatatcggttttacactgccggaatatctagctataggacatttcttctgcaagtgaagttaatcaggttgtccaaaaaaaaaaggctatcgtggtcacgggaacagacgcctgtatctcgctgtctgaatttttcttttctgacgaagaacaaagagagagaaaaaaaacgcgagcagagtatgtggttttgtgaattgaggcgccgattttccgtgaaccatctactgtttactcaagaaaaaaacgcaagaagaacatgtttactctcactttcacctaacgccattccagagcaaaagcgtaattaagatatgtttatgtccttaaaataacagagagtgagaccagccgacaggccatcagttttattcttgtttaaccattcatgcagttagaaccagctggatgaatattcagatacatgttgttaccgtaccttgtaaaaaaattgggtttgtgttactatttttcttacatcgggttgctttcaagaagtgcttttctgaattctgggcctcgtatgtaaacgcgttgggggatagtatgtgggtgttcgttttcgtcttctcatggtgaatgggatatattacatttatttatttttgagattacatgtttgtcttttccaataccatatcatagaacttgataagcctaggatacaattggaaccaaggaatttttttttcccgatcgcctctctatacctcctcaaaaaccataaatcgccattataactcctttgattggtaccactcgtccactgtgacgtgatacctactgcatgtgtataagatatcttcgaggtattatatctgaagggcctaaataaccttgtttttgctttaatcttaatctagcagattttcttgtgcaactttatgtggagttagatttctaaagttgaattggatatacaactctaatgtcctatttcatcatagatataattgtattttatatacaacatattttaaaagcataattggatttatcctacaaccccttctatttttattggtacaattttgtattttatttacaaacatcaatcaatatcaatgttataatttgaacccactatgatctataacaatgtaaggctgttgtggttggaaacaaatccctcccgcacgtaaaatggagcgatccattagcgcgttattaattaagtattagttttttttaaaaaaaattgatcaatatgactttttaaagcaactttactttagaacatttttgcaaaaaacacacacacaatttagcaatttgaaaagcgtgcgcgtggaaaacaagttgagtgagtcggaaaaactcaagtgttgaactcaacctagatctttctctttttttccccgattaagatactcccttagttccaaaataagcgtagttatgagtttccgtgtttaactttaatcgtccgtcttattttgagatggagaaagtagtaatttctaggtctccaagccaacatgatgctcttttatatctttcaagataatacaaatgtaatatagtccatccgttaaaaaaaaacgaatataggactggatgtgacgtatcctattacaacaaatctggacagagacatgtccagattcattatattaggatgtgtcacatccagtattaggttagttttttatgggactgagggagtagtagttactccctccattccattctaaattgatctacatatttcataggtacaccaagatcaaaaaaactaataactctctcatactatatttactctagcaacaaactcaatgcatgcagcatccccattatttcttaaccaatagcaaatctaaatattgtatgtgggtaataaatacttgtgtacatggatgcatgtatcaatgtccatctactctaatccacaaataacgaatagacttaatgaatgaacacaaatatgtagatcatttaggaataacctcaaaaaaaatatatatgtagatcaatttagaatagtgggagtagtagataaattttttaagttaactttatctgaaaaaagtttgatcagagttgctagacatacgagggtagcgagagtgtcaactgctacaatacatgcacggcgaacaaaaatcaatgcaattagccacaaagcgagaatcgagaagctttctctgctgcggcgaggttaatttaccgtgaagcaaatggcgatcgatctgcaggttggtgcgttgcgttgcacctaatcagattagcccaggccaaatagtaatacgtggtacggttgatgaggatggcctctaattaatagtgtgtgttgacctcttgactatattatgtatcgttggaacttgggaaccgctgatgtgatctgtttttgcagtacaggcaccggctttggtgacctaatatttgtggtcgacgattcttaattatgtatggtagtacatacagatatctgcattaatactctttattagtactgtatcacaaaatttttagattatattcagcacattcaagtaccagcgaatatcaaatatagttagaaaaaggaaatttggaaaaggagaacgataatctatcttcaccttgtgtatagcagatttattcttttgggggggttggccgaagacaaggttgatcaaatttcataaagacaagaccggatgggatgagatttgattaaaaaaactgcctgtaaaaagaagtacatatgctactagtgctgaaatttagccattagcttcttttttttaaaaaaaaagaaaccttcttgcttccacatatttaattttagagaactgcaacatgatatagcatagacctcttttgaaatgcagaaaaaaaattacataacttttacaggaactaaacaatttttcacaaaacaaagacctttgaaaacctccattgcgaaaaaaaaatcatagtataattttcaatgtttgtttgcaccgtgttttggagggagctgagtgtccagtttgtccacggatgtaccaccaaacgtgtaatactgtgcaccgaaatgaatgtttgcatacgacacacatgacgtctgagatgtacgtgtcaaacaactcggtaaatggacgaatgaaacgtgtgcgcggtgtgccagacaggtcaaccacatgaaacttgactcggtgaatacgtgcacgtgtgaggtcacgtttttgtgtgtcccaaaatccacaaaaaagtaagaacagaactacggtctgctagtaaatgctgaccttatatgcatacatgcaaacatggtaggagtacacagcaacaagagacttgttagcaaggttagccataaaagtgataatgtgtgccagctcgattattttgcgactacgtggaagacgcacaggccaggaaacgccgatgcttctaaaatcggccatatctgatgttaggtttttgggct

SEQ ID NO: 78257 - DNA, 2321 bp, Oryza sativa
gagatcaacccatatttatgcagttagttgtttgacacgaacttaatcatcagtagtatagtgcactactgatttgtgctgaggtgaaacaaaattaaatctttttgaaggtgcaaccggctcatatttctctgtacggtccagtagtaggttatattatttgcaatcgcttcaactgcagttataattcaatactccggcatgatccactagataatctatcagctcaagatatatatagaaaaaaaattaagacgcaaagacgtcttagttcctccttataatgtcaacaacccatggctagtcagaatcattatactgtcgacaacaggacaatgttcttattcccatgtcctttgatttcaacatgtacagaggtacacaaggactatatgctactacagccaaggatgcagaagaggggggaaaaaaagaggtggcattggggtaaggcaatgataacattacaagttaactcgagcaacaaacagctgacaaataaacctgaactggtttcagtacacaatttaattacacgatggaggacgaaagtagggcggccgctgctcctgaagggagaagaggaaaaaacccgactggttttggccggccaagtcgcgaagcgcttgccaagaggggtggtatagcgactgtacaatatcaatatggcagggtcttaatctctctcacatgttatgatggaatcgctctcacatgaagtagctcagtgctttcttcttcctcgaaccgccctcgccatataggtcgttccattgaagaagttcattcatgtttgctgaatcagatgaaacgcttgcacaaacctgtggtaaataaattgatcagattatgaactttcaagtaaagagctcaaaataaatataaaatgtgctggtctcacctgctcatgggcagatttgaaatcatctaaggtcagaggacgaatgtcctcactaccatacaatgcaggctcaggcctgccttctgcttttgccacatttttctcctgaatagaaaggaagcgaaccccatattagcatataaaataaaaagcgttgtcacttaacagtataattgtagtagaagaataaggagtgcatctaaagacagcataaacccaaaaaacaaactttatctaggtcttcagttgacagcaaggtacaagcaatgccaaccttcttttccttctcaaggatttctcgaatggggtaatgagctgcggtcacgcatagattctgggaacacaagcaagtcagtgaaaattgtgcaaccatttccaatcacttgtgttatttgggaagcgcatcattatcaagcataccttcaggtcacttcctgaatatccatcggtcatagtggcaagagaatccatatcaatacctggagccaactcttcctttgccaatattactttcagaatcttttctctattcgatgcgtcaggtaagttaaccattaacctacagtagtaattaacgaccaaatggttagaaatcaacaaacagcaatttttcattatcccaaccccaacacaagggtatagctgtcacctgcgcgggaacctcctaatgacagcctcatccaggtcgaaaggcctatttgtggcaccaagaaccagtacacgttctttatctttagtgcgtaatccatcccaattcaccataaattcgtttttcatcttgcgcatcgcttcatgctcccctggattctctctccttcctagcatactatcaacctgccaaatgttgcattttgtatggatcataccgtgaccaaataaatcactaatgacaataaaaccaacccacatgctcaagcatacctcatcaatgaatataacgcttggagctattttacttgctaatgagaaaacagcttttacatatttctctccttcgccaaaccactgaaagtagaaaaaacagcatttagctttgagaatcacatagtacactgtacacctcattaatgcaaaatttggatgccatcataccttcgatgtaatgcttgacattgatatgttaatgaagttagcacctgcttcagttgctactgccttagcaagcatggttttcccagtaccaggaggtccaaacagcaatattcccttgcaaggctgcaagtaacagatttaccagaggcaatttttaagataggacttaaatagagaaaattaggtagccaacatataatactccatccgtcccaaaatatagcaacctagtactaccctgggatggaggaagtactgacaaccaaatttcccacatgtctaattaacttaaatttacccattcaccactaaaaaattgaacaagaaa

SEQ ID NO: 78258 - DNA, 588 bp, Oryza sativa
acccggatctaatccaatgggttcccgtcggcgtcgacgtcgagatcgtagcacgtagcaggaacatccaactggaatatcccaaaaaatgattttggaggctcatgcgagattatctgaccaaatctttgtgctacgcgccacataatccaagaattatgggaacctttgcttccacgttcaaactccagaaatgattgttttcggctatggacaaatacaattacgtctgatcctttatatatatatatatatatatatatatatatatatatatatatatatatatatatatatatatatatataaggcaaggatagaatttttgtatttaacacaactgatagaatatttgattgtgtaagttttgatcgaactggagcactgaagaccatttgatttactggagagtcatctactgcgtgtaactagccgacacttattatagtagtgtctgctttgtgtgtctctactctctagagtctgctttcaaaaggtcagcagtttgatctttaggaagacagcatctgagaatattgctctttgaagaaccagatgcgtcactacagtattatatatattcaatcc

SEQ ID NO: 78259 - DNA, 551 bp, Oryza sativa
caactgctggggtaaagttaggagatactccccaacactggtcacatatgcctgcgggtggcactgaagcttggaaggggaaggccacctggttcctccaccgatgaccaaattgggaggcgagcaacctcattgagacgctgtcggactttagatatgagcacgtcatagacgagttcatttactgtgtctgagaaggccgcaactctttgtgatgtcagaggtagagcatggaaccttggatcttttgactgtataacagaaatgttatctttaaattagccatgaagacaaacaaagagttacttgtgatacttgggaaattataggtcaaaaaataggttctatgccacatatgagtagcttaaaaaaatgcataatagaaaaggaaagctaaaaaagatctccgaatttcctataaaaccagataatctagcttaatactaccacctaagtttgcaatcaggctgttcaaacaaatcagagaaacatgtgataactctagtgttgtgacactagcaagataatttaaaaatatataacttgcctgt

SEQ ID NO: 78260 - DNA, 952 bp, Oryza sativa
ttatgagataccggtttataggaaacaaagttttgatcaggtagaatctgagttcatgcttgtttatggtttgcagggttcagaggctcagaaatttcaggctgcctctttttaaagcagcataaaaccagtgagttgctatcgattaaaggccgctatatcactgaaatgtgttggatttatgatcttttggtttgtaaacctatctgcacaatgtttcgctcgatttgggttctgttacaggtaaagaactccaattacccttcgtatagcccatgtttcggggaaagaagaaaaaaaggttatcccaattgtaacatgcaaataagttgtgaaattgctcaggcaaatctagtaacagctttggcgacgatacacagtggagtagcaggtgagaaggatatcctggcgacgatacgcatgcatagatctcctgcatctggagaggttgcttctcaaaggtttgcatcaggctcatcatccatagatgtcaaacctccatggcctcacagaacacaacaaaggcatgtattcaagttaagctacatagctaataaccacaacaaattcaccattatctttctccagccatcacaaagcaaattaaggagctcatgaatccaataatccggaggttttttttaaaaaaaaggactcatctcagcatccataacaggcaaacgatagttgtttccgacaccaacattggaccataacgagtcaactgacaaccatagactagaccaaaaatacggcggactgcatagataaaacatcagtgtcgagcagaaggaacagctcggcacttgacccccttcagcccatgagagaagtaaaggaaggttgggtcggtggctccgtccttgtagtaggcaaacaccaagccgccatcatcatgcatgctctcaccaaaaaaactgaaacagatcataagacacagcataagaagcag

SEQ ID NO: 78261 - DNA, 2056 bp, Oryza sativa
tatgtattccaattgtttcactaattgcaaattttaactacttttttctatgatatgtcctgaagtgtcacaagcaaccgcgatgaacggtcctttgcgggtattatgcgtgctaattccttagggttaatggacgatacaggactaacgcggaggatgtaagtctctatgctatgtactagacagctcttgatatttatgatactaatatattgattaattttaatgcatgcagttgccaagattagaatgtcgaacaagttttgacgatacaggtatcacaaatgtgcagcgtgatctgtgccacttcatccaccacgagtgttgtcatgtcaaaagagatttcttcgacccagagggtgtcctagcggcaagtgacgaattcaaggatcttcgggagtggaacactgctatgccataatgtaactagatgacgttatttgaagtgacaatgtaaaaaaatattgtaatatatattattttggcaacacttttgatttatgcaatatatgtagatttctcagtaccaaatgcttgataatcttccaatatatgtacataaaaatctacctgcaagaatttctattaaataatttaaaagtaatttacggccaaattataattaaatttcaatattttctacctatctttgcaggcggaagttttttttttttttttgcaagcggacgattcctattttcacaggcggaccggactagccaacgtacgcctgtgaaaattatcttcgcaggcggacggccgccccgcctgcgaagatcggcgatattcacagtcgttggcttacaggcggacggccgccccgctgcgaagacccttttcggccgcttgcgataatgcttttcctagtagtgccacccgttgtttcgctctagctccgcccctgaccgcccctaccgccacgacccggcacggcgctaccgacttctgcctccgtgaggtcgggctcctcctccccttcgaggtgcccccacccttccgggccagcgaaattagctgtagcgagctcctcgccggagtcgtctcgatctcctctacgtttccatttttttctctttttcttgttgttgtcttttgttttatccatctatcggtttatgtatatgagataacgagagttaggctggccacgcgcatcatatgataacaccgttgtatcatggccgagatgggcctagttgggccgaaaggatgtccatgttggccatccgacttgatgtcatcctagctcgtttaggctcgacggctcgcgatccagctcgagttggctcgttatttctaacgagctaaaataccagctcgactcgttaggaaaatgaaacaagccgagctgagttgaaccgagcttgttatgagccgagttaacgagttacgagcttttcgtcaactcctagctacaagattgagtggagtggaagcggattttttttcctcgaggagacatcccctcattttgtgcatgtcatttataaaattatcaaatatttttaaaatttatcaagatagatcaatatatgatatatcttttcgcaaacatgtgagtcaaaattcgagttatacaattcaaaacaaaaataataaatttgaccgtgaattacgcgttcacttcatagtcaaatttgttattttttgtttctacttgtataagttgaatttgaatttgcatgtttgtaaagtaacatatcacatattgatctattctactattttttataatttttttgatgactttttaagtaacatgaaaaataaagggatatctcttatagggatgatttaagttttcccgagtggagtaccgtttagagcaagagaagattttgcctttttatctttggtccaagcaaaagctccgcaccgcaacagctctgatcttgtgagtgactaccgagcgaatcgcgcgccgcagcgaccggacgtcgcttcggcagcgggcggatcgacgcgaatcgacacgcgtgtgcttacggcgacggaaagttccagcaaacaccggcgtctcacgtgctggttggatgaacccggcgaatctcctcgc

SEQ ID NO: 78262 - DNA, 4193 bp, Oryza sativa
atggtttgcatgtaaatcgcgagacgaatcttttgagctaattacgccatgatttgataatgtggtgctacagtaaacatttgctaataacgaattaattaggtttaatagattcgtctcgcagtttacagatggaatctgtaatttgttttgttattagtctatgtttaatatttaaatatttgtccgtatactttaaaaaaatttggcacacgaactaaacacagcctgtatattatcccttattattattattattattactcccctacttgacgacaactagtactttttttgcggggagacggcgactagtattgtactccttttttcattacataatcgtatactccctccgtttcacagtgtaagtcattctagcattttccacattcatattgatgttaatgatccgtttcacaatgtaagtcattctagcatttcccacattcatattgatgttaatgaatctagacataacatcaatataaatgtgaaaaatgctaaaatgacttatatttgtgaaacggagggagtaatcatcatcatgtaatcagataagccaacggatctatggtattacacttgcacggtacctgccactgccagcaaggcacttcctacatcaccataatgctaggtccatccgcgtttcacgatttgcgctgtcacagctcttcaagtcacgttaggcccggttagtcctccaaaagttttttcgaaaaacattaaatcaaatctttagacatatgcatggagcattaaatatagagtaaaagaaaaactaattacacagttaaaaaggaaatcgcaagacgaatcttttgagcttaattagtccataattaaccataagtgctacagtaattcgcatgtgctaatgacggattaattaggctcaaaagattcgtctcgcggtttccagacaagttatgaaattggatttttcattcgtgtcaaaaagggagaatagccaatatggtccctaaagtttcgctcctaggtcattttagtccttaatctttcatattgtccaaacaagtcctttaaatttgtcatgtgggctgatatagtccttggtcccaccaaaatcaccacatagatatgccatgtcaccttactatgcaaaatatatatgatttgtccaatttacccttacatatatcatagaaaaacaaaaaacaaaaggaaaaatgtaagagcaaaaatatacctcaaaagggtgaaaaaaagagatgtattttttcctatggttatgtctaattcaaccttatatttatttttctatgatatacgcaagggtaaattggacatttcatcatagattttgcatgaatgatgacatggtatatccatatgataattttggtggacccaagtattattctagaccttatgacaaagtttaaggatttctttagactatttaaaaggttagtgactaaactgatttctacaaagaaactttagggactaaattagctattctcccataaacaccttccgacatccgatcaaacatctgatgtgacactcaaaaattttcattttgcgaactaaacaggcccttaatctacttaaaaagaataggctcttccatgactcatatgccccggtttgaaacagttttttattcagcaaattattattaaaataattacttgataaatcaaatataatttacagcacatggtttggtacaaaagtttcttttaagaatacatatttttagagacgtggagaaaacaatggtccccatcgtttggcttatttcctaataagccaaaacggcttattaggaaataaaaataaatttgtaggtaaaacttttataaatatgttcttggtgacttaaaagccaatgttgaaaaagaaactatgttgaaaatatttcaaaatcaatctcaaaattaagcttgaaaatttaaaatttggctttttctttggctgattaggccatccgatgggagccaatatattgtactaataatccaatgaagtagccagaaagaacgtgtggcttcctttcctctaaacccccctataaagtgcaaacaactatcatgtcgactctccctcattgtctattccctctggatccgtttggttgggtaaagttttaggaggggttgggtttagagggattagactattacttattctgtttggttgggattggttaggagacatgaaatttcggtgggatggaaatggaaaattttctaacacatagataaggggtggtaattgtcctcctttattttgcctaaactaaactccttattgttttctaccacctctaccaaacaagagattgaaacttaaaaaaataattaaattctcatgttaatctcaccgtcaattctctcgtcaaatcgtcttccctcaagttaccaaacaaaccatatgtcccataaaaaataaacctagcacaggtgacttcgatttaatttttttacgaaccgaagagagtattttgctaaaaaaaagtcaaatcttattgttgtcaaggcttttctttttcatttttttttgaaagtcctgccagccccaatcttttcctttctctttctcgccagctcccacaatcctttttcacgaacgcgcaaaaggattgcacgtcaatatattagaagaaaaagaatttttgttacacaacaccgacttataccaagggaagagagaaaaagcaaagccaaaaactgaagcccagctcaatcagccagaacaacttacgcaagggaagggagaacccaaacaaccttggtgtcttagtacaaaattatccgttatttaatatagcttgtagaaaatcaataaaatatgaagtgtacgctaaattttctactaaagccaattgaaaacatttggatcgattttcaattttggtaaacacgcatgggcacctagcagttgctatagtagtcggttcaacgtcctaaaaccagacccctttcttaatcgaccgcaaaagctgacattgccaaagataggagtatcgtccagcaacacggctaccaatcttttctttaccctttctctactagtaagcggtgggttctcagattctgcaacgtcctggcaccataaattaaagcgctaaaccaagccattgcgttatggacaatgcaatgtgatgaaccattttacgcatatacaaggctcttacttgatccattgaaaaatccacaagacagaacgtgtcattcgtggttcgtgccacagtggttctgacgaggtttcagccccagcaaggattcccacaatagtcagctacatttgctcctgaacaatgttgtaaacagatatcaggatctccacactaatcaaaattatgataagccattccagaaaatcagacttcctgttctgaaggatctcttgaagaaaacgaatgttgtgctgcaggttaaaagtacggtgaataacataaggacacaatgcaaatatttacaatgcaagtaaataatcaagtgaattataaaacgttctacattacatgagccttacctcaacaaatttcaacttaaaatcaaggttcccaaatctttgggttaactcatattcatctcgaaggtattcccaaatctgagcatagtttgcgttcttccaagcaatgtctgacctggaattgacaaagttctacagtaagtatgtgagaacagataaagctttctaaatagtggcagcaaagataaagtttaaatgcagaactccaaaagattgatccaatgcatgtgagacagtgctgggataaaaagtaataagactgagctaacaacctcagagaagcaatacagctcacacaccgactaccaaacaacagacctaattccagtggacaacaaatactgtgtttcgcatgattctggcatcccgctttaggagctttgcattccaaattaatagtattctaaaccagtttgcatggatacaaataaaaatgtctgaacattgcatgaaataaatagtactctagtctagcaggataaggcaaatgcattcacaaaatatgtgtatttctaagtaatatgcaacagagccaaacagcatgcaaaaaaatgctcttaatatggggaatgaaagaaggaggtttattaaatacatagttctcagtatggtgttctactcacctttcaaaaagcccaagcttgagaataacatctgccaggttagagttagcctttcctacc

SEQ ID NO: 78263 - DNA, 643 bp, Oryza sativa
gaaccctacaaatttggtattaattgtgcaaatattttacgtgtaacttttagagatatggaaagtcgggaatggatgtatcattggccgaggtttttgtctccatatagaaacgaagtggctaaatttattggtattgccaaggttcacgctgagaagaacaatatgaggaagataatttgtccatgtgctgactgtaagaatgaaatagcctgggactttgacgatgcttttaaagtgaatgagcacttagtaactcgtggatttatggacaagtacgaaatatggacacttcatggcgaagaacaagtggacgggcctgaaaatgtagttccgacacaagttgaagacatggtgcataacgatggttctgttgaggacaaaatcgacctagaggaaatgttacgtcatgcagaactcgaggtgctgatggggttggctagagggctaaataactttgaagctttacagaaggcagcaaaggaagttttgtacgatgagtcgaagggctgtgacagtgagttcacaacactccggtcagttcttgaacttatgaagttaaaggtgagacatggatggtctgataccagtttcgacagtctgttagaacttctgcagaaaatgctaccgaggcctaactcac

SEQ ID NO: 78264 - DNA, 629 bp, Oryza sativa
tccatgacattggaatataaaatctccagatctctgcagggccacacactagtactgtcgctagccatggccctggtagtattaactaccactacgtacgcatgttcttgtggacatggattggagtgacctgagaggctggtgagcccttacaaaaatggtgaagcaccctaatcttccatgggagatcgagatcggtacagcatcttccttccttttatattccgcagggtatcaaattggagtattttttctctactcgtgtagcgatgaggagtgtagagtatctattggagcgccttgcaagcaacgccaaacgactactcctacacccaagacccaacttcccactcaactgtactgtactccactcgccgcacacactgacacagcgggcccacctgcagttagttctccggatcgcttcttccacctcgcgcgcacttcacctgcgctgcgcacacacgctccagtactccgccacgcgcacggctcttatcccgagctcgtgtcactggtggggtggggcccaccatgacaggcgaggcgtgggtcccgcaagcagggtcagcgcgcgagtccgagtaatattcccccacaacctctgccacaacggaaaacaacggcct

SEQ ID NO: 78265 - DNA, 20771 bp, Oryza sativa
ggcgggggggccggaacaccgagggcgaaggggaccgccctagggtttggagggttctacaaggggcatgctggaggaggaggaggggcctcagtaggctcttctggaaggttcgaatcctacacagctccatcatctctcacaaatcacacattacactagtatttttttggagaagaagaagaagatatgatatgagtatgacggcggcggcggcccccctcccttcctgttcctgtgcgctttgtggtggtggatcgagggttagttcaaaattttatacatgagcaaggaggtttttgcaaaattaccagatctcacgtggcatgcatacaaggtgaaaccaggcaccagcggtggaaggagcaggcacgcgacatagtcaaacgcgagattaacagtgagattaccggcaaactgtgttttcctgatcgcacacgcgctcacgtggagccgtaatcgcaagacgacaatgtgcaaattaaacaaggagaccaaaaaatttttaaaaaaaaggagaaaaagggtacggttaggctggttattgattgatgatatgtcacacgcacccctttcctattacagcattgtgaaaactcttttaatgtttttagcttccattactgcccacgcaattgtaacaaagtggctcatgctttagcagcctatagctataatagttctcagacgactcagttcagctgggatggttttcctccagatgtggaggaggtggttgccggcgatttagccgaaccagtggtataatggaatttaatgttcctctaaaaaaaccctgcttgctccaaggatgaggtggatcagactccacttccaaactactctaatccacttattaaaaatttccaacttgtgtttcaaacttttatctctactagaaaaaaatgtccgtgcgttgcaacgggtgaagactattttaatttttattatttttatacgaaattcactatgagaatttgcttggatatgtatttttctgaaaaaatcatgagctgcaattaggagtccgagtccgatcatctcaagttagcatgcgagtttttttaaaagagatttcttatgactcctgtattttataaaagcgaacgaacttaaaacctgactcaaatacggatatgtatctccaaatgcgaacgaacttaaaaaccgactcatacacggatgacgtactaaagtaccggcaaaaacatcttcaacttttataatagtagagatactaaaaaaaatatccgtgcgttgcaacgagtgaagcctatcttaatctgtgggaattcacttggatattgtttttacaagttagcatgcagttttttttataatagattacttatacaactccttctatgtgccagggttacggataagtcataccttctatcctacgacttatggaatatacagataaggtgtaccttcatgtacacggatcgtttccttgtataccatttggaatccattccaaattatggaaaatatatctacgagtctaagtgatttccaaaatcctactcggaagggatagaatttcggttacaccgtaccagatccaatatcctcaggtctttcttgggggtcaagatgattcatggtataaaagggaccctcggggaggggtgaaagggcatccaatttaatcgccaacacacccactatagtttacaaagccagagtacgcggggccaaatcgctgggagatctcatcgaaaccctcgaccacgatctcgttggtatgatctatttcgactactctctttgtaatatgttcttgtcattataaatcccatataaactggactagggctatgacctgataaggggcctgaaccagtataatccttatcttttgtttgcttgatgtcgtactacgtagaccctcattccaatgtaccccaacactctattcatccggtctgcgagtatcactcgtcgacactatgtttccaaaagagaatggaattaaaagctgactcaaatacgaatatgtaattccaaaagtcaataaaaacttaaagaacgactcaaatacggatgacgtatcaatttaccggtaaaaacatctttaatttttataatagtagagatctctaatttttgtaatatgtgtggtattcccatacataatacatataaactagagtatagttattactcatctagaggacccgagctagtataaatacatgtcctttgtctgcttgatccgatctcgcatacacactggttctaacgatctccatactctacaaatactacttgcggtgagacgacaaaccttgttgttatagctaaatatttcgtgaaccgcattaagttcaaacggattggtcttgccttagatcgcaagttgttcaaatgctcatggataacgaaattatttgagtaaatttcaaagaactactactattttgtcaaaagtatcagttatgacatttcaggtaactggaatagtggtatacaattgtatcgaaaagcttctactttatgtgtctgacaagttttggcccatgtgtcatacatatatatggggaaatgctgcgttttttaaataaaacagttctctattattcccattttttttgaaatattcaactaaagttatagcaaagtgatagttttgaccaaataattgcaatttatgaaatttactcacatcgttttgttggatgatttttttattatgtttacaaatcccgtctctcttctatctatatatgtggttacttaaccacaattcgtgggaatagaacacatttcctccaagatagtagataaggatgcagttttgtgctcaagcatgctaggaaaaagctaatgtcatgacaacgagttcccacttggagtgttgcctagcctttcatgagattccattcattttatgcctacttatgttattcctattgatgacttcatggtttactattggttttgtgtattagggaccaattaaatacatactaatttgtcaatctgggagaggggggcattattaatatcgatcgtatcatataccaaaactaacacttctgtctaatgttttggtaagcgccatcattggacattcttcttggtgtaatacttaagataattttcaatgaattgctccctcatgttaaggatatttgacgttgggagtattggttttagtactcatagtatatttagctgtagggagtattggttttgttttatatatttttagggtgttcctctaaaatcatacattagtgggataaggaacaccattttttgaaaacgtactaaaagtggatttcactggcctagatgattcttggaatttcctcttcttgttctatcaacaagtggctcatggttacttgtacgtagcccacttaatatagttcaaacttgtactcatgttttgactagcttgagctcatcatgttaccaagttcatgctctatgtttatttgaatgtttttaggtctcggggaataaattggttaaaacacaatgtttatgtgtttgtatttctaactaaaacgtattgtaaacttaaatatcaagttgtggtgtttcaaatgaattgtggaatctcccatgaatgtcaccttagttgtgctcaggtttacttatgtatgttaatgtcacttccagaaattcttgggcactatatattaggctacagcaaatgaaacttctcttaaaaagtgagataccaaatgaattcctatagcttcattttttaaaagagggggctcaattttattttaagaaacaacaaaatataaacatttacataaccgcatgtttgttcatcaatgaccaacatgaatgagcataaagagtagaggcaacagaaaacactagtgcgccaccaagatatttgatcaagagaagagttagcaacacataaaatgtctatctaaagaggagttaccaaatcaacatccatttcaccagaattatctaagaaacacattccattaagcctccttgtcattggtgccaaacccatagactttctaaacacgtcctcaatcacttgttagattttttttttgcacaatctagcatctcatagcgttttccttcaaactggattaatgtttatgtttgtcggagatatggacccggaggtatgcgaaatgagggaaatctaccttcccatcctgccacgtgtccctacagcctggtcctgcccccgcattccgcgaaccgcaggagcagccgagggggtcggggcctcggggtgccacgtcatgcccctcgggcccttgcaccgctttgccccgaggccctcgcccagccgccatttggcagggggagcgagcgaggagggggcccaggctgaaccccctttaatgcgcgcagcgccccaactgccccctgtcgcatttaatgcagtggggtagacgtgcggcgtgctaaactgacgcgcaatagtcaagaatgaccggtctgtgaccggcctgacgccggtcacgtctgactggacggacaaccgtgctcccatgtcgcatctgcttccggcggagtagaggtaggtatgacccgtcccatcggagggtcattcggacggcggccaccacaagtcttcacccattaatgagggaatgacagggttgtcccccgtgtcaggcgagggacagcgctgggccccgctcaagggcaagctgtggtttagcttccaggcgaaggcacgggtcgagttccggtcaagatagggtgggtccccacccgaaagaagagtaggtagaggcggtgcatgtggtatccccttaagatataaaaggaggacattgcccaccgagaaaggggacgactctcagtgaacttgagctctaggagaagagtgttctcctgagtttaggaacccttgtaactctcagtctaaatcccatacacaggagtagggtgttacgcttcatagcggcccgaacctgtataatttggttgtgtgcgagctagctaggagccttagggacagatacgtgatttctagaggcgagcttcttcccccggctgaactcacgaaaggggggtctcacgacctcccgctagagaggatcatccctcgacagctggcgtgccaggtagggggaagtcgcgcgctttaaagagaagtcgtttccttccgtcccaagtttcccttggccctcgacgatcatggtcgaggtcctggaggaggaggcggtgatgttcacccccactccgtctgggagtgaggatgctagcgagagctgcggccctcgtcaccgccgccgcaactctccaactcctccccgccgcgatccctcgcggagggaggaccccacccattcgggtggttcggccctctccccgcccccgggcggagggaggccacaacgcgtcagggcacggcgccgcctcacttatggtgacggcggctcgccccgaggcgcgcttcaagcagtgggtgtccttctgcggcatccccccgtgaactcggagccagagacccctgtccagcgctggttgggcgacgtggccaacttggtcactactgcccagtggcagttggccgcgggcggccgacccgccgtcaccggtacgtcgcgtacccccattaccctctcctcgtcagcaaggaggagggcccgtcggtcctggaggaggaggcggtggtgttcacccccactccgtctaggagtgaggatgctagcgagagccgcggccctcgtcaccgccgccgcaactctccaactactccccgccgcgatccctcgcggagggaggaccccacccattcgggtggttcagccctctccccgcccccgggcggagggaggccacaacgcgtcggggcacggcgccgcctcacttacggtgacggcggctcgccccgaggcgtgcttcaggcagtaggtgcccttctgcggcatccccccgtgaacttggagccggagacccctgtccagcgctggttgggtgacgtggccaacttggtcactattgcccagtggcagttggccgcgggcggccgacccgccgtcaccggtacgtcgcgtaccctcattatcctctcctcgtcagcaaggagagggcccgtcggtcggccacggcctcgaggcggtccacggatccaacatcgttgggggcctcaggaagccggaggcgtcacgacggtctctacggggagcaggacgctcgaatcaatatcgagcgacgccgggacgagcgccgagctgcccgcatgggggaaggcgcctcctcatctggagtgccacattcctcctcacgaggcggccctccccccacgctcacccctggagggacaggttgtagggccttcgtggcgagtctccggaatgtccggtggcccccgaagtttcaccctaacctcacggagaagtatgatggcagcatcaatccctccgagttcttccatatctacaccacgatcatcgtggcggcagggggcgacgaccgggtcatggcgaattatttccccatggccctcaagggtcaggcgcgcggctggttgatgacccagccccccgactccatctactcctgggaggacctgtgccagcagttcgtcacgaacttccagggcacatatccccgcccaggagaagaggcggacctgcacgctgtgcggcggaaggacgatgagtccctctgctcgtacatacagcgcttctgccaggtccgcaacactattccatgcattccggcccacgcggtcgtttatgcatttcggaatggcttgcagcataaccgcatgctggagaaaatcgctttcaaggagtccaagaccaccgctgagctcttcgagctggcggacaaggtggctcggaaggaggaggcgtgggcctggaactcccctggcatcggcgcggcggctgcggctacccccgagtctattccccgctctaagcggtgagataggaggggcaaaaggaaaccggcccgctccgatgacgagggccatgtccttgcggctaatgggcccgcacgggccccgtgcaagggaaaggccaccggcgacaagccgagctccactgctccatccggcgagggccagtcggcagacaagtggtgctcagtgcacaacacttatcggcacagtctcgccgactgccgctcggtcaagaatttggccgagcggttccggaaagccgatgaggagaagcggcagggtcgacgagagggcaaagcccccgcgaccccagccgatgaccggcgaggggaggccaagaagaaggcccccgccgatgatggcgatgacagcgaggatctggagttccagatacctcagggaaccatcgccacgcgcgatgggggggggggcttgcgctcacacctcccgccgaggcttcaaggccatgcggcgagaacttctggccaccgttccaacccacgaagcggcttggaaggcgcgctggtcagaggtgaagctcacctttgaccagagcgaccatccgacaatgctcgctcggggtgggaagttgaccctcgtggtctccccgaccattcacaacgtcgggatgaagcgcgtcctggttgacatgggggggggggcagcctgagcatcatctccccagctgccttcgacgcgctcaaggccccggggatgaagctccagccgtcgctgctgatcatcggcgtgactccgggacacacgtggcccctcggccacgttgagctcctggtaaccttcggcgactccaccaacttccgtaccgagcggatcgacttcgatgtggcggacctcaatctgccctacaatgcggtcctgggcagacctgcgttggtgaagttcatggccgccacccactacgcctacctccagatgaagatgccgggccctagtggtcccatcaccgtctttggtgatgtcaaagtcgccctcgcctgcgcggagcagcgcgccgacaacctggcggtggccacggagccacaggccctggaggcctccgcgtcccgcgcctccaagaagcacctcacctcggctgacgaggtgcccgtcaaggagatcccccttggagatgatccatccaagaccgccaaaattggcgggaccctggatgccaaataggaaagcgcgctcgtctccttcctgcgggcaaattccgatgtcttcgcatggaagccgtcgaacatgcccggggtccccaaggaggtgatcgagcaccacctcgccgtgcggccggatgcgcaacccgtccagcaaaaagtacggtgtcaagccccggagcgacaggccttcatctgagaggaagtggcatggctcctggaggttgacttcatccgcgaggttatccatccggagtggctggcgaacccggtggtcgtcccgaaggccaacgacaagctccggatgtgcatcgactacacggacctcaacaaggcatgccctaaagatcccttccctttaccacgcatagatcagatagtcgactccactgcggggtgcgaccttttgtgttttctagatgcctactcttggtatcaccaaatccgcatggctagggaagatgaggaaaaaactgtcttcgttactcctatgggcaccttttgttatacaactatgccttttgggttagagaatgcaggccttacttttcagcgtatgactcgtattactttgagtaatcagatagggcccaatatagaggcgtatgtcgatgacctagtggtaaagatgcgccaccaggacacgttgttgcaggatttggccgagactttcgacagtcttaggtccacacgcgtgaaactgaaccccgacaagtgtgtattcggtgtgccggcgggcaaactcctcggttttctagtcttctcctgaggcatagaagctaatcccgagaaaatacgcgcgatagagaggatgcgccccccagcaagcttagggatgtgcagtgcatcactggatgcatggccaccctaagtcgattcatatcgaggctgggagagagggcgctgcccctattcaagctcctcaagcgctccgggccgttcgtgtggacggaggaagctgagcaagctctcaatcagctgaaagcttacctcacctcccccccatcttggtagccccggggctagaggaaccattgctgctctacttggccgtgaccccccatgtggtgagtgccgccctagtattcgagcgtgaagagaacggaccggaggcccccttgactcgcgatggcccttcgtcccccgaagacccgatgcccgaagcccccagcccctgggaggaccccgaggcccccgtgggaggaggggaggctttggcaagtggtcctgaggcatatgatcctgacatgattcgagaccccccggggcccctgagcaagggcgccccagatcatctgcccctgacaacacggaccggccccaccgaaaggtgcagcggcccatctactttgtcagcgaggcactccgagatgcgaagacccgatacccacaggcccagaagatgctttatgcagtcttaatggcctcaaggaaattgcgccactattttcaagcgcatcgggtttccgtagtgacatcctaccctctcggccaaatcttgcacaaccgagagggtaatggtcgggttgtaaattgggccatcgagcttgctgagttcaacctgcactacgaaccacggcacgcgatcaaaagccaggtcttggctgacttcatcgcagagtggaccccagtagacgaccctgttccgtccaacgttccctccctccccggagatggagaggacccaaacgccaacattcgtggcgggcactgggttatgcatttcgatggctccctcaaccttcaaggtgcaagtgccggagtcacgctgacttcgccaagcggggacgtcctcaaatacgtcgttcggctcgacttccgagccacgaacaacatggcggaatacgaatgactcctcgcggggttgagggcggcggccggaatgggcatccgccatcttctggtcctaggcgactcccagctggttgtgaatcaagtatccaaagaataccagtgcaccgacccacaaatggacgcatatgtccacgaagtgtggcgcatggcatcgatctcatagccgacacccatcagggtgagtgcggggcccattcggcctcacgcactttggtcggtaaagccttccgacaaggtttttactggccgactgcgttgcaagatgcccaagaatgggtccggcggtgcaaggcatgctagttccacgccaagcaaacccaccagccggcccaagccttgcaggtcatcctactctcttggcctttcgcggtctgggggctagacatcctcggaccattcaaagcggctcgaggcgggtatcaacacctgtacatcgccatcgacaagttcaccaagtggcccgaagcttatccagtcgtcaagatcgacaagcattccgccctcaagttcatcaggggcatcacgtcccaattcggagtgctcaaccgtatcattacagacaacggcacccagttcaccagtgagctgttcggcgactattgcaatgacatgggcatcaaattgtgctttgcctcgcccgcccaccccaagagcaacggccaagtcgagcgagccaacgccgaaatcctcaaaggcctcaagaccaagacgtacaacgtcctgaagaaacatggggattcgtggctcgaggagttgcccaccgtgttgtgggcaaatcggaccactccaagtcgcgccacgggggaaacgccttttttcctggtgtatggcgccgaggcggtcctaccttcggagctttccctgggatcgcctcgcgtcgcgctatatgatgaggccaaccaggatgatcttcgccgcgacgacctcgactatcttgaagagtggagaaggcgcgcggccctacatgcggcgcactaaaaacaaagcctgcggcgctaccatcagcgccacgtccgggccccgtcactgcaagttggcgacctcgtcctacgccgcgtacagtcgcgtctggggctaagcaagctctcgccaatgtgggaagggacatacaaagtgatcgacgttccccggccaggctctgttcgactaaccacggaggacggcacggagttgcctaacccctggaatatcgaacaactccgtcgcttctatccatagcgtcgcagttttttgctttccaggagctcgggccaacccccgcacaacccctcggcttgtgcgggcttggccgggggctaccactgtgaattactttgtatctttttccctttccaagcaataaatttttccacctaaagtggaggccgttacgcgccctttcttctcactctttcctctggcttgtcctggttcaaaggacaattcgcgcttactctgaaccctaagtgccgttgggcgacctaaaaaccgctgaaagggagcccaaacgcgggccgcgccccgggttgcgccgaaccccgggagctcagaagggcctacacacggccgtccccgacccccggtcgtcgtagcctcggtctggccagtcccgctgggcggctccctcgggaccacggaccgagcgcggatttaccttttcgcaagaacgagcccgagagggggatggggtaaaaacggcatttcgatcacagggaggttaattatatacttttgctcttgttttttcttctttccgtgccgcaggcattcaagggagaaagcaaaggggtagaaaatgcgaaggggaagctttatttatagacaagacggcacgatagcctaaagacaagaagtgtctgctgcagacacacaacaaaaggaaattaaaagtggggataatcatggagtgcccgggcccccgaggtcggcgccgctgaccacgtcgtcccagtcctcgccatcggcgtcgtcaccaccggcgtcgtcaccaccgtcttcgctcccgttctcctcatccgaggcaagcccgaaggtgaactgaggggccgacccctcgaagttagagacgatcgcgtcggccgcctccgggacttgctccagagcccttgcctcggttcccgggggaaattctcaagtgcgcgccatgggacgaagtcgggatcacgggcttggtggctcgtgaggaccagttccaccgtggcccgcgccatggaagccgatgacgttttcacgatgtcgccggcctcctcctccagcctctccagatccgccgccagcccgtccagccggagcgcgagtgccggctgtgtgggccgtccagccggagcgcgagtgccggttgtgtgggcgggagcttcctatcccggcgcacggagatgccgactcggcgccccgcgcgctccagccgatcgacagcatcggagagctgcccggggccgatctcgttggtaaggcggagggtcgcgacctccctagcctggtcttgcaccaggagctctaggtcggtaagagtgctctaagccgcggtaagctggctcaccaactccgcgccgccgggctgcccgcccaccgctaggtccttctcccgggcctccagctcagaagccctcgccgccatcgccgcgcactcggcacgagcactctccagatgccgagcctcgcgcccggcaacggcctcctcgtgtttcgcgagttgctcgcccagctggcgcgaggccacttcacggcggttcacctcggctttgcactcggcgagtgcggcatcccgttcccggcacgcctcttcccggagccatagctccttcgcgcgacgggccgccgaagctttcacggcgagggtggtccggtcacgctcggctgcagcctcctcacaaaggcgaagggaggcctccgcctctgccgctgttctctcatgggaggccaaggtggactcccgctgatctagcaggcgcgctcgctcctccagcgccttagcccgcctctccagctcctgggctcgctgcgcctgctcctggctgcgcgcgtcttgctcgcgctggctctggtcgaggacctcgattcgccgacgaatcgtggcctcaaactcctgcgcggagcgggcacgctcatctaaggccttgcgttcagcctcgagcgccgccgtccgagcccgcagcgaggcgttggcttccgatacccaccgctctcgggcggcagccgcatcgaggacaccgcgggcgtccttaaccctcttcgccaggtcctcggcatgggcctcgtaccgtaggcgaatgtcacctagctcttcattcaggacgcttgaagcgatcagtgctgcctgccgctcttcctccgtctcacgcatgacggagtccagcgtctcctcgcgcacctggatttcagctagttgggcttggcgcattttgcgtcccatattcaccatgtcgtccacggcgcggcgcccctcgtcaacctgcgtgcggtccgcagcgagctgtgcctactctgcctccagggccgctcgttcttccgccagggcttgaacttgggcattgagcccctctcggacggtggaatcggcggcggcgagcacctgcaggagcggcttcatacttgctagagtcggagaagaaaaagttgcggtcagtccatgggacgatagagtgctgctggatcccccgcgagactgggggcttctctcagccccatttctgcgaggccatccccgaggactccccaagtgcaagggagagcggctgttcctctcgccccccacttcgggccctcgggtagattcggccttgttctcaggctcgggcccgcccccagtttcggcctcggcctcgggctcagggccgcctctagcctcggcttccgggccgcgacctccctcgccccctgctcccgggtggcgctccgcatggatccgggcctcggagtcgcccccgggagagacgccgccgccgctatcgctcgcggcgggtcgagtcccggctgaggtgaacccagggtcggacccagtgtgtggcccatgggccccgccgggaggctatgaaggccccgcggccctggatcggccaagcccgggccgctccgatcgttcggactttgtcccctgcaaagggtcggaccccgagatcccctgggaaggaatctcgctgcaaaagaactctgatcgcgttaacgaagaaaaagaagaggaaggaacaagagaccgagatgagtaaaaagcaccgaagcgagtgccggcagtcgtacctgcgaggagggcgattgaaagtccacttcgggggctcaatgaagctctcccgacacggctccgtttgacctatcttccggagccgcttcttcttccgtccggcctcaggcgcggcggggcgcttgtggcccgccggcggttggtccgccacgcgcttggcgccccctccgcgcgggggagagggcggtcgagatttggacatcttccgcttcccttttgggtcgctggctgagtcgaccccgggtccacggcttgggctgggtgccctagagctgccacccccgccggggccgctggtccgactcccgcctgcggtcgcgccacagccacccacgccgacagcgccaccaccggtaccgccccggcgggaccgactcctgccggtgctgacggtcgacatcacccaggatactctcccggtcgcggtcgctgcagaggggaaggatcccgtctagaatcagtgtttgctcggcggtgtccagacccaacacccgccgaatcaccgtcttcgcgtcctcctcgccccaatcccaacgcttgcccacatgcgtgcgcatggggtcgttgggtccagtgtactcccacgcgccacgtgatttatcttggagaggcgcgatgcggcggcagaagtagtcgccaaagaccattgcccccgtaaggcccaggcttcgcaggcccctgaggcgatcccgcaccgcgtcgtactcctcgcccaactccgaaaccgctagccacgtggcggatcgttcgagagggccagcgggaagccgaagttgcgggtggtccggcagcgcggtgtagaaccagtccttcttccagtcctcccatttcttgcggagatgactctcgatgtattgccccgccgtgcctggccagggctggaagtaacatccccccaccaccgcaccttgcagcagttgcgggacgaagaaagactggaacagccgcatcgtcggccgcaccccgatgaacatctcgcatagatgcgcgaagatggccagcgtcatcacggcgttgggtgcgagatgcaaggcatggatttcatagaaatccaaaacctcgtggaataatccggagaatggcgggatcaaccccgccatagcaaaggacaggaggtgcacagatcgctccgggtatcgcggccgcggccacgactcccccgccctcacggcggcgtcttccggcataatcttgcgggggagactaagatgcctatccgccgtaatgcgcgatgccgaaagcactgcgtcgccagcatcttgagccatgatgaccggtggagaaacgacgaggggcttggcgtgcggaatagcgtggagtggcgagaatgttagggcttagggagcgagtatgcgggtgagcagttggcaaaaggaaggaggcaaagtccccgcctccgtatccttttatccttgcctcgcccgcgctcgccttctcgtttcacgccctcacggttgcccccatgattctcgcgcctgcagttgcctcatcgtttatcgcgaccactcatcacgtcgcccactgaatcctcgccccgcatttagtgcgcctgtcaacagcacactcggtgtagggcgtgcggcggtcacgggcgcaatctgggcgaactgtcaccagtaccgccgcatacgtggcgggcgagggagttgaggtgtggtctaaccgaccccctgattttcgcgccttaagcatcctcatcatcagcgcggtcagtggcggtcaaaccgctgttgtggttgatacgccaacccggccactcggcggcatccgcttagattccctgccgggcccacaaccccagcttgggaagtcgcgaggcaccacatcagaccgacctcaggaggccaatgtccgatgtggtgccgggggctactgtcggagatatgggcccgggggtatgcgaaatgaggggaatctactttcccatcctgccacgtgtccttacagcctggttctgcccccgcattccgtgaaccgcaggagcggccgggggggtcggggcctcggggtgccacgtcatgccccttgttaacagtgaaatttggtaatcggcaaagacgtcatcggcttagaatcattatcggctgcagcatctcggaatcagccgatgggagttataaagtcgccaatagtcggattcctgctatattcgattaaggaaatcaatctattaaaggaagcttatccctaagtgaccgagtttaaagaggatgcggcatggtagtttatctattaattaggaatagtttgttagtttccttttatctttaggaaagtgtgtttagtgtccgataaggactttatattttccttttatctttaggttagtttctttcttgtccgacaaggacttgtatcaacccatgggtataaatatgtacacccggggtctatgtaatcgattctcacgatcaatacaattcggcgcatcgccacccttttatttctacttttgtttttacgttccggcggaacttggcacccgacgcggggctgcatcgtctttgatctccggcgaagggataagtccaatgttctgctggcccaggccattgtatcgtctacgtcggcgttgttcaaggctgcatcagtacattcgacctcttggattgctctggtttggatgatatacttgcctacctatttatcatatgtctctgttaatctagtcttagcatatcgatttagctctatcggttgcttctcgttttagggtttctgccggtatcggctaaatcgtgttgctagattatattagcttagacatctaccaccctgaaaactcagcaacggcttgattatctagatattatgtttcttttcatacttagtgctgcatcagttaagtttgatctactaagtcatgcttagaaccataatctctagcctgcttcttgattgccaataagggtatcatcggggtttcagccggtgagttatctggacgttgcatcggctcataaggattgcatatacatataagtaggatttagccgatgacaacaaaggtttcactgtttaatctaatcttatggatttcatgacatcggacctccagccgatgtgtgctttgaccttcggatcgatgcttatttatcatatcattatttgtcgattggtttatactggattatattgttattttattacatcgttgttagccgattgcctttatattattatctacattggacatatagccgattgcttaaaccctatcgctatcggctggtatcggcattggctattatcggcatcggctggaactactccatcggcttgtcagcccatcggctgtttagatctactatttgcatatcttgtcagttgcaggatcaaactgactggcacgctcgcatctcatcaatatttggacctgcacaggagctaagcagatctcctaggccggtgtgttcaattttttcgtcaacacccctcgggcccttgcaccgctttgccccgaggccctcgcccagccaccatttggcaggggaagcgagcgaggagggggcccaggctgaaccccctttaatgcgcgcagcgccccaactgccccctgtcgcatttaatgcagtggggtagacgtgcggcgtgctaaactgacgcgcaatagtcaagaatgaccggtatgtgaccggcctgacgccggtcacgtctgactggacggacaaccgtgctcccacgtcgcatctgcttccggcggagtggaggtaggtatgacccgtcccattggagggtcattcggacggcggccaccacaagtcttcacctattaatgagggaatgacagggctgtcccctgtgtcaggcgagggacggcgctgggtcctactcaagggcaagctgtggtttagcttcaaggcgaaggcacgggttgagttccggtcaagatagggtgggtccccacccgaaagaagagtaggtagaggcggtgcatgtggtatccccttgagatataaaaggaggatcttgcccaccgagaaaggggacgactctcagtgaactagagctctaggagaagagtgttctcccgagtttaggaacccttgtaactctcagtctaaatcccatacacaggagtagggtgttacgcttcatagcggcccgaacctgtataatttggttgtgtgcgagctaactaggagccttagggacggatacgtgatttctagaggcgagcttcttccctcggccgaactcacgaaagggggggtctcatgacctcccgctagagaggatcatccctcgacaatgttgtacatcaacaagttggatccaataaacggcatacttaggaagttttccacatcacccaataaatatatgaagtaatcacaacattatcatttctcatttttttggaatatgttctagcaatgaattcaaaccaaaaggtatattgccaatctgaaatcacacctaacaaatggataaaagcttacattcacccactttccctagttcccctttttttctttggcaatttctcattgtgaattagtcaaaaagcagcacccaaatgatataatcacttctatgaaattttattttcaaataagacaaatgtgcaaataaacacaaaattgttttcatgttcaaagaacttttctttatcatcttccattataaagacgatgtcatcaacatactgtagaattgagaccctatagcattcagcaaaatgtgacacccttcctttgatcaaaccttttcaattgtttggttaataagcaaagtcaatgcaacatcccccgctatgttaaaagggagtggagcaatatatattcttgccttaaaaccttgtaagacacatgcttataagttcattaagcatagttgcaacacaacctccccttaccaccttaaaaatcgaaccacaccatttatctatctccaaaacatttttggccataaatttgttatacaaaagaaccatctcgcatttcgtcacatactttctcaaagtttaccttaaaaagcacccatacattttttcccatatgaacttcttgaattatttcatgtaaacttaatatccctttccattatgaaccaatatttcaagaatgcaacttgactattgaactcaaccttttggatcactctaaccaacctacttatcacccctttggtgagaattttataactcatcacgtcgagtacacaaataggcctaaatttctatatggtcaaagtatcaatgtatcaaggttatacatagtttaatctctctatatctaaaaccgcattgtaaaaaccctcaaaaactttcagaagatcctatgtgatcacttcctagaagaattggtaaaatatttgtaggaagctattaggaccatgggcggccttattctttctcttctaaataaaacatgtggtttaatttcttccaatgaaaaaggtccattcagagatttcggattcagttcatccatttatatattcctaatatattagtgtcactgtggggccaaacaattttttatataaaagaagatgtcacatgttccatcaattccttctcatcttctatcatcttgaagattttattatatccaaagtgattgcacggtttagaataacgtcactaagtttgtatttaataattgtagctcccggagctaccatgctcctcttcatctggtattctgttcataattgtggcctttaacaagccttagtttgtactcctttctatatctcttataaataaaagaggaagatctcctgctcccttttttatataaaaaggaatatatatatatatatatatatatatatatatatatataggccaaccaaatgaagttctttcgaaccatgtgtttcaactttcaacaatggaattgaaaccaaagctccaagagttcctgagattttctgaaaaaaaaacaggtgttatattgagcaaatgaaaagaaagaagtttcagattgtttagtgagcaacgaagtccaaaatcacaaggttagcacatgatgtcggttaccatttaatttgcttctctataaattgtgttgtccaaactaaaatcgttgttgtgttctggttagttgtgaatttcttttgaggtgataaataggaagaaatgtgtacgacgttctcttgtgttaagcaaactcagcagagcttcagtgtgtactagtagtagtatagtatagcaaaagaagtgacgaattaattgtctttagaataaaatgttcttgctacattgcacaagtaattctcaaaaaaatacattgcacaagtgaattatttaacggtgacagcacgtgttgacataaaataaaactgaagagagaaataattaaaatacgtactcgatccacttttataagaaaagagaaaacgttgtcctcaagacctgtgtgtgccatgtgaagcaaggcgataaaaggcatgaagagaatcaggggtggtgaagaaggatgggagaatatggagcaagccagccaggtgaagctgaagctgcaagggccaagggctaggctacgaggaaggatggaagatgagaagaaaaaaaaagaggcactactgtacatgtgggggtaggaaatcaaaaggattcagctcaagccacacaagaggaaagcaaaaaaggaagatgcaaagcagtgcacatatataaaaagcactgctcctcagccacaccaagcaaaggataggagaaagctaacct

SEQ ID NO: 78266 - DNA, 1153 bp, Oryza sativa
aggagagccaacgcctagaccaacgtatagcaatggtagtcttttttcatgagatttcccgtagtattttttcctaaggctgctttgtcgccgggacgacatgtactaaaaacttctttcttaatacacaacaatgtgcaattctctagtgtattagctataaattaacgaatgattatagggatatggaccatactaccatagtgccaagatgcactagctagggtatagaagcttggaacagtagatgccaggtaagccggacgctcaaagcaatccgttagcgttcaggcacagcattctcctggacgagggtaatacaagaccagaagtggccgccgcaaagaagtctccggacgaaggatatccttgtcctgacccgccgcgcactccaattctaaccggctgcctggagtgcaccgaaaggaagctataaaaccaaatcaaaccccatccacccgcggaagcatgcgcgccaacgcactccccacgcgatcccacagccctccgcttcctctcccctttcgcctattcatcggtaaaccaacgcgccgtcgcccacagatattcccccgccctttttctctttaacctctcgcagccagccagccaccatccgaaaacaccagaacccgattccatcccggttgctgttcttataatacgtggagaagaaactagactagcttcttcgccgtgagggctttggtgccggagcatgtgccatcctgggctgccgcctctgccgccggggtgcgaggtcaagcggcggagggcgccgccggtggcgcgagtgggttccccgccgcccgtgccgcggcgggagcagcctcatcaggctcagccgcaccactactgcgtgtgctcgcccacggcgcaccgcgggtcgttccgctgtcgctggcaccgccgcggctactacgagtggggcgcctcccgccgcaggtagggcaaagcccgttcggtgggtgacgcgtgcgcgcatggtggaaactgctcgacgcatcgccggccagctgcgtacaactcatggcgtcttcttgcgcatcatgttcggttgctcatgtgtttgtacacagacacacagtgtacagttgttcgaactcggaaggaaacacaaaacacttaaataagcgtacattactctatagtt

SEQ ID NO: 78267 - DNA, 1111 bp, Oryza sativa
tactcaaatggagcattatttaaattaaataagttatgggctattttttcaagaaaaacatttcaacttaaatatttaaggtttagtttgatttagattattaccgtggagtgcttacttcgtccctatattttagaacatagagtggctaattaatggtagagataaattaaatatttaaatgaatagcaaaataacatgtgttgcaacgaaggaaggcaggtttaattatgtatgcgtactatatacttcataatatcaaataggaagccccaatggttgcctgtgatcaattagttgatatatgttctgcttttagccgattcatatattgctttatatatttctcttgtgacaagtggatgtatgattgtttgtgaggagaggtaaggagaaaatcaagaagataggtaagactaggcgagccattagtacataattaattgagtattaattattttaaattttaaaaaatgaatttgtatggtttttagagtagcttttatatataaatttttacaaaagacaaatcgtttagtagttcggacaacgtacacgtggaaaatgaggtaaatcttctctcaatcttcaagtgaagaacacgggggatgaaaaagttttaaactacttttattcagactctctacaattatgcgataagttaatttatgtattcaattttaaacatccgcagtgaaacagtgcttaaatattgctgctgagaattatctgatcaaagcaatttataactgtaaaatacttgtgggaaagaagaaagatatccagaagctcatgcaaaatgtgagagggacaatgcatagaacccgactttatctgcactttgctctgaggattgttctctgaaaccaaaaaccactggtgcaaaatagtagtactactcaaccagccaaacctttaccaaagtgaaaagtcaccatgacgttcgcctgttcttgcagcagtgcacgtacccctgctctgagcgcatcaggctcctctaccttcaaaggtgtgagcctttctcactaacatgtaggcccatatgggcccgatgaaccccaggtccacctgttagtgacaaaggtatggtgtctttgaaagcagatgatct

SEQ ID NO: 78268 - DNA, 1504 bp, Oryza sativa
aatatgcccaatatagtaattttactttctgttaatttgtccacccaatcttaaaaaggctggctttccagcacagagggagtaggcttctttgtattcctcagggaagactccaaatggtagttgtttggccgtcgtcggctcgtcgcctcgtagagatgcatccagggtttacattaccggttgaccactaaatttcgagctatatcgtatcacggttttcgataaatttcgaccaaatctactgtttaaccttcgaaattctaatcagaacttaattttgagtcatgccaaaacgtcgaaatttcacagaattcgaccagtttttgttggaattgtgaacgctggatgcatcatgattcatgtcgccgtctcccactctctcgctactgccaccgcggcgccccgcgcgtccagtgttcccatccctgcggagttgggagacaacgctctcgaaatcgattctctgctcgcatcctgccctcatccaacattccaacacaaggcacgcacacatacatgacagtaacttggcagctgcaaatgcgggcagtatgcacagcacgtagtcacgtatagaagaacggtacagtacgacacaaccaagcagataccagctggccagctcgagccttctcgttggtggtcaacccaaatgtagtaagcttttgtatctcttttccaaggctcgcctggcctggggcaggagaacccgagcttctccgccatggggatctccgccgccgccgccgccgcccccttccttctcctcgtcgccctgctgctgctgctgccgtcccccgccgcggccttctccttcacctacaacttcacctcggcggacacggcgcggtcgggcatcgcgttccagggcgacgccttcttcaacaagttcatccgccttacccgcgacgagcgcatcggccccatcaccagcagcgccgggagggccttcttctcgcgccccgtcccgctctgcgaccccgtctcccgccgccgcgcctccttctccaccgccttctccttctccatcgccgcccccgacccctccgccgcctccggcgatggcctcgccttcttcctctcccccttcccctccgtcctccccaacagctccgccggcggcctcctcggcctcttcaactccttctcacgcgggggcgcagcggcggcgcacccgcgcccgctcgtcgccgtcgaattcgacacctacaagaacgagtgggaccccagcgacgaccacgtcggcgttgacctcggcgggattgtctccgccgccaccgtcgactggcccaccagcatgaaggacggccggagggcgcacgcgcgcgtcgcgtacgacggccaggccaagaacctcaccgtcgcgctctcctacggcgacgcggcggcggcggcggccctgacggaccccgtgctctggtacgccgtcgatctgatggagtacctccccgacgccgtcgccgtcggcttctccgccgccacgggcgaggccgcgagctgc

SEQ ID NO: 78269 - DNA, 502 bp, Oryza sativa
acagcccagggcagtttaagggaggccccaaaattaagcgtcctctttatataacggattcacggcctctatcgtacgaggctacaggttggacgcttgccgtggacaaacggctgaagtgaaggcactagccgccgcgagcatgaatttcaccgtattttatcaaaccagacggcgaagtaggacaacgttccgcccctttcgatgaaaaagtcagaactcaggacgaaaggttctacatctagaatccgcaggtccaagcaggatggagataataatatctccattctcccggccgcaatacaaggaatcctgatttgtaagcttggattacgtgagacactaatacgggacagtgtggcccacatgacaaacagacccacgtagcagtatggccagtatgtattgaaccggttctgctcggctcttacgggctacagctaggtagagaccaatcaatcacgcacgcactgggacagtcctcgccgatgattagaaatcc

SEQ ID NO: 78270 - DNA, 1023 bp, Oryza sativa
tcatattaatctattttttaagtttataataattaaaactcaattaatcacacgttattatcacctcatttgcgtgaaatgttgaaaatttagttataattcggtatattttaatccaaaataacaagataataaacatgatatttacaataggatttgatccagtgatagtggtgaatgtaatcaacattagcatgcttaacgtagaataagcatcaacaaccacataataacgcaatgttgatattacgatgaacattaacagtaaaacttctaattaaaataatataagaaggttataccccaagaatagtcctccgttggagtttgaggcggtattgcctccgttggtgttgacgggaacctccttctccttgtctctagtgttgccgttgtcatgttgccgctgtctccaatgttcgacatgttagtgaagacgaagtagacattgacgaacgcagtgagtagtcacgccttgcgctctccaaaaacctgatcgcccgtccgtccgtgcaaacgtcgcaacagtgcgtggtttcagaggcatactctcccaaacgtcgcagcagtgcgtggtttcggaggcatactctcccaacgcgtgtgcacacactcgtcaggatgggattaccgtagcagcaacagccttggaaatggatgaaagtgtgtctcccttcttcttagggagatcaaatccattctcattttataggaggaatggaagatgaagagtaagagtcatggaataggaagaggaatagagtaactaattctcatcaattagccatcaaccatcctccactacacaaccatcaaccaaccatcaattagaagtaattgatgtaggttaccaatggaatagaaagagaaatagagcaactaattgttatcaactagccatgtgaaagtgcatctaggcccctaatgattttggtgattaattacaatgcgattagagaggactaacatttttattcaagtaaatgtgaaggttgttatgtccttaatgagttaaagtaatgc

SEQ ID NO: 78271 - DNA, 703 bp, Oryza sativa
tcggcggcggagacgaggtcgcggacgtaggcgcgctccagcttctccgtcgccttgatgatggcgtacaggtcggcgaggctctccaggagctcccgctcccgcttgtcgttccacagcttcacctccatctccgccgccggcgagggggtcccctagcctcccttccctccctctccctctccggcgagcgaatcgcggtgggggctagggttccgccgcgtcgcgcgagattggggaaagaggaggaggagagggatcgcgatgggggagtttaggaggtcgaagaattgcgaggggcttcgtgtaaaagtgaagcgatctgtgtaagactgtgttaagcccaacgcgtttgttttgcctttcttccaaagttattactcgacctctcgacgagaaccaaacgcaactacgaattgcacggcagcttctgtcgttcgtttcttccactgcagtttttgcgtcctctcaatagaaacaggctttgcggttaagctcagctgttccaccgcacctaagacgagctaaatcattaatgtataatttaagagcttgttcactttgttaccatttttaactttaccttttttttaagttataaaaaaaagtagctgcatttagtttgttgccaaattttagtaagtacatatgaaatcttgcgaaaatttgacaaatttaccaaaattttggtaaccttatcgaa

SEQ ID NO: 78272 - DNA, 4260 bp, Oryza sativa
  unsure (1)..(4260): unsure at all n locations
cattttgttcaagtgtgagacttctcatgcaagctgcataagaattacggtgacccaacattacacagcctttggtggcatgccgcgttcatcgttcccatgaagctaacatttgctaagtaatgagtcatgctacctaggatagaggaatgcctccctagaataatttagagtggaatctgaagaagaatgttgcttgtaatttattgatctttctgttaattttgtgtaataaacccaatttcatcgaagaactaatgaaaaaatatgcacacacggtccaacacaaactaagtagcagcttgagtattacactctgcaagtcctattcaaataatgttaatatgcatttttttattttattttgcaaatcaatgatgctaccattctaatgcttaagttgttttgccatccagggaccagcgttatcatgaatgagcttacgattggttctatcgccaacttggaagcaccgatagcagaagtggtactaacttggagggtaacgatatgacatattgatagagagaatggcacaaaggtgcacgatgttttgttcttgtttttaagttctcattgttgtgttagtgacgatttccttttgaaaggggcctttatgcaatatcccacttacccaaaagaacagtgatgagatatcaaagctaaggccaaagaattggttgtttgtcattacagttcggcatttccttttttatactgagatttgtctgttgattcacagatttttttacgagtaccacatcatcgcgtatgttgtgttatctcgttgtcatttttttttaaaaaaaaatattctagagcatgagcattaggcattagcagtggctttgaacaagagccagaaacttattaccatcttaatgatgctatcaatagtttcagtgccaaatagctaaggcagttagaactttcaggcttgcagatgttacgtatgacgttagtaatcgcaaaggttgatcatgtccattggtggaataggcatgtcagcatggcaacatatacaaggcgtttcggtaggtattgatcaaatcattgaaaacttggaggactccatcactgttctctgttcttatcctggttcctggtgctcttaccatcttcaacgttaaattcacatgtccagataacccgaacacacctaccaatccaatgcaacaggtccttttgaagtcggatctagaacaacttactgcaatgaacacagatgctttcatgctcagatatacagtaagcgaacaaggttaaccagaagagataaaattggaaacaatagcgtatcaacatcacaacgcattcacctttgaagctggatgacgctgatacagctgttcaaatagccttgctgacactggctaaacagctgaaggagaaaacatggtttgagaacttctcacttacacaagcatagctttaatttaatggtcatgagagactccgcagctagctttcagcattgcatgataaatttctgactgctgaaattataactactgaaaacaaatgttgatactgcatcctgcaagctaggataatgtgagacaggatctaaagacggaaatattagctcagagaacatagcataaagatccacagctgtgcaatgatttctaggcaatacaaaaaaggataaatcgctaagataacaaggagagggatcgcgccgagatcatctaccatctaaataatttaataatataaactacctctgaactcaagtacacaaccagtcctcggaatgcatttaaccagataaaacctaaaaaattgctcactcgaccagcgaacaagtcgtccggcctggccagtgggcattcctagctctaagtcagtaacgcgaacatcttatgatcccttagctccagtcttcattacgcatttccctgaatttagaacatgcaaagttgatgcaaggcaaaatatgttagcatgtgcaaatgaacaatgaacatggttgggataaatgatcagggttctatttacctccaaatggcgacatatccagtttagcctgcaccatctaaggaacttgaggaaccattggcaggtatttgagatcatacctgagaagggctggaccaaatgcattatactttcccgaactgctatatgcctgttcagcatcagcactcttagaaaacactactcttgcgatctttgatttcttgttgatttcagtcgcaccctccatgattggcccgtgcatacggaatatactattgatgtcatccacagaagggatggcttctgcattactaaaatgtaagatcagagctgccggtccatctgcctgtttcacagcaggtgaatcagcagaggcctcatcttgaggtgcaacctcctgcttcatcttcttattaaaactcctgttctgagacagccgcttcattttgcggccctcatagtcacttgatgtgtctccatcatcaaaatcactgattataatatcacaccaatatgagtcttctgcctttcttgctgagtagatactccctgctgacttcctccgacccctatggccatccgccacctctaagtcaccttcttcttttgcagctgggtacaagcttctggccgtattttttctacctttcttgccacccaatgtctgcagcagctccttgtcgtcgtatgtggccggcacttctgagtccttgtattttgagaagaagctaagaatgacaggcacagagtcatagcccttgaagttgaatggatcagcagcaacggatgtaagctgtagaaacatgtcagcggctggtggatattgatactccactgtttcttggatcacctcgtcctcgtccttgaggtgtgcaggcctcccagcattgtttttcctaggcctcccgcgtggcctcccgcgtggtgcaccgctgcccctgccgcccttggagaccctcttgcggtcgaaatcgacttcggaatcggagtcagtggcacccttcttgcgtgggtcccaatcctcatcggagtcatcgaggatttcctcctccacctccttcctcttcctccccctcctcctggatggggggtaggagttgcagttgttgggagtggctgcggcggcggagacattgggtaggccgaggtggagggtgtactcgggagggtcgggtaggcccctgaacttgtcgaaggctctgagatgcgccttagcgacggcggcgtggacacggttggagaagcccatgcggtgggcggccaaatcgtgcagcagggcgatgaaatcgcgggggaggaaggggcgggcgatgcggccgggagcggtgagggcaagctcaacgcggcgctcgaactcgaggagggaggcatcgagggcggcgtcgaagtcgtcggcctcgccatcgtagagctcggcgacggggaagtagggctcgtagggcctgagctgggcggcgtcgcaccaggcgagggccttgtcgccgaagaaggagacgaggagctgggcgccggtgggggcggcggagatgacctcgccgggccaggccgggtgggagagcttcttgccccagaccaggtcgccgggggcgaaggggcatgcacctgctcctgctcctgcccctgctcctgctcctgatggaggatgaggattcggatccgtagccggtggcggtggcggtgggggattcttcctggggcggccgcggccacgcttgggcggcgctagggtttgggggtcagcggcggagttgaggtcgaagggtgtggacatggtgagcgcaagctagggtttggattggtggatgggaaaagtggggatcgatcgatcgatcggagcggaatggattctttggtaagggcttgagacttgagaggctttgggcggaggaatggaatggatgatccaatccaccctcctcttctcttctctagtagcctcctctcctctcctctctcctgtgagtgactactctctactggtgtactgaggaggaggatgagggtttgtcagtgatgctgtgcctcactgctactgttattatttactactactgtagcacggcaaagttaaatcaggggtaaacatcaatgctcactatctcatctcatctacgaaaaacaacctctcttccaatcttccaatactcccgtttcgnaaaccatgacaaagagtggataaactttttggatttttatggcacgttttttgaaactactaaacggtgtgtttcgtgtgaaaaccttttacggtgtgtttcgtgtgaaaaccttttatatgaaagttattctaaaatatca

SEQ ID NO: 78273 - DNA, 10945 bp, Oryza sativa
  unsure (1)..(10945): unsure at all n locations
tgaatggggnnnnnnnnattgagcgcccgtcgtgtgatggatctcacctagatctgattggtatcggcttgcggcactaagtgcagacaaaacatgtggatggtatcagttnnnttgaacctctgccgacatgtgggaccactacaccggcgcaccccgccggccagccttcgcacgtcgaagaccgcgccacacgcaccggcagctcctcctcgcaccgtagtcgcctcctccaccaccagtcgcgcctcttgcgccgcgctggtcagatgtggccgtctgccacacccttggctagccgtccgagtctgccatgcttcctcccaccacaaccacggtctccacagcgctgccactggctcgagctcgccctccgtgtttcctctcacagacgccgtcgccagcctcagccatcgccgccatcagccaccgccgctgccaccacgggcgctgcctcagccgctgccgccgtcgtccatcaccagccgcgcctccagccgctcgtaccaacggccggccaccgttgtctccgcaagcctcgcgtcgtcgtcgctcgccccgctgccgctgactcgtcgctgcgagctccaccgccaccaccgccgccagctcgccccgcctagccagatccgcctctgacgcaccactgccttccccgccgccgtcgccatccccgctgccttcgatccagccgcccggcacagctcgcccctaccgtcgccgtcgccatcccagccgccagatccggccggagcgacgcggatctggcggtcaccgccgccaccacccagagtggttccccaggccacccgggcaaggtctgacggcgagaaacgaggagccccgccgccgccgtccttgcaaccgcgtggctttgccggcgcccgctcagccggcggcgaggcgttgaagaaagatggggggagggggtggccggcgctcatcgcctcccgtgccacctctgataaggaagggcgaagcgagagcgtgctcgttcctgccttgtatatttataaaaaaggaaaatagaaagtgttacgatgtacaagcatgtggtgccaaaaaccatctctatgaacttatgaatgttagaaagtataactcgctgatggtatcttttgttctagaatcgtgattatacaactgatttagtatttttaatttctaatgctgataacgagcatatatacatgtaagctaatctggaaatatacaaagtgaagaaaaaccaaagccaaagtccaaactgctgcatgcctctatcttcttgcaacaaggacgtcctgtggggtgtaaccttgtaaatgtgtgatcatccatcaaagtcgtcatgatactgtccaagcacacacgttcataatcacaattttactaacatgaagatgatataaaaaaaagtatccattggtagctgatgaaaaagcaagataatattatcctcgatagtctactaatgatcaaaatataacatcttggttagaactaccattgtcggtgaaatgaaaaacaaaatcctcatcgctagcgactcagggcatgtctgcccccagggtgctatcctcatgggttgtgctcgaggcacttcactcctcgggacgaccccttgtgggttgtgctcagggcacaactgtgctttgcccccaagtgctcggaagagcaacagcgcattgttaactctcgcaagctcagacttcctcacgtgtgtattctatcaagcctcacactcagtgcgcaaggtgtatatgccaacctggtgtgcgaccggacaacacgcaataggacgaagcacacctatcccctgtagcacgtgtcaccctggaaaaacttttgacttcttcacttcactcgttaatcggcatgtgaaacagtcacctccgctaggcctaagggatatcgacaagaccaagcatgccgaacttaaggagtagggcccactctcatatgtacatattggtaccgtggacccccccccctccccgtttataaaaggaggatccacaccacctgtaagggggcttgcttttttcgatgtcagattaggcggagttaattagactgattcaagccaagttagaataaactcacacttcaagagaagaagagttcatcatctcctacttagaacaacatccacccaatctacattgtaaactttatcaccctcattcataacaagaacacaagagtagggtgatacgcttccgagcagcctaaacttgtctaaaaagaccatatgttcttatttgcatgattcgattgcctcgtttccgctcacccattccatagccaaatcttccttggggggtgccactcctccccgctgaaggagctccatacaaccattgatatacataaataaggcttgccaccaatgcaacaaaacactaaagtgattctctatctatttgtagcctgccaatagataactatttttttcatatatccctattaaaataaaacaaatcatagagacgtgtgaaagatatatgtgatataataggaggtcaattatcagaatccttagagataatttgagatgaaccgtctcatattatgccattgcaactacaagtgctcaattatcacaaaacaaaatttaaatcattttgtgaatgttgctataatatatttattgaaactacagggaccatctaacatccatgatgatcggttatttcataattttacaagtagggatatttaggatttgatactcataaaggtggcatttcaggatcccaaaaaaaaacctccgtgcctatgacatggtggttgttctgatcccacaataacagatgcgtgagtggtacatcctaaattgtaactatttatagatcaaaaaattcaaaatccctcttttaagtaaggaactagttgtgataatacatcacaatggattgagaaatttttcacgccttaagggtgtctcatcattgattcattgtatcaaaatacatgccaatactagttatgaaaaaaaactggtagcattggtataataaatatatgtctactatccgaagatttgaggactaattaagttcgactcacaatgagaaacataaatgacaaattcaaattgtaaatattgcactattcatgggtatatatattttgccttctttttcccccatttagttggttgagagtcgtagtagatgcaatatagtactctatattgttgattttttttcagaatttttatcactatttgtcttgtttttaagaagcagagctacaacagggctgggatagggggtaaaaatccactacctggtggaataaccttcacaacaaaatctggggtgacccaattgatgttcttgatcacaataaatcaaaaatatccaagtttacatgcatgcatgaactcaataccagcccccaattctccaaaagttgaaaaaacaaattctgaccatgactataaattaaatgtggggggaaaaaatcagggcttgtgctagctaccaacaaaccatgaatatatatttctagaagggaaaaaaacaagacaggaatattgacaaggcgagaaaccaacaaaagtgcatgggcaaaataatcagtcccccccaacttgaaaaatctcagctgcttgaaaccccccagccacaaacccaatcctgaactagtggctgtgtggatgaactctgattggattccagctactatttgccatccatttcttgctgaattctctcttctttaattcatcctctcttctcctcttctccttcatcactaggcagtagccacagtagccagtagctagctagcttgtcaagctaggagctagcagctgtgtgtcgtcgatggcatccaccgccgccttcctgtccacgctcgccggctcgaccagcctgggcggcgccacgccggccagcggcggcgggagcgggaggagcaagacggcgaggttcttgaggaggcggcggcgcggcggcgcggtgagggcggcggtgtccggcacggagcaggcgccggagacgacgaagaagaagggcggcggcggcggcggcggggacgagcgggtggtgcaggtgcacagcgcggaggagctcgacggcgcgctgcgggcggcgaaggagcggctggtggtggtggagttcgcggcgagccacagcgtgaacagcagccgcatctacccgtgcatggtggagctgagccgcacctgcggcgacgtcgacttcctcctcgtcatgggcgacgagtcggacgccacccgggagctgtgccgccgggaggggatcaccgccgtgccccacttcaccttctacaagggcgccgagaaggtccacgaggaggaggggatcggccccgaccagctcgccggcgacgtcctctactacggcgaccaccactccgccgtcgtccagctccactcccgcgccgacgtcgagtccctcatctccgaccaccgcggcgagggcggcaagctggtggtgctcgacgtggggctcaagcgatgcgggccctgcgtgaaggtgtaccccaccgtcgtgaagctgtcgcgcaccatggccgacaccaccgtcttcgcccgcatgaacggcgacgagaacgacagctgcatggagttcctccgcgacatggacgtcgtcgaggtgcccaccttcctcttcatcagggacggcgacatcgtcggccgctacgtcggctccggcaggggggagctcatcggcgagatcctcagatacaacggcgtcaaggtcacctagacatatacagattcatcactacgcagctcagctgcatgcagcaaccgtaattaaattaattactgtactactctcttgatcatgattgtaattttacaccaccacactagcttgagaagatcaagcttgttttatactggggacgatttgatcaaacctatctcgttgatttggtcccgtgtaatactagaattttggaacgtcaattgcaagttcgagacttgattttgcctatgattgtatctgtatccatccatctatcataggtggtgttcttatctctgaagatgaagattaagtttttttacgcaaaacaaggtggtattaacatatgattgattgagttttgattgttacaaacttaaaaaatagattaatatgatattttagagcaactttcatatagaaagttgatcatcactactgatcgatgtttttacacttaatggggacgatttgatcacactatctcgttgatttggtcccgtgtaataatactagaattttggaacgtcaattgcaagttcgagacttgattttgcctatgattgtatctgtatccatccatctttctatctatatgattgcccagttaatttatcttctgattaccttctttcttaattaattaccccatgtctcaaaaagaagataacaatgatctgctcaccaagagcaatggaagccacaagatgaccaaacaagaactgctcacaggtttgccaaacatttgtcaaatgcccaaactgaatctgaagatatttacaggcttccattttcagacggaaagaaacagagggtagcgtagggaagctgcctacgccgtaaagaaaagatcaacagcaatggcagcttgtcctccacaagttcacatcatctcacagcaagttgctttcacttccagatcttatgcactacttgcaggtggtaatgtcggtcaaaaactggacaaaattgccttccttggtttgctctgctgactgctggtcctgggatgtcatcacaaggaagcaatccagatcactagatttacatagttgacacaaaagggttcagttcagaaactgctcaattagtgcatgccctaacgtaaaaaaaatgatcttctgttcattggtactgttataaattagcggctgtcagcatcagttatgtcacagcaacggaacaggctcctaacagaagatgaccaagttgcagataccacagaatataaattactgacattctagctaaaaaatcctataaatctcttactgcacaaaaacagcaaactagagaaaggagtagcttgggactattcctctgcctcggcctcggcctctccttcctcttcatctgcagcccaccaagcaagaagaccaagaccgtctcctttaatgcttccctgcgaaagcattagtcagcctagttactcatcaaaggacactaagccagaattcaaataattgagcataattctcaaggcatacaataatttgcattggagcaaatgccctgtcagtctccttttgctcgactgggataggcgggtattttatgctagataccaagaatcgtatctgcgtagcaatcaagttgatcatgagcatacagagaatggtaattgctttgatttttttttagaaaaaaaacagattttgtatacctcatcatctaaatcaagatagagctcatcaccatcttcagtcttcagcatccacctaccatctagcgccctgggggaaatgagcagcaaagaaaataaagcaacataaatttatgtagaaagtactttcctcatgacaaacagaacaaggtagcagtgtgtactcagcagtctcaggtgacatccactgtcctcagcagttgtagagtttgtttttaaacacagataaagtaatccagaacgtatttaagccattgcaaagattctgtatttctgattctgttttagttcctgactgaactaaatttcaatagtatttttttttcataataaccaatctggttgaagtacatgccaagcagatgcaaacataacaagttaatctaagaggaatcaaaatcaaaatgtatgatataactccagagaagagtaagaacctcaagttttcaaattatagtagttactgctgtacaggaacaacaaaacaaaacattacctagccgtgccatactgcatcaagtgcccgggaatgcttatatcactgaagaaatcaagtgaaactgccaaacagatgtagccatatcagctcaaccaattgtttgtgaatgaggcttttcctactaactagtaccagaagaggaaggggccatttgtaacttttatacacatgtgaggcacaaatagtccaacagtaaagaacaggaattagttaagagtacacgcttgtcaaagataaaatttacatattcagtttaacaggatactatgttgaaaacagataactatagttcagaactaccctccagatatttagctagcaatggtttgtgtaccccaagaaatgtaatcactcttatgcaattgaggatgctgattccaggttagtaatcaggtctacagtggcaaagaagcatactatgatattaatcaacatctatttcattcaaacaaaaggatatatgagaaagtaaactagtccattgtttcgaacagcatgacctcaggataaaatagtgcaacagatacagagttaaacatcatatacaaatttcgtagcttattcttagaagacataagacatactatgacatggaaatatgaacataaaaattccatacagtacaaaatgttatccgatgttatagacaactgctacaaaaggaatggaatattccaacaggcaagataactagataagagattgccagcaaaccagctctttaaatgtcaataagaaaataagcaactcaccatgcagacccttttcatcatatccactgatcttcccgacaagaacctccccaacgaagggcctgaacatcagcaacctaaaggaaacctatacaggatggggaaaataaggaaatctaagagtgatttgcaaattgtaggaatcctcagaactaaatgcataagttcactgagacgacgtgttgcacacaccacactaacagaaatactgtaagaaagagcactgatgttaatagacacaactctaatcacaatgggtcattgagaacatgctatgttgtcatcaagtcgatcgcaactagtacataggctcgaaatacactaccaacatgagtaacagaattaatcaacttagagcttaaataagtctccaattgtgctgaaatatttttcaggcattcacctcctacagaatcttatgagacaagtacaccaccaagcagacatgtatcatacatatatcgcaattccatcaccaaaacaaaagggtaaaagcaatgggagcacaaattactttgtaagtggagcagccctctcctggaaagatgaagcctccttcgacggagcggatgtcgtagacggagacgcagagcccgaggttcgcgacgacctacatacagcacaggtggggggggggggcagaagcatgcaacacatcatcataatctcttgtacacaaccgtccgtgagcgagacaagcatcaacaacaggggtgactgagctcgtggtagttgattaccttgtcgaggaagagcctctcaagctcagccttgatggcgtcgacgagtggccggctcagcaggtgcggcggcatcggcaggttgtgttcgatctggctgagcacgaacatctctgcgctaaagtggcggacctaggatttagaagctgtgtattcaaaataacatgggttttttttctacacgtctacacccaaaatcctaataattagcttgtataatatcacgtactagtaattatatagtatatagtatatgcaccgtaacattgagcataggttcgtatagtatattgataaaattggtcataataacatactaatacacaaaatgaacattaaattctctgaattccaaacgattgtgtctcatataaaaaatatagtgaattactgatatacacttagccacacttaaccatatgctagttgaatccccttagctaactagataagcaagtgttaaagttgaataacaataagcggttaaatgaatcctcgattcctgatggctaactaggctaatcattcagtcgaatcggtaaaatagaacttcagataaaatcagcaaagcaaatactaagagcaaagcagcaagcctctatacagactatactaagtgctaaccacaagcgaatgcgccgaaagcgggaagccaagagcaggactaccgctgccgtgcggccgtgccgccgcgcgcctgcaccgcccctgctgcgccgccggagcagaggagcgcacagccccaccggcggcgaggccgagccgacgggggtgggggcggcggcgtcgcggcgaggtttgagaggcgagggcgaagggaggaggggtgtggtttggggtgtaatgggctgggatgggccgcggggcgactaatagctctgatgggaaaaaaaaaggaataagtacatctgaggtcccttaacttgtcaacgaatccgattttcgtccctcaactatcaaaaccggtacaaattagatccctcggcggttttggctgatgtggcacttatatggctaatttgactcgtcttcaactgacatggcactcacgtggcgctgatgtggcaattcgattcgaaaaaataataaaacccgtggggcccacaagtcagttcacacagaaaataatttaaaaatggtagggcccacgcgggccccacatgtcagcctcactcctcccttcatccctctccctcggcttcctcgacaccattgacctcaacggcggccgcgccgtctccctcggcacctccaacatctacggcttcctcgccaccatcgcccccgccgcagcgcacaccaccccacgcccgccgccgcgcctaccaccaccaccccaaatgcggcggcacggcggcggccaccccgtctcctcctccttctccccaatgttgggatccatgtcacggcggccggaagggcgacacgacgagcaatggccggcggggaaaaaggacaaagcgcgccgacctggaagatgccgccgccgccgctgccgcttggtgccaagatctggaggctggccgcccgtcgccattgggagcctggaggcctgctgcctggtgccctctgttcggcggacctcgctcctggggaagacgccaccgtgagccgatggtggggagcgagcaggcaacatcgggagtggaagatggctggcgggatggtgagctcgagctcgccggctcccctcccctcttcctcacctccgtcttcctcatcggccgccacctaccgcgaccccctcctcggcaaccgcctcccacctgcctgtcgacgggatggtaagctcgagctccgcctctgctcctgcggcgcgggggcctcggccgagttggagccgcacatgggcaggaactcggcgccactccccgccgacgacgaggctggcgccctccgcttggctccgccgccccatcggcttcgggtgcaaccacttcgccctcgcgtccaccgccgctgcccactctgccccgtcggcttcacaccgtcgttcgcccgccgccaccccccactcgaccccgctgctctaccacccacgcgaagataggggagaagaagggtgagagaggagaaataaattgctactgactgacgtggggcctatgtgggccccaccatatttatttgttgtgtagctgacatgtgggccccacttttttattattatttttatgtagctgacatgtgggcccacggtttttattatttttcctatatataattgccacgtaagcgccacatcaatgccacgtgggacagccctaatcaaattagccacgtaagcgccacatcagccaaaaccgccctcaaaaccgccgagggacctaatctatactggttttgatagttgaggatctatgtctcaatatcaccctgaatttggtaaaagtttgattgagggttataaacaagagtagcaaccaaaaaaatccaaggtttcaacagagagaacaagtaaaagaataaccaaatagtcccgtgggtgtatgaacagagctatatcaccatgtaatttggtccgatctggctcagtgatagaaagcatgtatttcaggagatgccatctcacagcggcgctcatt

SEQ ID NO: 78274 - DNA, 37401 bp, Oryza sativa
  unsure (1)..(37401): unsure at all n locations
atgtgttttggaatttttcggagtttttcgaaattcattttcggactttccgaaaatacacagaaccacttttcgcttctggaaattttcggatatgtctgaaaggcattttcagactttccgaaaatgactaagaaggcaaacatggttctgtatattttcggacttgtccgaaactgattttcggattttccgaaaaacatcagtagagtctctttcgcttctgtaaattttcagagttttccgaaaggaattttcggactttccgaaaatgtccagaagggtgtttttggttctggaaattttcggacttgtccgaaaagttttcagaatgtccgaaaaatcttcagttgactttactgtcggtgccgagctggaattttcggacttgtccgaaaatctttcggaatatccgaaaatcccatttattgtgcacaacgggcagaatttgggttgtggctataaatagccccatcccctcacttgtgagggctgctggtcacattggatattcttgtgcccttggcttgctcttgttgagattcacttttgagccttgctttcttgtttcccctctcacccgtgttcgattcggatttggtgtgtgtgtgagagttgtggattcgagtttgtgtgagtacttgttgttgacttcgtaaagatttgtgagcacttgcatcatctccgggagttcattgcatcatttgttactcttggaggttgaggactcctaggcggctaggtgttgctcccgagccaccgatctacttgtggttggccgggagaagtttgtgaaggtcgggtctcacctccgaaagggaagagatactcttagtggaaggaggagtgcttagtgcaacctcttgaggaaagggtcagctaagacccggctcttagtgagctcctcaacggagagtagaattccctcaaggattcgaacttcgggaacaacttcgtgagcttcatctttggtgacttcacatcctccctctcctttagctttgcttgtttgagccgctataggtctagttgctgtttgtgctagtatattcttgttgtaggcaactagatctaggttttaccttgtgtttgtgctgactccgataaattttcggatatatctaaaaattttggaaatatccgaaaattactgcttccgcttttaattgaattcttgaattagcctattcacccccctctaggcctaattgacactttcaccatcaaccatcctccactacataaccatcaaccatccatcaattaggagtaattgatataagttaccaattccctaatcaaatggattaattctcaaaactcttcatcccattgatatcccataagagaatgaatacacatgaattcctagcataatgagccttggaatttatttgatttaaatggatcaattacccaattaaatctaacatgaaacacttaatcttcatcttcaagagattcaaacaccaccttagggcctgcttagttctcaaacaaaatttttcgcgttgtcgcatctaatgtttggacacatgcatggagtattaaatgtaaaaaaaacaaaccaattatacacttcgctaggattaattaggctaattgcgccatgatttgacaatatggtgctacagtaaacatttgctaataacggattaattaggcttgataagttcgtctcgcaatttcctggtggaatctgtaatttattttgttattagactacgtttaatacttcaaatgtgtgtccgtatattcaatgtgacatgcagaggcaattttttttttgccaactaaataggctcttaggccttgtttaattcgcgagacgaaaagtttcgacatatcacatcggatatacggacacatatttgaagtattaaacatacactaacaaaataaaatacagatttcgcttgtaaactgcgagacgaatttattaagtctaattaattcgtcattagcaaatgtttattgtagcaccacattatcaaataatggagcaattaggcttaaaagatttgtctcgcaatttcaacacaatctgtgtaattagttttttttcttatatttaatactccatgcatatgtccaaacatttgatgtgatagggtgaaaagttttttgtttggtaactaagcagggccttaaattcatacttcccataaaaatattaaccaaaactgatttggattatatattcacctttacatctgctcttaagtttttcttgtttttagtccttgtgttttccaggtgttgcctttcagaggcatttctattaaatgttactttaatcaaaacatacgtagctctcaacaaagttatgtatacctcaccgttatatctagaaaacatattctgcctacataagctttcggtgcaaaatatctcaattttttttgttaaaaaaatatacacgtacttccaatgttacaacacatatgtgcaaagtactatctttaaattaattatgttttagccgtacaaagaaatacaaaatacaaacaattttaagagttattttttttggttatgcaggtgcattactaagagcaggtacaatagcagcctataagccagctataaacatattttaaagagataaagaaagagagagaagagcagcgggctacatatttgtagctaactacaacacggactccaagacgtaatgtatgtatgacagataggaccagatattaatagtatagcaagcaactattgtatgaattgactattacagctatagatgatttagagctaacaatgggctatactattaaatttgctctaacaatagatttgttgacacaaactccctttataagcacgacacggtacgacatacgtatgggttaacattttgattggtggcagctgctgcagggcccaattcgaacacaagtcccacggcctgtggtaacccagcccactccaccacaagaccaataatcgattatttattactcccttcatattttaatgtatgacgccgttgactttttattcaacgtttgaccattcgtcttattcaaaaaatttatataactatcatttattttattgtgacttgatttattatcaaatattctttaagcatgacataaatattctcatatttgcacaaaaatttgaataaaataaatggtcaaacgtttgtcaaaaaaatcaacggcgccatacaaactaggcttccatccaatggcaatgggggttcgatcaagcacgacaaagcaaaaggaatcgaacgattaatagctactcctactaaacagtactactcaccaccctcttcccttcattgctgttgatgttgtttggtcttttttttttgttaatttgtttattaaaggaaaacccgcaccctcactctcagtctagctccctgctgcttccacagctacttaattgtaggatgtaggatggtgcgtgctagctgcagctcactactacaactgtactagctagcagatcgcagctagtagcagagaggagaggagaggagttgatctgaggtaggataggagagcagcagatcagatcagatcgatccgggcaggcgggcagcatggcgtcggcaggtggctgcaagaagaagacgggaaatagtcgtagtaggagccctcgtagcccggtggtgctgcggagggcgatgctgcattcgtccctctgcttcctggtcggcctccttgccggcctcgccgccccctccgactggcccgctgccgccggcgccgccgtcttcctccgcacgctccgtgccagcaatgtcatcttcagtcgcagtagcaataggccgcagcagccgcagctggtggtagtggtcaccaccaccgagcagtccgacgactccgagcggcgcgccgccgggctgacgcgcacggcgcacgcgctgcggctggtgtcgccgccgcttctctggctggtggtggaggaggcccccgcggagaagcacgcggcgccgcccacggcgcggctgctgcggcgcacgggggtggtgcaccgccacctcctcatgaaacaaggagatgatgattttagcatgcagatatcgatgaggagggagcagcagaggaacgtggctctgcgccacatcgaggaccaccgcatcgccggcgtcgtgctcttcgggggcctcgccgacatctacgacctccgcctcctccaccacctcagggacatcaggtacagcatcacaatacatacctacgtatatgcgtacactacatccttattagagtcttagaaaaaaatactcgtacgttgtaacatgttatggtttagttaagatgaaattcactatgtgaattcacttgaatctatatatttctagaaaatcatgagctacagttaaaagtccgacgagtccgctcatcacaatttagtatgcgagttttttttaaagagattcttttatacgattcttcctgtattactaaaaagcgaacaaacttaaaaaaaaaaccagatatgtatttccaaaaacgaacgaacttggaaactgactctacacgaatgacgtgccaaagtaccggtaaaaatattttcaatttttataatataggctgtgttcccttcaaaacttccaaaaattccgtcaaatcaactatttgtacacatgcatggagcattaaatgtggataaaaaaaaccaattgcacattttgcatgtaaattacgagacgaatcttttgagcctaattacgccatgatttgacaatgtgatgctatagtaaacatttgctaatgacggattaattaggtttaataaattcgtctcgcggtttataggcggaatctgtaatttattttgttattagtctatatttaatacttcaaatgtgtatctgtctacttaaaaaaaaattggtacaccaactaaacacctctatagtagaggtaaagatattttagtcaacactcaactacattccgctatatataggcctgggttagttactaattttctttttaaacttttaattttaatgtagaactaaacaaagccatactactccagtatgtttttaattactagtagtgagctagctagctagagacaaacaatgtacacataacatggaggcctcccggagtgatagtttttgtacgtaagcaggtactccctccgtcccaaaataagcatagccatgaattttcgtgtctaattttaattgtccattttatttaatttttttaaaaaactaaaaaaaatataagtcacacataaagtactattcgtgctttataatctaataacaaacaaaatactaatcataaaaaaataaataaaatagatgatcaaaattgaacacagaaactcgtaactatgtttgtttttgaacggagggagtactacgaagctagggtgtcggtggatggaagggccctccctactactacaatagctactccttaggattcaaaattatatatgtgtcatcctattcacatttttctctccaatcactctttgaaatttctccccattttactctatagtgcaccctccatccctaaaaaaataaaattagagataaacctggataaattcattctcaaaaggtactacctccgtcccatattacttgtcgctttgactttttccttataacgtttgaccattcgttttatttgaaaaatttatacaaatataaaaagggataagtcatacttaaaatacttttgataataaagcaaatcacaaataaaataaacaataatttcaaatttttttaataaaacgaatgatcaaacattacaaataaaaaaaggtagtatctttttaagacggggagagtactctataatttattattatgtaggagtacttactactaatttaaagttgagcgtgaaaaatgattgctgaaattaaaatgagagggatgtcgtagcagtagcgcgttaattattgtatatggccgtacagtgcagtatagtacaggatgtgtcggcaagaatgaatgatttgatggggctggcatatgtaaatgcaggacatttggtgcgtggcccgtggcgacagtgtcggcgtacgagcgaaaggtgatggtgcaaggcccactctgcatcaacacatcctcctcgtcggtgatcacccgcggctggttcgatatggacatggacatggcggccggcggcgagcggcgagcggccgctgaccggccgcctccggagacgttaatggaagtgggcgggttcgcgttcagcagctggatgctgtgggacccgcacaggtgggaccgcttccccctctccgaccccgacgcctcgcaggtcagccactgcccagtgcccggaaagagatccctgactttgtgcagtttgcagttatgccactggtgacaccagtggcataacaccagtggcataactgcaaaccagtggcataactgcaaactgcacaaagtcaggggatcctcattcccagtgcccacccatcatcgctacctctcactcgatctactcctgccacgtagtagtaattaattagcctaaccacgtcgtccaccccaccttcaggcggaccggagtattatatcacgattctcaatttcttacttattagtcattccatattttaacgtataacgtcgttgacttttaagtaaagtttgatcattcgtcttatttaaaaggaaaaagtacgttttaccctctgaactattgtgacagtacgaattaccctcccgaaccatataatcatgatatattacacctcaaactattgataccggatgaattacccccccgactcaatactgagcggttttgctcctacgtggcatagacatggcgtcgatgtggaaatccaatcagcaaaaaaaacacacacacacacacacacacaagggcccacatgtcattatctctcttcagtcttccccctcccccttctctctctcaggcgtgcgtcaacgggcaatgcgcgacggcagcggcacgcggacgggcggcgagcgcggcaaggagtggtggggccgagacaggcggcgggcgggtcgggggcgcagcggacgtggtggagaggtggccggcaggcgtgacggcgcctgtgccctcctgtcgcggcggcagcggcgcgcggacaggcggcgagcgggggccgcgggcgcggcgggtggcgcggcagggagtggtggggccggggcaggcagcgggcgtggtggagaggcggccggcgggcctgacggcgcccgtgccccctatcgcagcggagggcggcgaagtggcgagggcggcgaagtgccctcctctcatacctctctctcgggccgtcgggaggtcggtgcgcacgcctgagcttgccgtcgtcatcttcaatgtcctcgggaccttggcgcccgtgcccgtctcgccctccccaccgcgcccaccggagctcgaggcggcaggaggaggggacagcgaaggggagcctgggctcatcgtactccagcaggagcggctcgaacgacgacggcggcggctgggggatgactccgacgactcttccggcctccacgctccctcgccggtctcctcacctccttcctctctgcccgccccgctaatgccggcatgcttcggccgccgccgctccgcccgcgttgccaccgctgcttcgccccgccgctctgccgccggcgcgcgagtcgcagccgctagcatctaacgggagagagagagggggtgagagggaaagagagagagaatattatgtcatgacaggtgggccctatcctttatttaatgaaaaacttgctgactggactgccacgtagaccaaaaccgcttacaaaactgttgggggggtttcatccggtatcgatagttgagggtgaaaaatgactggttttcaggtttagggggtaattcatactcacccaatacttcagggggtaattcgtacttttcctatttaaaattattgtgtaaatataaaaatatttatgtcattctgataaaacatttgatgataactcaagtcataataaaaaaaataataattatccaaattttttaaataaaacgaatgatcaaatgttggttaaaaagtcaacaacattatatattaaaatacggggaagggagtactttcttgtcatgtcctggggctggtcctagctatagatagatcagtagtactacctcgtttcagattataagactttctagcatttgtccatatgtatatagatgttgattaatctagtcacacacacacacacacacatatatatatatatatatatatatatatatatatatatatatatatatatatatatatatatatatatatatatatatatatatatatatatagtgtgtgtgtgagtaaagtcgaaacgaaggaagtagctagctaactgaaaagagattaaaagtcggaagaatataatgcgcaattcacgtacgcacacgacactagacacgcacaagctccgcgtctgtctgctttctttttggtttgtttgtttgcttgcttgcttaatttcatcaatcatttccatatattattccagcctcactagctagaagcctttcagcgtgtagtagtagtacatgtactataattaccgtacagtttggatcccaatctgcagattcatcatacataagtacacagtaactattgacaattacgaagtaggagtacgtactagtaattgagattatatatatatatatatatatatatatatatatatatatatatatatatatatatatatatatatatatatatatgcgcttaataatatgtgtatacatatatatgcaggaatcagtgaagttcgtgcagcgggtggcggtggaggaatacaaccagtcgacgacgagggggatgccggactccgattgctcccaaatcatgctctggcgcatccaaactacgctctaggctctagctagcttaatttcattcttcttccttaatcatcgatcgtcaatctccaaaacccacactcctactcctatctaagacaaatacctgcatataaatatatacacacgtatacgtggtgtgttcacgtacggttaattaagctgcaaggaagtactccgcaatactacatgcatatatgttttcaccttacttacgtcgagtctttgtgattctcggtctctttttaagtaagagtgacaatatattcacgaggaaaatacatcagtgatataccacaacctgtgtggagggtgaaatttttagtcactcgctttgtaagttgatcaacccagcttaagattctgataagcagctgctgagaaactagctggtgacttctaagttcattttctagattctacaactacagactctcagaatctggataaaaaactagactgtttggaggagcttctggcaactggagattctaagagaaactgaaggtgttagaagctccccaaacagattcataggctaaatcttgtccaacagatgtcatttctgctggttttctcttatagcatggacacacacgatgtataaataaatcaacagcggaggcaggtaccaaatcatgacagttgattgtgctagattcaatggttcaataatgtaggtaccagacaacgccatctaatctgggagatggtaccggctcgaggaacggaattgctagaaaactttcgcaagtttttcttttttgcccctaaaacttttgagatttgtgcattaacgtaaaaaaaaagataatctccaagaaattctattgacaagtgtccaaatctcagaaatggcatcgataagtgtgagttttaagaaatgccatcgtacaaacgactttgtcctaaaaatgccatcgtcgttagggttatgtccattccacgccattaaattctataggatgaacagtgtatttaatggtgtaaagtggacggcgatggcatttttgggacaaaatcgtttgtacgatggaatttcttagaactcacacttgtcgatggtatttcttggatttggacgcttgtcaatggcatttcttgaattatctctaaaaaaatcgctagaaagaaattttcacgcatgccacgcgtaagatccctatgctaaccaaccaaatcatagttgaatacaagttttatataaattacatcgtagttataatacaattacacttcaattatgtgatgtcgcatgcgtgacggagaggagatatttcagcgtctcgcgtgaaacattgaggtcgcgcacctctgcttcacttcattacctatcatgcctatgttaaatgaatggttgtatttaatttggtacctggtggtaccgtaccagtatattgtattatcgtaggcgcatgatgttatggtccgcctgtaatttagtatgtgtttggttgcagagatttgctgggtcgggttaggtcgaatccgcttttatagatgtataattgtggggttagatgggacgggttgactccaaaagagaatatcctcctgatatttgggttcgactcccccatcattagtatataaaaaaccatcataggtgtcagttcccaaccggctatatgtgccggttttcctaccggcacctattgatcgacaccaatacaagcaaccggcacctataccaaaaatagaaccggcacctataggtttgtacgagcaaaaaaaaagagccggctcgaatcgagccggaactcgcaatcgcaatcactgcgccatgccccacatctagttttttgaaatccccacatcacagatcatccaccaatcacagatcaaaacatattcaacaagaaaagcatccacaaatcaaaaaacatcttaaaagaatctacaaaatcatcccaaaaaaattcctcaggcgccgccgcccgccgcctcccctcccaccggatttgacggaggggagtgtgcggcggccgccgttgctgtctccgaggtccgccgtctcctcttcggtcggatcgagcggaggggacagcgccgcggcagccgccgccggccgttcccaaaggtccaccacctcccctccggctggatccggtggaggggagggcgcggccgccgccagccgctgctgccgcctccgcctggccaccgccgaagcccgccgactcccaactgcctccctccacaggctcccctccacgccgccgcctctgtctgtggggtgcccgccgcctccccacctgtcggatctggcggagaggagggcacggccgccgccgcctctgccgcgtccactaggccggttgccagccgcgggggcttgccgtcttcgccatgcagccactgccgagagagagagagagagagtggtgggagagagacgcgagagctgagagacgagagaaaggtagtagatggataaggcggagagacgagagaaaggtagtagatggataaggcggagaaacgatttgataaggacgcgtggtggtgtggtgcttatgggctcggctcgccggcttggctcaaagctataggtgccggttttttaaaaaaacggtacctacaatatatgataggtgctggtttttttaaaaaaactgacacctatagtataagtgccgggtttttttctagaaccagcatctatatatattgtttaaaggtgccggttctattttttccatcgtagggaggtgggaaaagctctataggtgtaggttttaaatgaaccgacacctatgagccgttctctatgacggttttttagtagtgcatgaaaatttggcggaccgattcgacccaacactctcgcgtgaatcacgtgaggcagcggcgaggttgaccacgcgtcgcagcctcctccctttgtgcttcccctccctcactggcttctcgtccaggaagcggctgcggcggcggcaacagcgacggcggtgttggtaggaagcagtggggaggttgatgcgcgagggagtagtcgtcacgacctctttccttctccctccacacttcccctcttgtgccatcttcttgtccaagaacggaggaggcggctcccagcgacatcactctcgtgcccttctctttgtgatagctggttggttgcatgagactattgaaattcctagcgatgatgtttttttttcaataaatttcatcagaatagaacaattttttatatgaacaagtgttaagacaattctgaagcagctatatatagtgggtggtctaattaattaagctaattctaagacaattctttgtgaatccccctaagcctagcctaggagaccctctcccctttccacccttccctgttccatttgtaccctaactcaggaccctaactaatcacgattgccgctgcggatcgtcagagttggaggagaagcccactagagtacgaatcgcgaaaccgaattgaagtttataaatttgtcagaatttatctttattttactatatggaatgtggtttacagattcccgataataataactaatagagtttgggaccatgtgcgtatgtacctagatagggagctcagctcattgatgcacatgtacatgcgtccatgtctggtacttacttgcgggtaactagcacgcacttgcactaattggatagatccatccatcacgatcgagctcacctatggatgcctacgctatataccacacttaaaatccactcttgcgtgcgtgcttggtgtcagtggaacaagcaccgaagaacgactatcgatagaagttgatgatgaggcgcagcttggtgattgtgatggtggcctgcagctgcgccacagccatagccagaggaggaggaggaggaggtctgaagctcaacttctactcggagtcggagaggtgcccgagggcggaggaggtggtgagggaggaggtgcggaggctgtacgaggagcacggcaacacggcggtgtcgtggttgagggcactcttccacgactgcatggtctactcctgcgacgcctccctgctgctccacaccaccaccaccacaggcgtctccgagcagtcctcccaccgcagcttcggcatgcgcaacttcaagtacatcaccgccatcaaggccgccgtcgagcgtgagtgccctgccaccgtctcctgcgccgacatcctcgccctggccgcccgcgacggcgtggccatgctgggtgggccctcggtggccatgcggacggggcggcgcgacagcagggagagctactacggcgtggtggagcagtacatccccaaccacaacgacagcgtgtccaccgtgctgtcgaggttcgcggccatcggggtggacacggagggagcggtggcgctgctgggcgcgcactcggtggggcgcgtccactgcttcaacctggtggggaggctgtacccgcaggtggacggcagcatggaggcggcgtacggggagtacctgcgggggaggtgcccgacggctgcggcgacggaggacacgagagaggtggtgtacgcgcgcaacgaccgcgtcacgcccatgctcatcgacaacatgtactaccgcaacctgctcgccgggcgggggctcctcctggtggaccagcagctggcctccgacgcccgcacggcgccctacgtccgccggatggccgccgacaacgactacttccaccagcgcttcgccgcagcgcttctcaccatgtccgagaacgcgccgctcaccggcgcacagggggaggtcagaaaagactgcaggttcgtcaactctagctaagctcgactagctagtagtacacatatacatacatatatgatcgatgtaaaaataattgaggtacgttctatgagatcgatcggtctgtgaactaatcgatcggcggcctctatctgttggcatcgactcctccattggatctttgtatttttctcaacttgtatgtacgtacgtatgtatgtggggttccgtcgagtcgtgtgtgtccgtgaccgtaactggactcaattattatggagtaacataatatatattgtatgcgtggcgttccatcgttacaaatatgcaacagtgtctatcatcatagcagtagtgcagtggcggcagcgacatgtttcgatggatcagattcaaaatactttgggggaataagttcaccggaggtcccttaaccacaaaaccagaaatgtctacccctaaactcactcgaaccgttcaccggaggtccctcggcagtattttcgcccggttttgctgacgtggcatcctagtcagcaaaaaaaaattaaaaaaatacatggggctcacatgtcagctgcacatttttttcttctcttttcttctccttctctcctcttctccttcaggctgcaggcggaggcggagcagccgcgcgccatggccgccgtcgtcgtcggctctccaccgtcgtcgtcgccatgagcgaggctacgcggagcggccgtccggtggcggagcggaggcagcggagcgcggcggcgggcggagcagccgcgcgccgtggccgccctcgtcgtcggctctccaccgtcgtcgtcgccgtgggcgaggcctagagttacatgcacatatgcattcattcatgaatgtagtacatatatattcgatcgatcgatcttgtcactttcaaccagtgcagcctgcaaatcaatcacaagctgcttttgctttggtctttttctctctattgcatgcatgtatccctcacttgagaacccatagctagcatgcatgcgttcacgggcttttggcctttcttctctcgcgcgtggagggacgccattgccgccgacaagctcgcgagtgaagctcggccggctctctctcctctccggcaagaagggcgccaaggccgccctgtccgacgacgacgattacgagccccccgcgccgccgctcccacccggggacggcgacaatgacgaggagcccatcaacctcgtcttcaagggcggagatgaggccggcgggagagggggtggcgcgccgcatcggcgaagaggtcgttgccgacctcctaccgccgctccgcagccacacttgccccccgccgctcgccgaccaggccccccgctctgtcgtaatcgcccgccgtcctctgcccaccgctgctccgcctaccacgctcgtggaggtcaaccaacacgacgacgacaccggcggtgaagagctagagcatgacgagcgccgccgctccgctgccactctcgcccgctgccctgcccgccgctcccgccgtcccagctgcctctctccccctctcccgccaccgctggcgcgctcgctccacgccgcccaccgccgtgcccgcctcctctcccctctctcgcttcttccccgcgcgccgctgtgcccgcaccgctgcctgtcgccacgccctcatctgcccggccgcctcactgaagaagacgagaaaagaaaatgtgcagctgatatgtgggctccatgtactttttaattttttttactgactaggatgccacgtcagtaaaactgggcaaaaatactgccgagggacctccggtgaacggtttgagggagtttaggggtacacatttctgattttgtggttaaaggaccacagaaaatctcgctgttaagttgagagacccctggtgaacttattcctagtttgggatagagcgttgactgacgttggttgcgattgggcctctttctcatctttcgacaagtttaattgggcccccatcacaacgtacggcatattttatccccaacgtctccactctcacacctccctctctcctgagtcccctctttcaagatatttaactatttatcaattttacatatagcaatttcactaaacttacatatcatagatacatacatgatggtccacatatcgtaggttgtgagtaacaaatcattaattacaacatcttaaaagtaacgaatagttaaatgcccctacgagtcccacataagcaacctcaccgacgacgtcatgcacccaagccggtcggcatcggcagcctcgcctccactcagagtaggtgtacaatagcagactataagctaactataaatatatttcgaggagataccaaaacatggcagggaaagatttgtagtggcagatctatctcttcttcaaaaaagattatcaatcttggagtatatgtatagttagcttttgtatgagagctaacactcatttttttctttatctttctcttccacataagattatagttggcttataacccactgccatccttgctacatactctctccgtgctcgtaaaggaagtcgttttggacagcgacacggtctccaaaacacaactttgacttcttgtttctataaaaatatttattaaaaagtgatatatgtatacttttatgaaagtatttttcaagacaaatctattcatataacttttacattttcaaactcaacaactaactttagagttattcatgatttatattcccaaagtttgatttaaacattattctaaacgacttctttacgagtacagaggaagtatatcaacatccaacatcacaggaagccttctggtaagactcgcattaatgcattatacttgttggctgctgctttgtgtgtggtgtgttgttttgaggtgcaatcattcgaacaatcaaacatgaaggctctagcaaatgaaacctgaagatgtagatattctgggtaaagggtttgtctttcccttttttagtagtctgacagatcaattacaacctccgcattcatcttaggtattaggacctatttcgggaaacttttagtagctgtatctttcaacagaatctctaactctcccaaacagcttagattattacctagattctacaaatatgtatatgtagaatccataaaataaattagaagctagaagctgaaaaacccaacttcttcaaattcttagaaactggatactaactagcaaattatgagaatcttaagctcctcatttcatctatgattggcttgctttaaccatgcgaaaagaggtaacaattacgtagtactccctccgtcccatattatatgggattaggggttaaaaacgtgtctcaaaatataagggatcgggtaggtagagtactaatgcaaacaaacatcgggcagggagagtactaatgcggacagagagctgtcggtggaatttgtccctaccttatcctctcaccgagtcgcccatcgaccaccgctcgttcccctcccgattttcttcgctttttctctgtcccctccatcagcgcctccctcccacccgcatcttcttccacctcctcccatccatccgagctccttcccttccacctcccatccgtcgacgccaacgccggtggtgcggcggccaacctggcccatgcgccgccgccaccggtgcccaacctggcccgtgcggtgggggcaccgccggggaagcgaatcgaggtggtgtgggagcgggagaacacgctgctctcgttcggccaggccgccgcgcacgccgccgtcgccttcgtcgagttcaacgtccaggtatatatatacagcgcaaccgagtttgatgtgcgtgcttccatttccacgttgttggtagtacctgtgtttgttttggatcttacattggatgtcagtttacgctttgaattgtttgattttgacaccgctgcatcgcaatgcaagatttggaagctagcgtgggtatgacttggatgtagccattgattggtgtggtactggacatgaaatttgcagcaacgttctagccagtgaactatatgggacaagactcacaagtaggagtatcaatttaatcgcatttaaccaggatctagatgccaccatgctaaattggtcaagaatgaagaatggagcgattttaggtggatgttttgcagggatgtagttatccattaggcaaagtgctaggatttgaagttgcaattcttgtttagagctgaagaggttcttaaaacattgccaactactcttagatcatacggagtactaggaaattaacggtgtttaaaaaaactgaagtgtcaattttattaatcttaaacgctgttaggcacatcctatcttagattcatggtagatttaaaggttctatgtttcattttgatagtttaaaatttaaaattttataggaatataatgatttaacatgtcgccggcagcagtttacgggctggcggcagaatgcggcctagcggcagggttcgcgggacgtggtggttgctaggcaaagagccgcgtccagtggcggaaggcgtttgttttgacgacttggtgtttgtccctgactcggatgatgaaggggctggcaatgagttcaactcacaaggttttgacgacgaatttgtgcctgaaacacaacaagatgttccaatcgaggagattggcatagggttcctctcttatttatttaattattagtcctttccattcaattttgttaaattatgtgctttttgatgttccatttatttctccttacggtgcagccatcctgtgacaagcaaatcaggagggccgcgccagctcggagtgcatcctcgcttggggtatgtgattcacactagattgttgatttgggatggttatgcatttgtagcatgcaaattgagtcacatcttgatttatattgatttgtcttatcttctttacagtacaatgttgcacgattggcttcgggctatttcagagtatgagaagccaagcatcgacatggcaaccatcgagaaggcatgggccgatgagaaaaaggcaatcgctgatgcggactatgagggaaatccaagcaaggtgaacacaagctccgagaagaaggcatgtgtcgacgaggggaagtcaatctccgatgcagaaactgatgatgagggcgtcggtgtgcctgagaagaaggcatgcatcgccgagggaaagtcaatctccgacgcagagactgatgatgagggcgtcggtgtgcctcggaatttacagatgaaagatttgcacgatatcatgtttcctacctgctgaatgtgattgtgttgtggtattttattgtggaaatgcacaatggacataggagtacttagtgcaatatggatgtaagactaccatgtttataagtgtacaaattaccgtagtgttccatatggttgccagactagtacgaagtattttgttatggaaatgccctagttatagtcatatactcctataatatattgttctaatgattgtagtattgttccaaagttagtgctgaaattaactatgcaatgacatgttctgaaatgggttcaattaagtattcattgttatgaaattagtgctgaattaaatatagaatcacatattgctgattgctaaaactagttatgctgaattacctatatataacaaaagtctgaaatcatatttacaaactccatcggagtacgaaaaacaaaagtatggctaggctggactagttgttcaacatggtctgcatcaccacatacttacaaactccatcggagtacaaaagataaaagtatggctaggctaggctagtttaacaaggtgtgcattaccacatacttacaaactccatcggagtaaaaaaacaaaagtatggccaggctggactagttcaacaaggtctgcataaccttgttgtaaagtgcaatatcacaagtcagactagtagggagcatgttaagcctctccaatcgatccttgttcatatggggtatcttgtagccattgcctccatcggctttcatcacttctatgaagcaagcttgtagggttaggaaaccctactcaccaagttagaattatactcattgtactcttcgtccacattgctgattaattcatccatgttactacaatttttgaggtatgtcttcgattgaagagaagcaaagaaacccagatcaagcacattcatgtttggtgaattagggcgttggttcatgatgcgtatgtctaggcctacttgggccaccgcgagggcaaatgcttcgtcgtttggcagaatatgtgtccgtgcattgtcttgctgaatccaaatggtcttccctacatcttctctcggccaacaagaggcaatagttggaataacctttgtaatcaagaaagccctacttgtttctctcgacaccgtaatagattttgtgaccaatgtacccttcggcctgttgcgactactcctttgtgctggttcctaacatatagagcaaagaacaagttagctacaaagtgacttgaaagcaataaaaatagattgaatcaagttgagacttcaccttcctaacaaagggccatattcctattttgacatcgaagtagcaatttccttcctcatcatacctaggctttgcaagagctgataaaaacataactttatctatggcatttttattttgcacacatctcacaggttcatcttcattgaatacaaggtagaaggtcttgtttttcatagtggcgttgaaccatttttcatcaatatgcacaatgttttgcatgtctataaatcttggttcagcattcaaagtagcaacatctagcatggatacacagaacttgagcctttgttttttattagcttccttcaagtaaggtttaatgctattttagtgacggcgaagggctccttctttgactaacctatgcaccttgcttttgctagcattcaatgcgctagcaagagatctgatgctacaccttaagttcaaaggaagtgctaaaacctgatccaaatcaatgtcacttctttttcggccacaattaccaggcttctttgatttaaagtcaacttcaacacctgctgctaaacatttcttcgcctttgtccaaatgtcttgtacaactctccttgtcacatcaaccatagttgcaataattgttgtagtatctctatcaacaagtttcccattgatagtacttgcaagtaaagcaccataaatagctttgttctcagcttctggtaaatatttccttctctttatattgtcttgttgagtatctgcacaaagaaaatatttatatatatacatatcagttggcaatatattttatacttgcagtacactaatgaatgtcatttgcatgtcataccttcctcatcacttgatgtatggagatcttcatcaaagacaacatccatataaggagaataaacatcaaaatcctcctcgtctgcatggacagaaaaggtgagacatgagctactcatatgatatccccatctgcatcactgctgattacatatgagcaaaaaataatgtatgtacctgcataatttgattgatcttggagaacatagagtctgtcatcgtcaaatacaatatcatcttctccataatttgctgcatgacatgtgacgaagataaatttaaagttgaaggttgtacaaagaaactagctaatgaagtagtgcattcgcgcggctttaaccaccctgtcatgtgctttgtatgatgaaatatatagaaaagtgcattataaattaagtaaccattcttgaccacaaaagtttttttttgcattaggtcatctaccacaaaaaaaacacatgttcccatacctatatgggtcatccttcagtggtgttatatataaagttcataatattaattttttggattgttttagtagtttctgatattaaaaccagctttatgaaataaaacttgaactatgctgattccaactatttagaacacatgatgtacgcttataaactttggagattgttgggctaatggctggttatcataatgagcaaataaaatttatagagccatttatgatcatcatttttgcacagtaccacataagagtatatatatgactgatggctgaagtttacaactcttgactaaaagcaacaactgattgacactaatagcaaagttgcaaagctctgtgttatgcaaagaagtaatattgggcttgttagtttatgaatttgttcataaattttgatcatacaaactttgctactttcaacatttatgtttctgttatttcagcagaagggaggatgggaaatgtgagtaagaccataacttgctttgcattaagattttgattccatacctggctccatgtttagatgacaaatttcttgtgcactccggccattggagagttcaactgcttgcatggcagggtctggatgttcatcttcatgagcaccaaaacattggttgtcaggaagctcttcatcttcatattggaaggcatcttctccttgcacagcaggatccaggttaaggtcagggatcccatcaccttcatcttgtagcacttcttgcacaccaagatcaaggttgagatcaggaatctcatattcctcttcttccatggattagttgagggtctctcttggtgtaatgctggagtaggttgctaatatgagtgtaatatgagagctttggtttttagacctgtgagtgagagcaagggagtgaaaatggcgggttggttctgagcatcaagtttaaattttgaacagctaatgcctgtgtatttgtggcgctaatgtgtagtgcgtgtgaattttgggcagcaaagaggtgagtgggatttaattgactcttgtcaacatatgcattaatgtcattgtatactgaggaatgcttactctttctttgtgccaatcatttgctggcaagcttgtaaacccaaatagtctctcactgctagtgccagtactaagtaaatgaggggtacatgcatctttcgccaacctccttattttggatgaacagtgtccagtcccatataatgtgtgtcggtgatatgggcccgggggtatcagatttagagcgaggaggctgccccacgatgccacgtggtcctccccggaggggagtcaggcccgaggtagggtggcggccactccttcccagagactggatggaggaggctgccccccgatgccacgtggccctcccccgaggggagtcaggcccaaggtggggcggcggccactccctggccgagactagagggagaaggctaccccaggcgccacatggccctcccccgagggggtatcgggcccgaggtcgggctgcagcggccccctcctgtgactaggggtcgggctcccccgaccccctctctaggtcaccatgtacggtgggttaaatgtccgcctccaggtgcccacctacccgcatttatggcggctcgagtagtcgcgcaacgccgcatttaatgcggtgtgcaatgcactccaccggtctgtgaccggtcgaatgaccgatgggactagggtagtgcgcctgtgcgctgctcgtgtgtcaggcgacgtgcagcctgacatgtcccatcaaataatgatggtgagaggttctcatcctcttatcctagccagagtcggtcctcccgctctggtcaaagtaaggctcccgtttcccggtgtaataagagcccagaagtcctcacccattaaatggtgactaacaggggcaccccccgtgtcaggcagcaagatttgacaggcctcatcagcaagatgacgtgcgcttgcttcccaagtcaagagacaagacatgcatttaatgcaaagattgtaatccttctccactaagttatgtttttgggcccatgtggtaaccccttggagatataaaaggaggtccaggcctagtaggagggggggctggagcccctgatgatcaacaccttctaccccacaaggagatcttgtaatttctcataagatcagctaagcacaggagcagggtattacgcttcttagcggcccgaacttgtataaacctcttttgtctcatcgtctttggggggggctaaccccctcaagatcacacagctccgctcaccaagccctcgaatctcacccgctgcccccagccgaactcacaaatgggggcctcatggttccctggtggaggagttcattctccgacaatgtgggacggagggagtaccagatacgcacaagcacatagacttgcttgcggtttcctagagtagggtaaagtggcataagatttaacataggattatgcttaatgggggagtagaaactaaacgacgtttgagtcttcaatctcctctaaccccccaaacccccgaggacagtctcaactctctatctcaagttctcaactactacctccatattttaatgcatggcgccgttgacttttttttcaacgtttgaccattgtcttattcaaaaaatttatgtaattattatttattttactgtgacttgattcgtcatcaaatattctttaatcatgacataaatattttcatatttgcacaaaaattttgaataaaataaatggtcaaatatttatcgaaaagtcaacggcgtcatacattaaaatacggagggagtagtttatagcattaaatatattgtcattgaagaaaaaaactaatatagcaaaagagttattaataagaaaagaggaaaaaaataaagtaaccatttaagaggaaaaaaaaccttttcgtctctcactgggccgtcaataaggcgtttgtacttgatgggtaaatggaccttttggtcagaattactctaatcgaagaataaaaatcataaagatctaaaaaaaaacataatgtgcaagatctattccatattcaatatgaatgaatataaacataatgtgtaagatctactccatattcaatatgaatgaatatactaaaccagacttttgcatcataaagaaattagctttacacggtacagacgtgtagtcacctttctccatatatacgctgcccaggagatgcttgggcacaaaaggggcggggaaaaaaacagaaagcgaatcgagcattactgaaacataagcaagataagaaagggagagaatgtgtaaaggaaaacaaagaaggagaatagccgatgggtcaaggaaaggcacacatgcttgaatgttagctggatagatacctcgctttgcttccgttgcattttttcttctcttgtttttcatgatgatcaagactcgagggagagcaacgtccattatccatcattttgtctttcgtctcgtggactagtctgttgccttcttttctttttgcttaattattgtattgtcttataccgctttcaattactgtacatggctgtacttttgtgccccattaactctcccaatttttttcctctttattagcttgtactatactaccccaagtccccaacctaaaataaataagtgcatcttgtccaatatttgatcgttcgttttatttaaaaaaattataaaaaaataaaaaatatcacacataaagaactatttatgttttatcatctaataacaataaaaaatactaatcataatttttttaaataagacgaatcgttaaacgttggatatagacagtatataattatacttattttgagacatttagagtagttgcttgctgtttctttttcttctctttctttcttataccttccggttccacaggcagactcatcgtatggagcggatgtcgtatcataattatatcatatattagaactaaacacaatggacacatgttatgcttatagaccacgtattatgtgcattcttatccgtcctccacatgcactcacacctcacctgtcggtggggccaactaataattaatactccaacagctaaccaagcaatactctatggcaaaatatctttattgtactctagtagattagatcactaataaaaagtagaaactctgctgcatattactccctccgtcccataatgttgcaacctaggatgggatgagacccacctagaactacgaatttgaacatgaggacccatcttaggactacgaatctgaacatacatgtccagattcgtagtcctaggatgggtctcatcctgacccatccgagattacaacattatgggacggagggagtagtcttctatcttaagctgactcgataaaagtactactccctcggtccctcctcctaggtttagctcttaaaatttagcctaaaatataacatcttattcatcaatattttttttccaactaatcctaaatcttcaccatttaatttttctatttatctttacttcttatctaattagattttctttaatttacttgtacctattttcttattaataatcatgtccaactctaaaatttttatattctggaacggcctgcatagtggtgtgagaactttgacctttgatccataataattatttagtgaattgagctagtggtgttgaaaattccatccattaaataattactcttgcatactcaaataatgaattaataaaatgtagtgaccgtgccgacggaggaagacgaagacaggagacggttactggagttgagtactccacccaccacaccacacaagagagagaagggttggggttggggtcactctttccttttctctgttgttgttggcttgatgatgagctgattcgcataattccaattccaattccaattataattccaagaggcttatcatcaactcaactgaagaagaagaagaagaagaagaagaagaagaggaggagggttgtgaactgatttgggaagggagggggaggaggaaggcgatcgatcggcgatgggcacgtacaagtgctgcctatcttcaagcgccgcttccgctggaacgacgcgccgccgcccgacgatgtccgcgccctcttcgccaaccactccgccggcggtggcccccacatggccgccgacggcctccgcgcctacctccaggccaccggccaggacggcgacgtggacatggagcggctggtggagcagatccggcagctgcaggggcgcggcgggcgcatcccgcgggtggggcgggcactcccactcctgacggtggacgacttccaccgattcctcttctcccacgagctgaacccacccatccggcacgggcaggggcaggtgcaccacgacatggccgccccgctctcccactacttcatctacaccggccacaactcctacctcaccggcaaccagctcagcagcgactgcagcgacctccccatcatcagggctctccagaggggcgtccgcgtcatcgagctcgacatgtggcccaactcctccaaggatgacatcagcatcctccatggcaggacgctcaccaccccggtctccctcctcaaatgcctcctctccatcaagcaacacgcctttgaggcctccccttacccggttatcatcacgctcgaagaccacctcacccccgatctccaggacaaagcagccaaggtatatataatcttcttcttctctctgtctctgccttgctcgctcacttgccaatgggccagatggttcttgaagttttcggcgacatcctctactaccctgacaaagatcacctcaaagagttcccttcgcctcaagacctcaagggccgtgtcctcctctccaccaagccccccagggagtaccttcaagccaaggatggtaatgctgccaccatcaaagaggacgccaaggccgccgccactgacgatgccgcatggggaaaagaagtcccagatattcactctcaaatccactctgccactaaagtactcctcatattactagcttcttcttcttcttcttatgctcatagtagagccagtttcttacctgcagggcacacttttgtttcattctgcagcatgaccaaagagaagatgacgacgacaccgatgaagacgaagatgacgaggaggaggagcagaaaatgcaacagcatctagctccacagtacaaacaccttattaccatcaaagcaggaaagccaaaaggtactctacttgatgccttacagagtgacccagaaaaggttagaaggctcagtttgagcgagcaacaacttgccaaattggcagatcatcatggtaccgaaattgtaaggtacgaatctgctaagtgaatgaagttgctcttcctttccatcttcagcatcagtgaaaatgtttttttttttttgcactttataggccatctctcgctaactctgctgaaatgcccaatctttttggccaaaacaggttcacacagagaaacctactgaggatatacccaaagggcactcgggtcacatcatccaactataatccatttcttggttgggtgcatggtgctcagatggtagcgttcaatatgcaggtgaggtgcacttctgttcctgagcagttagttccagagtgatggtttagctctttgtaccttatttccaattcagtaaattcggtgaggaatcaatttgctgaatgcagttaagtttacattttatcttataattatacctgaacgattattatggtataatataacttcagaattggtggatcaaatttgagcaacctggaatttctggctccatgttttctgaatgcctgtcaagttgtgacatttgccgcttcttttaccgttgtcatattaaaaatacatgaaatttcttgcagggatatggaagagctctttggttgatgcatggattttataaagctaatggtggctgtggttatgtgaagaaaccagatttcttaatgcaaactgatccagaggtttttgacccaaaaaaatccctatctcccaagaaaaccttgaaggtatgcatgcctgtcattctttttgtttgtgctcgtctgtgaaacctggagacttcactgaagtgctgcctttcaggtgaaagtatacatgggggatggttggcggatggacttcacgcagacccactttgatcaatattctcctccagacttttatgcacgggtacgtacgtggattgaatttcataccgaaaacggttcgctactccaagttgatgtgatattatggaggtgacgatggaaaatggacttgtgatgggatgatggataggtggggatagcgggagtaccagcggactcggtgatgaagagaacgagggcgatagaggataactgggtgccggtgtgggaggaggatttcaccttcaaactgaccgtgccggagatcgcgttgctgcgggtggaggtgcacgagtacgacatgtcggagaaggacgacttcggcggccagacggtgctgccggtgtcggatctcatcccggggatccgagcggtggcactccacgaccgcaaagggatcaagttgaacaacgtcaagcttctcatgcgcttcgagtttgaatgacccaacacaccgacactttctttctttctcgccgcatcgcattgcactgtgcctgtgcttgtgcagcatccatcatttggtttggtttttcatgttcctgtgcatacgcatttgtgtctgtacataggctcggtcctgtatattgtttgtgagtaacatgtaataataaggcttcacgccatgttcattcctcctgtttgaacccctccaaatatattaataccgaaggtacaaaatatctcaacggcagacggttctgtttgcagggcaggagtaatttggcaagtgcgctatgtaataactaaactcgaccacaaaaagaccatatacagttgaaccccccccccctccccgccaaaaaaaaaaacgtatgtaacaaatatcagacattcttcaggcacaaaagttcaatgaaaaattttagaaaatatagaccgccaaagatgaaaagacggctaagaatcttcccatttccctagtcaaggtaaaactgtatactacatatccaactgcccagctacaatgaattatccaagtcctaagtcctaacaagggtctattccagacccatcttgaacttcaatgcccacctccttccggcatataactaatacagaaagggaagtaaccaatagttgattgggacgtcacattctgcagagacaaaatccgcagacaattgcgtgtttgttcagttaaaaacagagcattataatggcatttattatgataaaacaaagagccaaaaattttgagatatttaccacggctgccgaagaagattagctaacagcggaagattcctgggtcacttctgtcgtagtatctgcagctgaactgctggtttctgcagcctgattttggctactttgtgcttgaggtgcaggttgctgttgatcttcagcaagacccaaaactaccaaggtagacctgccataaaatggaagctctgaatcagatcctgccctcgtgtacttgaaatggataagtagcttttatgctggtaagatatagggttaagtacaaaccttggaagagttgatcgtacgttaggttggttcgcgtgctcaaccaaaggtgccttcagtacaggattcttattcaaggcattttcaagttgaggagctggtaactgataaaccaagtttgatgttatgaaaattattggcagtttggcactatgataaaaatgaactcaagagccactagcagatagcatgtaaaacagctagcggatggtgcacatgctacagagatttttgcatacaagaacaagtagattctacgtagaagcaaaagtgagccaacctgcagcagcacaccatatgactgaggtttcgtcaagatagcacacttcaggaatcctacccataacttgggatacttccatatctgcaataataaaagatgacatgatatttccatatccaaaattatgtaaaaccactgaaactaaacttaaaaaaaaaatgaaaacctgcttgctaacaagacgtgacatgatatccatcacaaagtccacctgaaaagaaggcttaccgtcagattataagaacaagaaacaggtctataagattgagaaataataccgaaaactcccaagagatttttcataataaagaattgcaatgctcgtcaacttcaatatgttatcatgccaacactgtgtaataaaggaagttccacatgaatatctttgatagtttgatggtcccaatcctccatcaccttcgagagagtggaaaggacatatattaccatgtaactgctttctcatagaatcaagtggataagtgcacgcaccagatatgaagcaagcagttgtaaacagtaaacacaagtgatcaactctttgcttcttaagtggcagtaaaatacaactaaagaaaaatcatgaatggacactttctaattgaatcaggcgcaagcaccaaaaccaggaaagggaatgtggcctactcaacatgaaccacaggtagatcatgtaacagcatgaccgtggcatttcaacttgatttgttgtactatcagcagatgttaactatatattataacaccaataaactatcagccacagttagaatattgggttcatgcagttaactcaccaatgcaggaaatgcaccgattgcttgcataacagttcgcataaacagcaacggaagtggaatttgttcaacctgaggaaaagtagagcttgagcaatgacccaacaactacatcatatcacaaggcaggtacatctgaaaaggcgaaaaatatgatcatatataccagttggttcagtgctttcgccaaaacttgttgagtgaatattgtcctttgctcaaaacaagcagcacaggcatcaataacctatcataagataaaatgaattaccaaatttatcagtatattaaactaaatcgccaaatgatctatttaaaaatattggaaacagacctttttgagtggtattccttctttctcaggatctattacatgaatcgcaatcaaaatttctgatggatcaagagaaggcccattctgcggtgatccctgcaatagtcagcaagttataatgtatcataagcccgcacaagctgggaaacccttaaaactaaactgaatcaatttaccaaaaccaaacaagtacactgaacttgcactttgcaacaggcataaaaataaaattttcaacaagtaaaactgtaatatttacattttacaggcagtaaaaaaaataaacaattaccattgtcctactttgagaaaaataattaaatgaaaaggaaatcatatcatgaaaagaaaaaacatgaaggaaaaatcaaacatgatagatgagctgtggaatcatatcttattgtcttattgaatgctgcaaatttgcagctaataagatcaatcagtgtttgcatgtaatatggatcagttacggtctgatggattcttgcggtgtgtgagtgcctttgagtaaactttccagtatttttctagataaaaataaaagctcccaaatctttataactgcaacaagaaaactgtgccctactaacagaagaccaaagttaatccactttgttaccagttaaagtcatgcattatcttctccccccagtcaactttacatactttgacgacatagttggcctaagaaggatagctaagctactggatggtcattgaatacaggtgaatttttggggtggtgtggcactgcataagcttctttctgtattcaactgcagaagtctaatatataatactcacgtgaaacatataaccccaaaaggagagggtagaaacaaggttttactaaaaaaacattaaagttgttatttttttacgtcaaaggtgcaacgaaaggatcagcttggacatgaacttaagttaatactcaaatacaaatcacagttaaggatcagatagaaaattaacacagcatgcacatatttcatgccagacaaaaactaacctgcaggattcgagaaagtgcaacttgaaacttatccaagggaagattaacaatactgggaaaaacagggaggacctgagaaaaagcacaatgaacaataaatgtgaaactataataataatacaggtgacatattgatgcctagagaccataaaagttccactaatgcaacatgccatgcattgtcaaagattcttaacacggaaaagttggatacccagattagtcaattattaaatgttaatcagcatatgtacaccttctaattgaaacactccattgcaaaaattattaccacaggttttgcaaatacaattcaaatagtataaattgtgagcaattcagcagcatatgctgattaacatttaataaatgacagtacacaacagtcattaggtgactgcaggaaatgaagacttaaagtaaatataaactactgcataaattctatagttcaataaaactagaaataaggtatgcatgctgctggttcattgtaatatcttcaatgttgcaagggggagaaaaaaacctcatcttttggcagatgagccaagactgcaaaaaggacctcgatatcctgcaaaatgaagccagaatgttaatagtatctcaggtgggaatcagtccagaaacaaaagttgaactctgataaagataagtaaagaacctttgttttagaatataagttctttacagaggaaatcagatcttgagatggcattgctccatcggtgagtgtctgtaaaacctgtgtggcgatgcaatttcatgggttatgatgtattcagataaaacaaaccttttaagaaaatttgatgaaacatctttttctgtacacatttaagcagaattttggatttttatcataaaagaacaacttgcacctgcatcagtaggtcccgactatcagctggtgggtctgagatgatcccaagaagactgggagatgagcctattgtgcggatcagaatgggtacttgtcgatgaactgcctgaaaggtatacaatatatcaaatggatatagtttattactgattgagccattggcatggcagagagaagcagtcagcacagacctgcttggcagcttgtggtagacttccatatattgcaaatacatgccgaagaagggaatgcttctggcaagtaagatgtaaattgcatgctgttagtaaaatccatagaatcagatcaagatgttaaactttagtaaatactaaccttggtgcacaaagcaaaatagagtgacatcaaagtttgagaatctgctactgaagacgataaattttctgaaccaccatccttcataagacacagttcatcccaataagaaaaggcagcactataattcacttgaaaaggaacagaaatgtactcaaggttatcttccaagacaatatcaattaagtcatctacaattctgcatatcttactcatcactttttctttttacatcacttcgtaggttcatctatatgactttattcgtctgtttttcatctgtttcttggttttagtgtattacttggttgattttatgacaaagttcaaccgcaattctatttaagaatcaactaaactgtaataagtccagaacagtacatgtgaaagaaattagagcataaatcaaaccttgggtgcttctggagtagacatttcagaagctgctgattcatcagctggaactacttccagaactgaattaagtttttcatttgcaaaatcttcaatcctttttgaaatgcttgccataggaaatagcttatttgctacctgttattaccaaatgagaaacaaaatggttaaaatcacataaatgcatgtttcatgcaagcacaaacaattaggtcaattaccaagcgtattgccttcatgcggacctcatctagatgatggattgaactctgcaagaaaaacttctacttagaatcataaaaaaggaacaagctatacttgaaccagaaaagtagcactagagtaccagtcaacaaaaccaacatcaagtcctaaccagtatataagtttcattcattggtaattgcacgtttggagttcaatctgacgcttatgtccataaaagggaaatagagatgcaaaacattactcatattttgagtgttcaactgtcctgaactcttccaagacacatgaaacaactaaaactgacatcatgtcaaatgactcttgcatgctctaccactgaatcaaaaatcaaaatagaaaactntctcatgctaccacaggtggagttcctgacaatctcatgacagtttgtgactcacaaaaatcatgtgagaagagctgcacatctaagcaagcgtatcgcacatttacacaaggtgagtaaatatgtcatgaagtcagtctagcacctgcaaagcgatctccagacatctgtctcgatttgaaggtcttaacatgataaggttccagacagcactaagtccttgagttaccctatcaccactctgcagatccttgtcctgcttctcattgcttccaggagaacataagccctctagcaacttcaatacaccctctggtaagtatggtatctcacaaagtaattttccaagtgatttatctgaagccggaaacatatcgcgaagattttcagcctacgccaaataagaagtggttggacatgatgcaagaaaaacaatacagtgacaaagttagagatatcataagaagacatacaacagtcagaagaaacgattcataaactgatgttgcagttctcgatgaaaggaagtcttgatcctgttctgcttcacgatacaacctgttcagaatgcacagtgtcagctcgtgtccctgctcaaggaaagatagtcagaccattgtaaggggtaaactgattaaagcatgtaattagataaagcaacagagttacatgaaacataatctgggtaaacattttgatataataaatagataatgatcatcgtcataggcttgctatataaataagaatggagggagtagtttggtaaactagaatgaagataaaaaatgttgtgtctagttaactggtcaagatattggcttgctagttgaaccacataccacagatacagcgccagccctacaactagaagttaaaaaaagtgaagctgaacaaacatattttatttccataaatactttggcaatggaggttggggatatgttcttgtaattgtcatggtagttgtcaagtatgatctttcgctgccagtctaccagataggtagcattctgtgcaaaatccgtaacgtttagcaaggtaatttggtttgaatcaaagccatgtggttgaactggatttttctcccagttcagtcacctaggcaggactaaaaagctttcagttctctcttttttttggtatggactaaatcagttcccatccaacacttgtgtttataatagagaattgataccagttgcacccagtggacccaaaaaaaaaactgtacagaaaagaaattctatgattttgtacacctgtacctcattatttacataatcagacagtacatgcttctggagaagctcccaagggtccaactccaaagggaactgcactatcaagtagcataatgtaaaaggagtgtaactatgacaaaatacaagaaactgaagcatcattggtttaaacattgcaggcactatcaattaattgcttctgcaaagaaactgtcaatggataaattaaccaaacaatggtgcacacaaaaaacactaaccgaattgaagcaaaagaatattactctaaaggaggcaatgtaacatgtacctcaacacccaagtgagcaagcaagggaagacgagctattgaaccaccagatgcatcttgtttatcacaatcaagaatccgcaaaaatgcttctttttgaagtagatctttagcctcatcgctgagatcaatattagtcacaaccaactttggaagcacatgctgtgaagtaagtgtgcttgaatatgagaactgagtctgacttgcttccaccatagaagagcttggactacgagtttctgaagattgagccaaactaagaccagctgaggaattatcagcaggcaatgaactaataaaactgccaccatgctcttgggttccttgaagttctgttgaagcatgggaagcttctgatgattcttgaatctcaattgataacctagcggcatctgcagtgggttctttagcctctatagtttccatatcagatggaattgatgaactattactattctcctccataggtacatttcttgaggtaggtccaggaatggcaggaattgctgcagtttcaccagcagcagatggcacaacagcagaatctatagtttgaggtgcttcatcgacctctcgatcattttgatttattctctgaagacaaagttcaataaacaaaagtcaaagaagaaactctaatgaatcaataaaatctagataaaaaaccaaccttcaataaagattctaacagaggaaagcatgctgaaagaagacttgaactcggagcaccagatggctggccagctgaaggagattgttgttggtctacttcaggatgagaaactggcaggtgttgcatgttaaccattaccacctctgctaataagtcagcagcaatactggatgacaggatttgcagtgatccagccgctctgtcaccttgagcggctaatgcagcaaacatactaactaattgatatacagcttcagaatttccagtacttgcagagttggacgggctagatggggtatcagcagaggttagctccacattattctttacattttcagtatgttcttgatcatgatgtgattgcctaattcttttgttggaacgatcaccatcttctggcgcattatcgatgtcatcgatcagattacgcttgttactgttatctgtgcttg

SEQ ID NO: 78275 - DNA, 763 bp, Oryza sativa
cataggataataagctagttttaggccttgaacagtagtccttcaatatgtactgtcatttctgatgtatttcagggatttattcttaatatttatatattaacaaagaagaaaaatagttagtaaaccaaactgtttcctgccacaaagaatcaatacggccctaggaaccattgtgatcatgcaggatttcaaaaggaaaacattaactataggcacatctgaacctaggtaaaaagctcttgaggtatccataaaaggccccagtgaacatatattacattaaggcaggaaaatcctttagctatatgctgctgtaaaatggaataacttagatacgaacaacataggtgtagggatgtacaaggcgccaccacagaacgacacatcctattctctcccgtccatcgaagcagctctatcaaaaggccgatctcatagcaccacgagctgcctcacgtttcatctcagcagccttcccacttccacggaaatacatgtatacttgctgcatttcaaacggccaagttcagaatgacatctcccaggagaaaatgaagacagcattgcagcggaaattttattgcaacaagaacaaaatcttaggggacagcacattctagttgggagtggagacatcaatgcaaatagaaatgtatatattctgaaggcacagcatgacgcatgatgatgaacggcagaatgaaggagtgttgctgaacagacaccaaggtgttactatttggctttggctaagatcaag

SEQ ID NO: 78276 - DNA, 1413 bp, Oryza sativa
gcaatgcgtgcgtgcagggtactacaatgggccgccggtgatggcgccgccgcagtacgcggctccgccgccgaggcggccggagccgagcttcctcgaaggatggtaagaacgacaaagccatatgcgagcatacgatcgtcagaatactgtctctgtcctttgcattctctctgctaatcatggtgctaatttgtctgaataatacagccttgctgctctctgctgctgctgcctcatcgacgagtgctgctgcgacccatcggtcatatttgtgacctaattacggtcacagtggcgtctcgactggttgacgaggacgaacagtctgagttgagatatacactgtacacgtgcttgccttttgttaaatgttgataattgtatcggtctatagctagattacagtacaagtcctccgttaagttcaggttcttcaagtatcagatgcatgcgtgatccacctgcagtggaaatatttatattgcatgcactggttgctcgattaaccaaaggacgtatacgtttctatgtgtatgtctgcatgatcgactataaagaataaacgaaggtaaagtgaagttatactgtgcatggtcctcaaatctgcaatatatattttgcgcccccctgaatttcttctgcaatggcattgcacattcctaatcgaacggttggcagagattccgatggggttcggagttttcaactccgaatcccatcaatgggccttcacgagcccgttcagcgccataggccgagagcccgaggcggagcctcccatcaggcccaaggatcacggagcgtcgcgaataattccactcatctaggccgcacgggcttgatcgaacggtcgtcgggtattccagggagctcggagttggaaacaacgaacccccgtggccctgtattcgggtggcaagaatgaggcgccaggcctcgccggagcgccgccgcgtaatacccgtccccagaggcaaagaggacgcacccgagtgcccaagttccagacttccagtacgccgatggcgtctgggtcaatgtgccatttgtccccgtggcagctagcctcagagaaaagaacgagctaaaaccatagaaggtctcactcttcttcatctgcattgatgaacttactggagcagaatttcatgcatggccataatgttgcaaagggcaagttcgatgcagcataaaaggttccagctgttgttgttgcaacactgccgcgcagagtacatagtcctaatcaccgcaacacgacacgttaaccgctagctgaaatcccagagggggtcggagtactccgaccccatgcaccagtgcatcctcctcctgggctcactgcggctgtgcggcacctgctgctcatctgagccgcacatatctaatcagacggcgggaaaagattcc

SEQ ID NO: 78277 - DNA, 9218 bp, Oryza sativa
  unsure (1)..(9218): unsure at all n locations
tgagtccntttaanccttgggtaagtacgaaggaataaaaaagtacggtacgtacataagcacgcccagccccacgtctttattttcattttttcttctttctcacttattagattagatgaaaaacaaaactaataatttaagctcatatgtaaaaatatatgttattttgagttgtattataaccatatttatgctantcggatcatacccataaaagataccaaaccaanantnncngnnaanaaanaaannaaantttttaaaatttttnaaaaggggngnnaaaaaatttttttttttttttaaaaaaaataattgtatatcactttaagaaattagacttgcattttcaaaattaaaaataacatagtaacattcccaaatgtcactcaccctatttaaaaaaaatactgatacaattaaacaacattactaaatactgattctgctgcccccagactctctctacccgtctctgtgactactactctctggactactttttttaactcatccttccattcttccttgttcaatcgggctaactgtagcaagatgttcccgatctattcgcagcaaaacatcatacgctccaataattctctcagtttttgttttgttcacaagtgaataaatttgtgctgcactcaaaacctgttcacaagtgaagagttgactagttcataggatggagcattttctagtttttatcccattacgtgtctgagtatttccctttttcctggtgagacaagaggcggcaacatgagaactttgcaattctgtccaccccaagaagcacaagaaaagctaggcttgctacattttagtgtaccatagctagcagctctctgattggtatttgatctcgaaccgtagcccagggaggaaaccatgatgttacttggacatatgacgttgatatgcaggcaagatgtatggctaacttgctcaaaatatgacaataatgtaactatttttaccagttttttagtcacttaatttggagttaccgacagatccatacttccataagatctcgacaaattccatgcatctaatccaaaacaaactaattgaatttttataacaagctttagtctttttttttcgaacggctggtcagaattgactggcgttatattgatagaaggacaaaaagtacaaatagccaaagggctaaaaaagagaaaaactgtacatgacaacatgcaaacaagcttgcacgtagccttcctagctcctcatggcaacattctcccaatgtgtttagcgccggccatactccaccaacctaattcctcttggatgcgactaatcatctggtgtactgtcgcctcctttgctctgaagattcttgcatttcgttccttccagatttcccaagcaatgagcaagaagagagctctgagtcctttctgttttgttgcttccgggtcgcttgttccttgtgtccaccaatctaagaggtttctacttgtgttccatttcgggatgatgtgcccttggtgcagccatgtgagaatcccaaaccagatttgctttgagaccgggcattcaaacagaagatggtcgattgtttcgagatttcgaaagcatagctggcagaaataattatttggccatcccctgatctgtaaccggtcagttgtccacacccggttttgaagaaccaaccaactaaagattttgcactttgccggagcccatgcctcccaagacaactttgttgatggcgagagtaccattccattgaattggaattggtacgcggattttgcaccgtattccccattagttgtccattgccaaacaatcgagtcttgtaccccctctgttagttgtggggtgtcacgggctaaaatttcccaaacatggaagaattcatcaagaagaggaatggtgaggctgtggcggacgtcgttaatccatcttccttgttgcagggcgtcctagacggtgcaggttttcctcttcgaatgcctataaagattaggtgcttgactttttaggctttggccaccgatccaatttgattcccaaaagctcgccttttgtccgtcaccaatttggactctcgttgatgccgcgaaaagatccttatccaattcatcacagggtgtttcagtccctatccaaggcttctttggcatcctccattcgaaccataaccatctcagtcaaagagctctggcaaacttttctaagttcggaacccccaaaccaccgtaccggacaggtgagaaaactttaagccaattgaccttgcattttccgccatgcatattctcattacctacccacaggaaccgccttcttgctttgtcaatttcttgaagagattgtttcggcggtttcagcaccgtgagggtgtaagttgggatggcacttagaactgagttcaccataattcggcgcccccccatgtacaacaatgatggcttccatcccgagaaccgacctttgatcttatcctggagaggctggaaatgcaccttacgtaggcggccaggagtgagtggtagccctaggtaagttagtgggaagctggctcttgcccccgaataactacgcaagacgtcgtccagatctacttcctggcatcgaattggtgccaccagactttttccaagattgacgtgcagccctgttgccttgccaaagtccctaagcatggtaataagaacatccacctcgctttgtacagggttgagaaaaacagctgcatcatctgcatcaagcgaagtcctcaatctagcatggcgacttccgatgttggttagttgcccaccttcggtcgatagatgtagaagcctttgtagggggtcgatagccaggataaagagatagggggatagggggtccccttgcctcaagccacgtctgtgtgcaatgcattccccctggtctccatttaggactaccttggaagtggcggtggaaaagagcaaacagatccaatttctccactgggggccaaaacccatgttttgcatcagttcaagtagatattcccaggagaccgaatcaaaagctctagcaatgtctagcttgagaaaaagtgttggctttttgctggcatttaggttcctgagcacgttccgaacatacaggaagttgtcttgaatgcatctttttttgatgaaggcgctctgtgcaacagagatcaggccatccatctgcctggcaagccttattgctagaactttggatatcagcttggcgacggagtgaatgaggctgattggcctaaaatcggtcaccaaggtaggggcattcctctttggaagcaaggtaattgctgctctgttgagtgctccaaagtttcatcctgacaggttatacaaacactggaaaacatccatgatatcctgtttaattagctgccagcatttcttgtagaaggtaccattaaagccatctagacctggggccttttctgccggcatctgctttaaagcggcccaaacttcctcctctgtaaaaggttcatctagttcatcggggttaacctgtggtagatccatcgcgttccaatttagggtgcaatttcacgcctccttgttgcctaggattgagttgaaatggttgaaaagcgcgtcacttttttcctcatgttctgtcaggatagcacttgttgtatggagttggtgaatgtggtttttccttctcctcgagtttgcgtgaatgtggaaaaactttgtgttggcatccccttctttcagccatgtcaatcgcgatatctgccttttcttcgactttgccactgctgctagccccaaaattcttagcttgaggtcattcctgagctggtgttcatcagtcgcttattatacgattgagttacggttataaattagagatacatagctggatgcatgagttggcaaaatattcagtagtcattgttacatatctaaccaacgaaacaaaaatgtacataaatcaatcacatgtttttcccccttttttttccctgaaaactatccacgcgtctacaccaaattaagttcataacctcaaggagtgatgagacccatggtggtttacagcgcgtcgcagccgttggaaatctgtgccagtgtcagcctgaccgcaacgcaaaagccggtaagaccatgcttgccagattgccactaatgctgcagcaccaagatgtcaagtgatcgatggacttgaactgaacgctccagcggtaatgctctcggcgactatttcttgagcgacatcttcttttcccgtggcctctcatttctatggcattttttttgttttcggtaagcaataacctcaagctgatgcaatcgtggaagtatatatatagtttatgagagttgttctatatagcatataaatatggtggaaatatgggaatgtgccacctgtgagtattcctttctcattttacatcgtctccgtttgttccactcttgcaattcacactaatgaggaaggcccagcgtacgaatgggaggacgacatatgaacggtcacaaatgcttagttaccggaatagcaacagtctcaacatgaggagttgaaatcttacgaaagaacagtggaccgacaagctacaaatgttgaaagaatagtataacaaaaagtcaaaaacttgatgagcagatagccatatatttctcaccttcgcctcttctaacggagtttctgttagatttaattgggtaatttatccatttaaatcaattaaatcaaataaatttcaaggctcattatgctaggaattcatgtgtattcattctcttatgggacatcaatgggacgaagaattttcagaattattccatttgattagggaattggtaacttatatcaattactcctaattgatggatggttgatggttgtgtagtggaggatggttcatggctagatgatgacaattagttgctctattcctcttcctattccattgcattggtaacctacactaattactcctaattgatggttgattgatggttgtgtagtgaagaatggttgatggctaattgatgagaattagttactctattcctcttcttattccatgactcttactcttcatcttccattcctcctataaaatgagaatggatttgatctccctaaggagaagtgagacacactttcatccatttccaaggctgttgctgctacggtaatcccatcccgacgagtgtatgcacacgcgttgggagagtaggcctccgaaaccacgcactgctgcgacgtatgcacggacgggcgggcgatcaggtttttggggagcgcaagacgagactactcactgttcatcaacgtctacttcgtcttcaccaacatatcgagcactggagacaacggcaacactagagacaaggagaaggaggttcccgtcaacaccaatgaaggcaatactgcctcaaactccagcggaggaccattcggtataaccttcttatattatttcacttagaagttttaatgttaatgttcatcgcaatgtcaacattgcgttattatgtgattgttgatgcttattctacgttaagcatactcatattgattacattcgccactatcattggatcaaatcccattgtaaatatcatgtttattatcttgctattttggattaaaatatgccgaattatgaccaaattctcaacaatccaaaaacctgataggtccttttaggtagttggctttgctgcaatactgaaaccacatgtttttgatggttctaactataagagatgctaagcacgtgcactactgtggttgacagcgatgcaatgcttctatatttcacggaaaaaacgaagtgaactgcctctctctcctgaggaggaggctaggttcgaggattcggattgcctgttccgtggaacattgatcagtatacttgctgacaatatagtggacgtgtacatgcacatgccttcggggaaggtcatgtggaatgcatttgaggccaagttcggagtttccgacaccagcagcgagctgtatgtcatggagcagttctatgactatgagatggtcgattaccgttctatagtggaacaggctcatgagatttagatgctgacaaaggaacttgagaacaaacaactgcgagttgccgaacaagtttgtggcgggtggcattattgccaaatttccaccttcttggtcggactttgctacttctctagaacacaagaggcaagagttcggtgttactgatctcattggctctttgggtgttgaggagaaggcgagagcaaaggacaacagggcaaaaatatcgagggaggttctagcgccaatttggtgcaaaagaagaaccctcacgcatcccacaacaacaacaacaagaaagtcaagcctgatgtcaaaccaaaggctactaccaattttaaggataaaggcaagggaaaggccaagggcgactgctttgtgtgcggtaagcctaggcattgggccaagaattgtcctaatcgcaaggacaagaagtctgccaacatggttattagcgagggcggaggaacatcggggtatggtaaatttttacctacaattctctctgtttttcattcacctgattggtgggttgatactggtgctaatattcatgtgtgtgctgatatttccatgttttcttcttatcaagtcgggagagattcctccttgttgatgggaaacgggtcgcttgcggttgttcatggtgttggtatggtcgatttgaagtttacttcgggaaagaccgtgcagctaaagaacgtgcagcatgtccctttaataaagaagaatctagttagcagctctctactgtgtagagatgcttttagacttgtgtttgaatccaataaatgtgccgtatctaaatatggaacttttattggaaaaggttatgtcagcggagttctgttccgtttttctttggatgacatgcgtaataataataatgatgtgaaccatattagcgagaatgatgagttcaatgtgtggcattcgcgactttgtcatatgaatttcggttgtatgacacgcttggctaatatgagtttaattgcaaaattcactttagtaaaaggttctaagtgccatacttgtgttcaatcgaaacaacctcgcaaacctcacaatgcatctgaggcgaggaatttggcacccctagaacttgttcatttcgatctgtgtgaaatgaacggcgtgttgagtaaagagggaaagaaatatttcatgacactgatagatgattgcactagattttgctatgtgtacctattgaaaccaaaggatgaagcattgtattactttaagatctataaagctgaggtagaaaaccatcttgaaaggaaaatcaaatggttgaggtctgataggggtggagagtatttttccaatgagtttatgtccttttgcgaagagtttggaattattcatgagaggatgcctccctattcacccaatcaaatggggtagccaaaagaaagaaccgcactcttactgagatggtgaatgccatgttagacactgcgggacttttcaaggaatggtggggtgaggcaattttgactacttttcatgtcctgaataaaattccagtgaagcataagaaagtagcaccgttcaaggaatgggaaaggaagaaactaaatctctcatacctacgcacatggggctgtttggccaaggtaaatgtacctatagccaaaaagcgtaaacttggaccaaataccgtagactgtgtgttcctcggttatgctatccacagcgtgggttatagatacttaatagtaaactctggagtacccgacatacgtgttggtataattactgagtccagagatgccacattctttgagtgaatttcccatgaaaaatacacctagcacatctagtcaagaacctgttttaccccatgagcactttgcaccgatagaacacagtaatcaaacgcctgaggaaaatcctgaggaggataacattgtatactcgaaagagtaagagacaaagggttgcaaaatcctttggagatgactacattgtatacctcgtggatgacactccaagaactatagaagaggcatattcatctcctgacgctgactattggaaggaagcggtacgcagtgaaatggactcaattatatctaatagtacttgggaagtcgttgagcgtccatatgggtgcaagcctgtaggatgcaaattggttttcaagaaaaagcttaggccagatggtacaattaaaaagtacaaggtaaggcttgtggccaagggttataaaaaaagaaggtgaggacttttttgacacctactcaccagttacccgcttgaccacgattcgagtactacttcatctggtagcctcttatggtcttctcgtccattagatggatgttaagataggctttctaaattgagagctggaagaggagatctatatggatcaaccagacaggtatgtactagaaggtcaggatggaatggtgtataaactgttgaaatccttgtatggccttaagcaagcatctaagcaatggcatgagaagtttggcacaacacttacatctgctgacaaatgtgtgtactatctctatggcgggggagagggagtgatcttgtgtttatatgccgatgacatattgatttttggaaccagcctcaatgtgattgaggaggttaaggactttttgtcccaaagctttgaaatgaaggatttgggagtagctaatgttgttcttaacattaagctactgagaggagatgagggtgggattacactcgtgcaatctcactatgtggacaatgttttgagtcgctttggttatagtgactgcaagccatctcctactccttatgactctagtgtgcttttaaggaaaaaccgaagaatagcaagggatcaattgagatactcccatatcattggttcattgatatacttggctagtgcaacgagtcctgacatctcatttgctgtgagcaagctgagcagatttgtttcaaatccgggagatgatcattggcaagctctggaaagggtcatacgctatctaaagggcacagtgagctatggaattcactatactgtgtacccaaaagtactggaagggtatagtgactcaaacttgatatctgatgctgatgagataaaggccacaagtggatatgtgttcacacttggaggtggcgctgtttcagaccatcttaacgaggtcaacaatggaagcagaactcacagc

SEQ ID NO: 78278 - DNA, 736 bp, Oryza sativa
aacatacaagtttaaatttaacttttacatctcgcaacggaaaaaaaataaatttgacatatgaatatatgttaacaagctgtagtttaatatgtttttctcgttgtgaaatgtagaagttaaatataatataacataacatattaatatattttttaaatttttttcataattatttgagtgacgtacaaacaacgagaagtcgtcccctcgggatatcaaaatccactccctagacaacgataatggaagcattattttcgacctctatatcaacaaacaatgcaaacaagcattatttatagaaccttgtcgctgccgttactgaaggaggaggatgcgaggagctccggtgtagaagccggacgcgccggtgcggagccatggcttgtaaccgagctggcttctcttcccatcagggagaaatgcaccagctggtccggggaaacaacaaccagagatctccggcgaattcgttcctctccatttctacacgcaatggatttgattcttcttatcggattcgaattggatgtagtttccccctttcttaggtggataaaaaacaaaaaggaaaataaatattggtgaagaactgtaatggactgggcctagagatgccacattatttttatgatggaataagtccattttgtctccctcatctcttgcgcttgattgaattgcctccctcaaccacaaaaccgggtataatgaatccctcatcttcaaaaac

SEQ ID NO: 78279 - DNA, 6634 bp, Oryza sativa
taaagcatgtacccagcctaggctcacatgaacaggatgcaaggcgtacaggaaatgagcatggttcagcagaataaggaaataaagcatatatatctcccacattgccatgacactaccaaatatgctgcctcccaggctgctaaagctgacactaaaaccccacatatgttgaagctcatgcctgatttagtgctgcctgacaaattgccaccgcctaacaactgcgtgatgttattgtctccccaagaaaccccagcttgtttactgccaaagtccaaactctccaatatatgatgctggcactggtaatgaacttatctattggaatgtggttccatcaatcaagaaaggcaatatgcaaaataaagaaaagaactctgatattccccgggagctgggagtaattgctaatttcgattatatacggttaaaatgtcacaatgaaggaacttattttatgcttagtttatggttagaatggtacaatagacataattggtttagtttagttctttttcaccactcccataatacatgcatccaaccaaagtactaaaccatactcactcattcatcctgcatccacaatctaaccgaactagtaaccaatcaaaaacattggcgccttccaggacaaatgagaccaaagatgtgattaactgagccccatctaggaaacccataggcacctaagcgacctaacatgtgtatacagtatgcaaaactcttgagtacactgaccaaataaaaacagcatagcctcttacataataaattaattaactacagtttttaagcacataatgaaataggcacggagtgatacatgtgaaacctgccagtagaaagaaaggttcaccgagaaaaagttaacagacaatatcagatattatgaatgcaacatttataagttataagttactagttgtacaagctaaaagaaataccggctctgcacttgaatgtgtacatttcaggcatgcagcaaaggcactcttcaaagcatggaaagcacctgggacttgcactttaataatggaacttgctggatccaaagaaagtaaaactggaagtatgcgtccgtaaaatgaaggtcttctttgcgcgatagctgagaggctgagggaaattcatgttagaggatgaggaaaaaatggtagaagataaaaatataacatggaagaaacctgcactttcttctacaaacagaatgaataaatgttacaacatcctcatacaggaaatatatttgttccaagaatggtaagaaaggtaatatatagaaaagacagtggaacacaaatggatgagacaaacctagtaacaaagacaatgatcatggaagtactgagtgattttactttaggaggcttaagctgttctagcagcaatccaaggttctggctggcttccattgccagatctccaacattaagcaaagggtgacctcctctcagccacgctacattgaatcccatatctacaaaaggatttacagatgacagaccatcatggcacaactccaaaatattggcaaatgtttttttttttgggggggggggggggggtatgaaatgccgtgtatgttataccttctgtaacttcaattggtggatccggtggggtatcaagatcaggggtgtacaatagaactgttttttcaacaaatttaatagccagtaacctggctccttcattgctcatcggctatacagcaggttacgcagatgtaagaaatggcaggaggagaggatgaaattgaccagccacgaggaaaaagatagtgccttacctgaaaggccatgtgtgacacagcagatttaagcttgagcagtgcctcccaggataattttaatgaatcatcaatgccaccacttgagaacaagccctgatatcaaatccggcaaaccagcgatgttaggcaaagttcacccacacaggctgctcgaagagcttctgataaaattacctgaataactgctgtcgtagtactttggcaaacaaggttgttcctgttttaatagcttgccttgcgaccgcaggtgtgtcatcgttgagaagatgaagcagacaaggcatgacattgggaaggtatgccatgtgttttgacccaacctcaccaatcatcctatgtcggggtagaattgacatgcacatgtagcaaaaaaaccatgagcatatacgagcacagtgaaaagcgtgggcagagtattataatttctaatagacgctcttatgaacaacaacaccttgagcgagcaggctcgtgtacagtattgttaataactagcaagcgctaaattatcatttgttactgttggtgagtggtaaatagaagagtggaaacttagcatcgaatgtgtgtggaaataaaattacagagtgactcaacgttgacacctaaaccacacacaatccaaatataaaaacctaggacgggaggatgaaattgggaggtccaagaccaagaggagaaagggacactgactcggcgacgagcttgcggacggggctggcctgatcggcatggaggtcggcgatgcgggcgacgaagtcgaggagcggaaccctgcggagctggcggaggcgcggctccatggaggaaggcaaaggcgaggggttgggatggaaggtcggcgggaggtcttgggcagcggccacagccatcggaaccctagctcctccgctccggccgccggcgctcactccgccgtgccgcctgcggatgggttgggctttcccttttctttttttttttagaataatatgaatatgggatgggttggaaaatgtaaatgggcttacggtgggagggatgtcatctggacttaaatcatcagatatatgggctcaaatttgagatgcacatgaaataggaaataagtccacctgtcatccctcaactttacgtcgagtttgccagaaattttcaccctccatcttgacaaaacgggcccatctcgctgagtcaccactgaccgggcctatatgtcagtggataacctttcttcttcctccaatcctcctctctctctcctctactcctatcaccctccatatgtaattgctacagtatttgaaacaatatataaatgtaatgaggcattgaggtgtgtatataatggatatatcaatatggccttgtccaaattgtcactagctttatgctgcgtcttacaaagtacagcacgcacgcacatcaaatctagctacatatccttcaatacatgtatgtatactcctatatatccatggaaagaattgtgacctccatatctccacacggacacgcacatatatatcgattgatcggcgatatatataggtctctttctatctgtctgtggatcgaatgttgaatacatgtccaggtcagtcgcagctatctaattaagctaatttaagcctccgggcttaaaagaattgaaggaaatgtaaaattaatttagttagcagggtcggtctggtagtagaccacatctccggtgtcgctgacatagtggtcgcgtttcaagctccgggacagcgctccaaacaggtgtaagggaaaaggcccagacttgtccggctccctgtagtatttccccatcacaccctttgctgcttccgtctgcacattttcatcacccatgcttcttagtaattactcagcactacgtactgataaacatcacatagcataatttaattactagtactccgcatgcactgcagagactagagcttaccgcctcaattagatggtaatgcgggatttgggggaaaagatggtgaatgacatgtgtcccgatgtcgtggtggatgttgttgatccacccatagtccctgtccactgtcgtcagtcctccccgcaaatagctccattcctgtacatatcatcaatctattcagtacaaaagtgcaaaagtgagattattattatttggatttccttgagtaattctctgcctacgaacattttctaaagaaaaaaaaaagaaaaaaattcactgcctcacagtatgaattctgaaaacgatgcagctctctaggaaaaagatgcatgtatacaaaagttgtgatccaacttgcatttgcatcatggaccacaacgtattgtgattttttgtggacagaagatcgcatctttgcattatcatctagtttctatgactcgtttaatcacaggctcaggtcaaagtcccttcctaaattgactatttttgacaaggtagttatgcctaatctttttttttctacgtactgcaatcaatcgattactagatccaacggcataaataaaagttgcaacctagcttattcattcagtgtgtgagccatgcatacatatatattgcttgatttctgaatatattaagcatgcatatagtgtgagcgagtttaattagagagaagaaatgatgtatatatgcatgtcgtctaatagtaattgatagtaaaaaatgttagtaattagttaaacggaccttgccacggtaccagggcagcttgtcgttgtggccgtgatggtgcaagtaggtgacgaagtccagccacataacaaaaatctgcagagaagtagaattgaaatacaaactgatgagaaaagaaagcaaggtaggttttgttccccacatccacaaaagaggagatcgagggcaggcagaggatagaggaacccaatccacagatcacatcaatgaaccaacgtatgtatgtagggggtaactacgtacccagtaagggacaaagtagaggttgagcatgaggaggggtcccatgaggaaggtgaggcctgcgaggagggcagccatggccacccagcacgctgtggatgtcagcacatcgttcctttcgttgggctggaacaggtcgctgctgggatggaaatgcgaaccagactttcctgggctccgagaccactgcatgcatgcaatatatccatccattcatcatcgtcttaatcatcacatcacatataaatatatataatggaataatgaacgtagagtacattgttatgctagtaatattagtagagtactagagtagcaattaattaaccaggtagaatgggtaggcgagcatggggaagggtatggagaagcggagcatccgggtggctctgttaaggctcctgtacagccgctcggggagctgcattttggattggattgatcagattcatttgcaatggggaaacccaactggagtagttgcaattaagtagtgaaatcgagaaggaaggaaggaatgcgtacgggatgccaggactcatccttgtcgacatggccatggttctgatgatgcgtcctgtggctaatcctccagccatggtagggtacgaggatggaggagtggagtatgtggcccatcacgctgttgagcctcgagttgttggagaagctcccgtgcccgctgcaattccaattccatgaacgaattaattactactagtgtagtagagtggagtaggaatcaaaatggaaatgaataccgtcgtaccagtcgtggccgaggacgaagagcgcccagaacatggttccctgcgccgcccagtagagcggccaggcgaggcagctgtggaggcgcgcggcggcggcagcgagggcgaacaccaccaccacgtcgcgcagcacgtaccccatggatcgccaggggtccttcacccaacagtgcttggggatagcggcgcggatgtcggccagaccaaacgggggcgccgcgcccgggtcgaagtcctcacaaggaggaggaggagcattattttcattgtcgtcctcctccacggtggccacgcggctggtgggtgcggccacacgagcggaggcggacattcccaagtgggagcgcaaatgcaatggcgcgacggcggcaggggaggagggggagcggcgcgacgccggagagtagcagccgggccattctttccttggttggttctactccaattggtattggtaagctgcgcggcgccgcccccgcctgggtttatcaacgcaaaaaggaaaggaaaacccaactgggttgccggccctatctatctatctatctatccatctgtccgtatcccacttttgggaactcgtcggcaaacctcagccttccctccactccatccaatacctcatcaccttccaaaccaccccacccgttacactcccaaccacaaactactcacatccccatttctcttcccaaaactaccttccactcttcctacatactagtatatcattacattctgctgtaatacaacatattactatcttttttctttcaaaaaaaaaagagagagagaaacattacattctcgtgtagtacaacatgaccctaaagctaacgtgtgtataaacgaccaccgcgacaagctcggagaaatatgtaccacaaacgaattatatatatatatatatatatatgtagtgcatacctaaaaatgataaaacaaattgacgtataagatttatccacatcaccacaaataaaacttttactcgtgatgacatggacaaatctctcacattcacttcataatcagacagtttgtcttacatataaagtttgcgctacatatttccccaaggctcccctcctactaatattatacacaacaccaccagatggcacacaatgaatatgaatcaatggc

SEQ ID NO: 78280 - DNA, 612 bp, Oryza sativa
cctagctaccagtcttgcatctctaactatatatacacatacatgtagcatcctgctccatcttaactagctactactagtgatgagcagaatcaacctcatgcagtaatatgctgtgctgatcgaattaatttacacatatatagatagatagatagatagatcgttcgaccaatcgagctagcttgagcaaactgattgacctggtgaagtggtataattaacgagcagatcatggaggattgcagcagctggatccatggctacgccaacgctaacgccaccgccggcaacaacggcttcatgtgcggctacgctgccaggtaggtgttcaaacatcttgatgatcaccgtgacacgatcgatcgattgatcgcgacgacgacgataataccatctgtaaattagtcgtctctgttcttgagtggtttggctgatcagttagttaattagctacttcgtgtttgcagctgcagcccagtagagtttcagcagcagcaacagctggtcggctcgcagattgagcaccacctcaaccaggcaagcttgatttgcaatttattcgatcaagaaacaatgcataaaatcaaagaaattttaggatttaatttg

SEQ ID NO: 78281 - DNA, 4420 bp, Oryza sativa
tacagctagtgagctcgcagttgctcgggttcgtcttcgagcagcaccggcactgcaggcacaacggcgccgccaacgtccctactacgccgccgccaccgatggccaccaccaccggcttcgccggcttcgtcggcaccatgtcgtccgccacctgggcatccagcgcccatgctagttgattgatacacgcacacacaccgtggtaaattaaatgtgtaatccgtcaagaattacattacaagttcagagatgaatccagatcgagcttagaatatataccttgggattgcacggcgacgacgatgaggaggaggacgggggacgaagctcgagagaggggaggtcatgctcctgcagtagttcgccattgctgattcgatggatattacgctgttgaatgatgtaaatttggaaatgggaatggttgaggagaccgagtggcgagtgacgacgagatatactcgtttatataagcgaggaggcgtttgcatgccaaggcaagaattcatttcctgctaacgttgatatgcataaatttagaggggcgtttaatagattaattctatcctaatttgagcaaaacgctacttcatcgaattcatgaagctctgcgaaatgtatcgattggagctcattgtagatagacgattttcaaatggaccatcaaagctctgctaaatgtatagattccgtgcctaagtgcttatctcgaacagtttccataccagctttcttcttgttctgatcacttctctctttggagatatgcaattagttccttccatattgcaaaaccttatccatttctttagaggaagaaacttactttcttgacgattcaaaacgagctagatggaggtgggggctaatcgaagcccttaattacaacttgggcctaagttgtcaaacatagggacatattgaagggaaaagaatccattttgtttcccccaaccataggcccggcttgttcacatctcttacccgcaaaaccagatagaaagcctcgctcgcctatcaatactggattgttttgtcttatcgagcagtttgcatgtatgtttcgtcctacaaagtgcccacatgcatggcacattgacttgatttttgaccgatgtgacgactacatggcagttctaaggaaaaagtaaaaaatatatagctagacccatgtaaggcccatatgtcagtgaccaccatctgtctcccattcccccctctcctattaattactggactaatgcggtggtgaattgaggaagggaggaggttgctcgtccaagggttgtgtcacatccctttttcaaatttgcctaattttgaaaattcacattcatatttattcgcttaaatttttttaatggaaacttcataaatgaaatatggtttaatttgactaaatcaatcctcctctatcttttctcctaataaatctccaaaaatctcaaagggaatcccactgattttgtcgctgttccatcttggtcaactcgagataaaccctagtttcttcgctgcctctagctatcaaatccccaccggtcacttcctccttggctaataaatagcatccccttgtccgagctcgtcccataccccagccgccttcccgcatgctcattctctctcctccaccatcggcgccgctccggccgagcagtatcattgccccggtaatcgtcagtcaatgccacctcctccttcggcactgcagcagccgtgcgaccggcctccacttcccggaagactaagaccaccgaaagttccaagtgctcctacttgccgtcgtctctagccgagctgcgccgatgatccccgccgaagccgccatcggcatctgaaggacacagggaaactcggtcaccacctcttctttctcaagtcttgttagagcactgtcattgtcgttgacccttgaagcccgtcgctggccaccgttcatcctcatcagtggttgccaaagtgttgttaagtgtcgcctcaccattccttgtccattggtgtcctcagtgtctcgctcctttgttcgccgtgtgccgctgctcctgggtctgcctttgttgatccaacatggttgccacatcagcattttatcagctaatccgtcctctgtggctgccacccaggctccacgtggcacctctctgcatcactagatcagaattgatctgaatagtcagattatttcggtcaacagtggccaatttatcttaggcatccatctctatggaccatagtggacctcctctatggactagatccatggtagacccattgcatcctctctatgacatgcgggtccctcttgtcagtgaccttagcctatcctctctatatggcatgcaataaacagtttaattgttttctatctcttcttcttcttcttcttcttcacaaacatgatacattcctcattcctcattcatcatatccaacgatcaatattcatctataacagatcgaatgggtgagattgtgtcacacccagaaattctcgaaccagaatttctaagctgaatgtgcattaaatccttgtccaggaccagccagggtacacaaacgacaattgttgacatacagacccacgtcttacaaaaatataaaagattataaatgcagcgggaaagataaaagtgagctaaaccaggaagcttgacttcagcagcgggcgactccactccacaggcaaaccttgacggcagcgacgaaaccaacctctctgagacggctccaactgagaagaacttcaactctagtgtgggggaaaagagagcaagactgagtactacccactgtactcagcaagtcataccggaagaggaggtatgatgcaggatataaccaaaggaagctaggggttcttttgcataaagcaggcatttcaaagcagtagttggaagcagtaaaacagctgtagtaattaatcaatattaaccaatcattgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaattgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccgaacacctcggccgacccaattccatcacgcccattctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcactcacagcccgccatttagaatattttaattaactgacacccttgcggtggcaccaatctaaagctatgccaatagtcagagtctatgtaataatgtgatccccatttgtgtactagttgaactaagcatggctaagcatttcctaagccaacatctagtcattttgatacccaagttatcaatggcataaggtaaccaatatgtggctgaggaataggacccatcccacattacattgtaaaagaatgcaacatttaatagaaatgcgggatatttgtaaattgggtacaatatgatcaaaagtattgcatgacttgccttggcttcgaactgatgagaccttagcaaccgctttcgagaaacccgcggatcgacgaaacggcccaaacctatgcgacaaacaaagcacaacagccaaacatgctttaagactattgaaacaggaaacaaaacacttttaatagattctttgcatttttctgatttactggaaatgaatggcttaaacggagctcggtagaattacttaggtatttagaaaaaaaaatggggttttacctataaagaaaaaggcctaattaattattcgccataatattcacgggtgacgtcatacaagggcgcgcacaaggcggggccacaggttaacggtttaaagggaaaagaaagggcccccgcttattggccccaggcgagtgttaaggaggccggtctaccgggacgggacacccgttgggtccacccgtcacaggaacccagaccgaattggtcgggagcccctggacgaccgcgggcgttagagcgctctaattcttttataattggcggcgccctgttaaatgggttacccccatgctctcatcagaatatatggcggaaacaacgatcaggtcataaagcgtgttctcaaagaatcatcttgtggag

SEQ ID NO: 78282 - DNA, 982 bp, Oryza sativa
  unsure (1)..(982): unsure at all n locations
aacggcctgcttttggccatgaatctaanctgagcccaaattgatgttcgtccaatcagtttctagggagaaaaaaggttcctggtcattcgggtggctaaaactaatttattagggcagcgtagtgtgcaacttttcttgtgaaagtcttgaactttttacagtccttctgtttttaactgacaaaaatccattactatccttctgctgttatctttcaataaaccaagggaattttagtttgttctaaaaatcaattttccctaggctacccagtcatcactcagctcatgatgtatcaaaaaaaatctctattatatttggaattactttcgtgattatgatattatattagagtcgtttagaataccaaactttttcctactaattttgtaggcttctaacataagttaacttcaaatataatcactctgtgaatataggtattgtgcatatgaaaatgatcacatttgaagtaacaaaaattttacaattttaaacttatgcaacaatttttcgatttatgctaagaatgaagtcatcaaagttacatcttattgactttttacagtctaaaatgatacatatttgtgactcgagggagtatatcatcattgcttaggactgtaaaaccactctgaattaaagcaagacttatgacatgcagtcacgcacccaagtcttttgtgtctctttcaggccaatattgttatgtgccagctgctgataatattattggttctcatcttgacttttatcaccagcttagattcgtcaaaagttatgacattcaaccacacacatcacacatccgttggcttcttccaaagagattcctacaccatctgctaaacactttcaccgatggcagaagcaatcttctcggcaattgttggcgatgtgatcggcagagtgatatcccttgttgtcagtaatttcaatggagatcacagcactgaagtcaagttacagaggatatgcc

SEQ ID NO: 78283 - DNA, 662 bp, Oryza sativa
gggtgtgtgtgcgagagattggagatggtgcgctgcttatatacaagctgagctacgcgcggtgcgttgtgttacagctttcaggcggcctggctagctagcttaatataagctgacgatcgagcggccgggcgggctgtcgcgcgcctggaatcgattggttggcttggcggctcggcgccaccagctggttcagttcatcgtggtgggagggagtccgcccggcgcgggatggggtcgttggcgccggcccggggcccgcaattgcgtcgctggagagcggcggaataattgattgcgctcgcggcgcggcgcggcaaggcacatggtgaattggcgttgagatgacaactcctctgccgtgccgcgctgtctactggttacgggggcttgcgtccatggtctacaagcgaattctgatgcagcccaatccgatgatccaggcccattttccgcagggttgggtaggccagatcctcctaatcagaggctcagagcgttcggcccagaaccgtactgaaacagagagaaacaagtacagggaaactattctaatccctcgaggggatgttccctcgtttgctcaaaaatcatttaaatggttatgaaaaattctgaaaaaatttgacaacattcatacaacacatatatacaacttcaca

SEQ ID NO: 78284 - DNA, 2676 bp, Oryza sativa
ttgttttccgtgagacgtcgccgtgcacacagtccatcgcgaaccctagccgatgacgcagtaattcccttttccttttcaaaaataattcattattgcgtcataattcaattaaaatccatacaagtgttttaatccgatttaatcttttaaaattcataactaattcatcttagctcggatttagttggttcaagtctctaaatttttctaaaattgagatctacatgttagaaatatccacatgtactgttcatgcttgtttatgtgctgttttggtgattttactcttttctgtttagattccgacgtttccggagagtccgttttcgcaggagaagaatttgaagagtttcaaggccagcaaggcaagtcacacagatcccaaataaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagatatgattgtttagccatgcttagaaacattagcacactattgggataacttataactcactattcctcaagattggattaatgatagttcacgatggtcaatcgtgttggttgatttaatacatgcaacataaacttgataaatgttgggttgtgagcacatggttttgagagtcgtgctcatgacaattaagagcaggtcacagagtttaggttgtgaaacataaaccgtgccaaccacaagccagcgtgggcacaggctttaccttttgtatagcatggttcattgcgcagcaccagactgagaagtgccggagataagcccacgggggtcgttgaggagtctataccttgtttataaaggggtgattatgatccaggaacggtgcactgctttgaattgtgttgtgcgaggggaactgtcacagctcctttccaaggtaccgtggtggtattgaggcacatggtgacatgtcgtggggctgtgtcttgtgggtacagtggtacacctctggccagagtaaaactattcgaatagccgtgcccgcggttaagggcgggtcgaacaatgtctttcgtgattagtctcacacttctcatcataataaaagatgctataactggtaataatttgattagctcctggtttggaatggtatattcctggtttgaagatagaactgtgcagccgggatggttgttcagaatggttgggcctatgcaacagggtatgttgtatagcattggattaatattgtttaattattacttaactgttttattaaattctgaaatgtttattaaatgctgtttatgcaaatgaaaccctcctatgccatcctttgttatcctgtgcacttgcatatttgctgcgtggcttgctgagtatgtcatatactcaccttgcaatcattcatcagaggaggagttctacagtgatgctgatggtgtggaggattaggtgtagccctagtcaagctgcctgtggagtggagtcgtctgcgtcgtttatcttattttttccgctgcttagatctttattgattgagaggaactatctacctctgtaatgacattttattcgcttattaattagagtgataattgtactctattatcaatttgttattgtgtgcctcggctgattcctggacgagggttcacacacatgtaagcgtttggaattttggatagaaattccgggcgtgacaaaacttatccaagagaaaaagagtacaatctatccaaattattgctttgatttttgtaattggttttgggtacttgattattcagatcaagcttttgttaatagacatgcaaaatatccccctaaattttgcatctcttttaagtgtgaaccatcaaaactcgttgcgtgtatcatttttttcagacatagtgcgagtgatgttccaatggtcaaatcttgcatgtctatgacttgtagagtttgtatagtctatcagtgctgatgcgacacacatatcattatcttcttaataatgattttggggtttggacaaagttagaaccatgttacttgctagaaatggcgaactatgtccatggaacttatgtattttcatattctaacatagtatggttcactcttcacatggtgtaggcttacaggcctaagcaacataagtttctcccaattttattttaaactcggtccaaagagtgagcctttattttttatatgaggatattcggaacaacatttggtttggggctttaaatacttgtatgcgaatggtcaaacccaaaatattttatgcattattattaacttaggtcaactgcgggtgattttaaccatagcaatgccaagtagttctttggttaaaaggatatgtccataataggtttataccaattccgggaacatgctttttttattggcatggccaatagtggacctctcaattgttggaaaaagtttgtcaaaaaaccaatgggtttttaaaccgattttttggtgtactttaaagaaaaattgttgtgagttacgctttttttgccacctccaaaattggataaatacgctcatgtgcaaccaggttgggttgtgcacacaacaattg

SEQ ID NO: 78285 - DNA, 1933 bp, Oryza sativa
tggatttatattagtttatcaaacgggcgcaatagaactgaggtaactctgacttttgccgatttccctgttcttttttcacaccatatacaggatcttagtttgtttttatgacaatttttggcatgctgaattttatgaagatttttgatattttgactttttagtataattttaatagtatatggataaacttatagtgtgtatgatcaatgtattgttggagagaatgtgcctttctctttatactagagcgcattcctcaagtcaggaaacatgactaactacagctttgattgtccacctcaaatactacaagtaaaatctgagaattgtagtgtaggtaagaaaggagaaatgttagtatagatctcatgggaatatggtttagttatatgaaaggaaagagagtcataaattattgttttaaatctagaccatattcttaagttttaatctggaaagttctgtaagtccttaattgggaggtccaatcctggctgtcccagcccaatcctcaccaagaccagttcattttcgttgttggtattgggccctcccatactatgcctgagtgatgtgatcttcactgcgagcatgtatgcatacatcaatgcaagagcctggtaatttttgttgaaaaataattatcttacttttatcatgagcagatctctgccagagctggctattcttgctgaaagctccttaatgtcgttatcaaggtggagttacaaggcaggcatggagaaatctatgagctccgcaaatggacagattgctctggtaaatcgttttgctttgagctgtaaattggtcctaagggttcggttggtttatgccaaataatacattgaactttggtgtcacatatcgccagatgtttgttgattccttttttctgttgtttctggaacgtttatatttgagcgcatgctcaccgtgccaactggcaagaacagttgaagttgactttcgctagtaaaagtcacctctaatcaattccatctttaataggaaactcaagatttaatttagaatctccaggtccatctacctattacaatgttacatagtgtggccacagtacatgcgaatgtaactaatgcattagcgcacaatacacctttttttcacaatccactaatcatccttgatccagtgggaaatgttcggggaagaaatccatcattttttattctgatcttccctctgccacaggtaaacgggttgaacttgcaatcatctctcttatagcctcagagaatgccttcaggtacttggcttttctggcatgtcttctgtgtagtttttttttcctgtttcagttcgatctgctatttaggttaagaagcatagtcccgacatatgaccatgcactgatattttggcattcacaattatcattttaggcttccagagtcaatgccatgccttcatgacaaagtacttgcagcagctgctgaagcagctattaatgcctcaatggaccagaaaagaaaccaggtttggccttgttagatcttctatgtatcatcatcacctgtgtacaatttggcatgacaatgaaaattcatctgtagactccagcaggaggaattcttggtggcatcattaaaggattgaaaggcaaagaagaaaatgcaaaacagaaaggaagtttaagtgcacaaaccatgagcgaacagttggaatcgattttcttgaaagaatcacttgttgaaccatcaatacccgatcctgacgacccatagaagaactgtcaataggtcatcttcctccctgtctatctgaaagctttgcccttaagtactgcctatttatttgaaagcatttgaatgcagacgacatagatatcgatgatgaaattccactagcacccccaccagcatcatctacatctcatgtgaataaaaaaacaacagggctgcag

SEQ ID NO: 78286 - DNA, 3530 bp, Oryza sativa
aaaagttggaagtttatgtgtgtagaaaagtttgatgtgacgaaaaagttaaaagtttaaagaaaaaagttggaatctaaacatgcctatagagaatataccaataagctgaatagcaaacactccgattctaaagtccaattcaaagaagagttcaatcaatgccatgtgacgtgatgtcagagagacaggaaagaactacgaatgtgaccccattcacctccgacatgaaaaacagagcaatgaattagtacgtgattaattaattattagcttaaaaaacttcaaaaatagattaatataacttatctatagaattttttcaaaccacgcaccatttagtagtttgggaagcgtacgtgcggtaaataagagagtgaggttggaagcttaactgaagaatgcagcctaaaaaccatagcattgtatacaacaatcaaatatggtagtagtaatttgtattgcgaagcaatcaaagtaccatggagaggtaggtagtctcgtgcctcggtggcaccggttagcctagctagagttccggcagcatggcggcaagcagggcagaggattgaagaaggggtcggacaggggcaagcgcccgtcgtcgacgccgaagcgactgggagggagtctccatccatcgttgcgagcagctgctcatctagaccgcatatgcataatcgaacggacaacagagattccaatggggcttggagttttaaactctggacccttccaatgggcctctgtgggccaattcagcgcaataggctgacacagagaggcctctcgtcaagtcgaaagactacgcagccacaaattattccactcatcttagtcgtgcaagcttgatcgaatagtcataagatattccacggggttcggagttcaaaacgatgactcccactcccactattttgtactcctactcagcaaagaacaccaccttggccctcgtgccaagcctcgccggaccgccgccgcgtcctgtccacccttcgctagccagatccacatgagaagaggatgcacccaagctctaagcaggtttcccttaccgtcggtgtcgagtttatcgcaccttagcgataaacacgattaccgcgtggtaactgcagtaaactgtataaaatttattaaaaaattaaattatttttaaaatttgtttaaatttaatgagattaccgtggttttatttttatggtaccctaacggtaagtaagtacagcaatttgacggttactgtcggttttgtcaaccttggctgttggctccattcatccctgacggtatgcagctagctagcctgtcagatattccaatgttgtggacgatctggtcgtcgaggtgctctcgccgtcgcccgcgcatgcacgcacctttcatgggcctcgaactctggaatggagtactccctccgttcagaaaaaaaacccaatcctagatttaaatctggacatacactgtcttcagatttaaacccaggattggagtatatgataagctgaatgacatgcagattttaactctctaattcacagaagagttgttggagataatagaaatgtgatgtcagagacaggaacaaactactccaaaccatactccgcatcgatgatcttgttggagcagaattttatggtctcattattgcaaagatgcagcattgaaggttccaatatattgcactaaacaaattggatatagatgcaaattaaaccgcaacacaggcgcgcgcagccgcgcagagtgcatcagagcgatgagatctaatggcctaatcaccgcaatgcatcacgttaacagcgagctgagatcctagagtgggtcggagatttaaactccgaccccgtgcacactgccgcttcacgccagcccgataaacgtactctcttggtctctcgacgcgtagtctcggttgacttggggcggtttatgaagaagagcagaaactgaaaggcagtcaatgcagtgaacaccgtggcagcatttcatcgtgttcatgctatagcagatattttctttgcagtcaaattgagaagacctccagctcaaaagagagagagagagagaaagaaaagaatgagaagaacttgaaagcgatgctaattaacttccggcatcaacattcacgaaccaacacggtacgtcaggcgaacattaattcagaaaaataaaacatccaaagtaaaaaaaaaaccaataaatttcttatgtgctgggaatgcgtaccgtaccaaagcttgcgatggattaagaaaggagactgtccggcgagaagggaccaaagcagttttcttttttctccgaaaagcatccctggacggttggaccccatcccgagttccctgctggtgaagtagtacactcaaatggcaggcttacgtccaggttacagtctttcttctcaaactgtgacacagcagcaatccgtagcagagtcatgtcttcctttctcagttcaatactgctcttgtaatttgggctctatacaacccttttagcatttttttttagagaaggatattttttaaccggcctctacatttaaccggatatatacggccattgaaatagggaacttagccccgcaaacaatccaatctgaaattcgctccataggaaatttgaactcagaaccttggggtactactcagatcactacaacccttttagcatacatgacctgtaaagttacttaatgatccccgcaaaaaaagttacttaatgataacgaataatcaattaatcattcgtgatcaagttatattgaagtacacgaaaaagtgttaataatgctgccaaatgcagaatgctaatgccattgttctttatggactctgctagtaataagaaacaacagggtcagtgttcttgatggaacctacgaggtttggcatacttttgagttctcagtcaaggaacagcgagtgtacataacggccggcccctaaggaccagctgcaaacaacgaactcactccatttcatctttttctatttattattgaccgcggccacacatacagataagttattccccctctttttttataagaaggaaaataaacagctcgttttcttttcttttttgaacggaaaacggcacgagatagtaccttttcattgaatggagtaggagaaacagcttgctttatagtattaacaggtaataaaaccgaaacggtggatcaaagaacatatattacaggaaggatttacatcatcacataaatggaagagggtaaaataaacggagcaaaacaaggaactttcgatctcgatcggcgattattcctcccttttctacgaggtgggccatcacatcgatcacccaaaaaacctccaccaatataaatactggtttcccccatccgaacacaccgagcaatgatcatattgtaatccttcccgtcgccgagagattcccacacaggctaaaactatctatcaggcctgcaaatgcaatagggctgagaagtgaggaagctaggcaacctcaaccttattataaacacggggggatccact

SEQ ID NO: 78287 - DNA, 692 bp, Oryza sativa
atgcaatattgggaaaaacagctgaaaaaaatgataaaataaaaacaaatgtaaaaaacagagtaatctaatataaactaattcaattaaacattacataaatacataccatgtcacatgtctcaattggtctagcaagtgatgctccaaaaactcttttggaccattccaaaattagtttttgaagggtgtttcataagatcattctgaaataaaaaaatacatactcaatttgcaagtaacagagttgtatttaataaaaaaattaaaaaaatacaaacactcatcccaattgatgagaagaaatagtgtcgtttggattttgaaggatgaatcgattgaaacatatatcgacagaacacagacattacaaaatttgataattctccaccttgtttgaatgaagaaccaaaagatgagaatttgcagtgaactccatcaatattaacagcttcttgactgcagtaatagtacaaaacttacatatatgaagaaactgaaaaaaattacatgaaaaaatatttaaagttacagttaattttgcaagaaaaaaaatgtatgcagacattctaacatggagcagcacatgcttgcacaagcattcaatcacaacaaaatgttcagcaagtaaatataaaagtgtcaagcttatcccatagcataccaaaaactataaaaaattaaaaatcatg

SEQ ID NO: 78288 - DNA, 2851 bp, Oryza sativa
  unsure (1)..(2851): unsure at all n locations
gagagccnnttgtatganctccgttagaaccattcttttactaacttattacattttctctaaacagttcaatttagaccctattgacattttctgttagttgctttattttataacagttcaaaatataggcattatggatatttaaatcattggtttaactataaatacaacaatatttatattagaaatcaaatgtatagcttaaaattcatgtatgcttgaatatttttgattatttctcgctataaaaacaggaagggtagatggagagctcaagcgaagtagggaggtttcggtagtgccatgttgtgcatatgtgtgggggagggcgaagtgcaggggacatgagcggtttttttcttttttttctaaatgatttaagtgaaactgatgatccagtttttctcacaacttttgttattcattttttctaatttttaatatgtaacacatggtggcttaagatttttctaaaaatatatctattggctaaaaataaggatatacctatttaagtagaacttgatggatagatggttttcttccaatctgtaaggttttatttttatttaatgcataactcgtaacgccttcagtgcacttcagaggatatacaatgatttccattgatgtaatacttattttaattttattattaggttctctttcctttttgctatttggttacaattcgaaggatcagtgtctacattcaaatgatgtatttttaattttatagagtggaatgtgggtaacatgggtcttaaaatatttatttaattataaataaaacacaattcagataaagtaaaaattggatttaacttaagaactataatcatttagctttctaattattggactgtttttttacttagttaaaaattaggagatgaaggaattaaatgagataggagaggaagagagagttgaagagaagagattacgccgcatataattataatatttctttttatgggttatattgttttagttggtattacttttttagctaaaaattgataaatgctttattgtatgattaaaatctatctttttttacttgtcttttcctatggtatattcgcagtagatattaaaaatataaacactatattctaataacgttattttgacttattgtaatgttagaatggacgagtaattttttaaaaacattactcagagttaggttcattttgcttttatccatatagatataatttaattattctgacatcatatacgatgataaaatctatatcactatttttctataattttgtattttttcgaatgatatacaaaaataaaatattgttgcccaaattgacagatttcttctcaaagatgaattaccgtggatatgggtctttaaatgtaaaatagtctgattaaatattagttgtgtgatacttgtcttttcctatagtatattcgcagtaggtattaaaaatataaacactacaatctaataacattattttgacttattgtaatgttagaatggaggagtattttttaaaaacattagtcagagataggctcttttgcttttatccatatagatataatttaattattctataattttgtatttgttcgaatggcatacaaaattaaaaaattgttgcccaaattgacatgtttcctctcaaagatgaattaccatggacatgggtctttaaatgtaaaataatctgatcaagtattagttgtgtgaattagatgttaatgttgcttacttttagcataagttttgcttttaaactcacagaatattcattttacttttatcattatggacatagtttaattattatgaagttatatacgatgataaaatctatattattattatttcatacttttcacaattgcttgaatggcacgtaaaagtcacaaaatataaaccaaaatttcatttcttttcaaaagctaaattgtgaaatatgatcttcaactgtaaattgagttataaataatttaaagatttaacgtgtaggatcgaatcacaataactaagccaaccagaggggggtgaatggttggtatacccaaaaccgaaaaattttagccgaaataaaagttgccctcgaaattgacggaagtcagtctgaccaagattgatctgccagtctgaccgagtggatgttgccagcctgaccggtatagattacccggtctgaccgccgatgtcgcctgctgcgcctgtcgccgccgctggtctgaccgccgccttgtcgccggtccaaccgccggtgagtcatcggttagaccgccgaaacccgatgaaacacaaatcgaagaactcttaaagtagatgacgactttattacttctctatgtgtttacaaagtgccccaacagcactccttataaaaatctcgactaaactcgaaaccctaactcaaaactcaactcaattgctctcgaaagcgataccgctaagcctcacgctccccctctattttatacatgaggtaggcagcctaaagccacgaaccaaactcatactaagagtcctaaacaccttaggaaaccctctagtacaagaaagaaactttatataaccaatcgtaccaaatttggactccttccaaattcgactccgcatcccatacgtacacaatacctccatcgtataccatatagaatctccatcaaccacgtgcatcaactctagcctaagtatcccgcatgatctttgaccaccatggacgtcgtcttatccccaagccgacttccggtccatcaccgcaaatattctcccgaggtatcaagtcacctacacatgaaataaacaaagaaaccatattccgagaccaagttatctcaaacttgactc

SEQ ID NO: 78289 - DNA, 12094 bp, Oryza sativa
aaagaaagcagttgagagatactagcatgaaactgataagaatttgatcatctgtcatatgttcccctttaatgaacttgtccccaaaaaatttcacagagggcattgctgatttgccaaatgtttcaagaatcttgttttttccaagttcaaaattagaagaaatttcaattcctccaacaggcaatccaagaataatatgtacacaatcttctgtcaatggaattactttgtcatcaacaactatatcagaagaagacacatctacatgattagcaatccaagaggcaaactgatttggaacaaatgaagactggaaattcagcaggcttttaaagcaagtccttccaataacttccttatcatgtactgataaattgttgattacttcagagaaatacttcacattgaatctagtgaaaacttcttcacacttgttatctttctcaaaggtttttctctgccaaaaaaatttaaagaaaagaaattaaaaaaactaaagaaaaaattattcaccaatgtaataaggtaataaaattaccttattttcagactgttcaccaagcatgcttaatttcattttcaaagaatggagaactagatcattgtgaatctctaacaatgcatcatcgataattgagtctgattcaactttttgtctctgaaaataaaaaatatcatattaaaaaaataatgtaaattacaaaaatctaaatatgcattaatcataccttctttttatggtcatgtgtaaatggccttttaccaagcttaattttcaatttcttcataagctcttctttagttaaatgaagcaaaggatcattttcctcaaaatgttggtccttaataaaaaaacaagaagattcaaaaaaaatattgaaataaaaaataaacttccatgataaatgaacatgacaaatgaacttacatgattatcagaactttcatcatgattagataaatgaacatcaccatcatgattatctgaactcaaactacaatcattgtcactgttagattcactggaaatatccacttttgatctttttctatgacccatactgcaaggagagaaaaaagatctcaaaacataagtattatggactaaaatatataacaaaacagaataaaacatacaagttaaatgcaccatgtcatatgaaaataatattactttcatatagtagaaataattatttccatagagtagtgtcaaatgtgtagcacaaactcatgtcatatatcagagtatagtgatgactaggaatactatagtcttctccttctgaacaaatgtattaacaatactcttctccttctgaatactaaacctgagcatgcaaaatgcagagacaaaaattgactactataaaaaacattctagtacagaaatcttcaataacttgtgttatttactcatgtaaggttgtcattgaaagattaaaaataccaaactaaaatgcaaatggcatatagcatttgtggatttctagaaaaaaaaatcctgaatcagtgcataaacatccacctaaataccatatagcattctcttgcatagatttagaaactgacatcaaagcattactacaaaatcaatcagtgcacagaacatgcaaatcaagggtatacagaagggtcaacaaatgtacattgcacacatctagttcacaaaagcaaaagcacatatctagttcacaaatgcaaaaaagcaatcacaaaaagatatatctaaaatgaaatgaatcacagatctagtccacataaacaatatctagggctaagaacacaaatcgcaaccataaacataacagtactcttctcattttgaatactgaacatgaacatggaacatgcatcagagacaaaaaaaaattaacaaccataataccattctaataaagatataaaacctgaaacttagtacaaaccagcatatcttagtcatgcaaaaaacaactgataatatcaataacaaatttaactgctcatataaggttgtcattgaattaacatatagcatttgcagatttctagaataaaaacatcctgaatgcattactacaaaaacaatcagtgcatacagataggtgaacatatgtacattactcccttatttgcacacatctagttcagaaaaaagcataaaacacagttctagaacaaaataaaaaagcacataactagttcacaaaagcaaaagcacagatctagtccacaactacaaccacatcatgttctgtaattttcatatagaagacaaaagcaaaagcgcagatctagtgcacaagacaatatatagggctaagaacacagagatcaccgagtcataaacgaatatgaatcaaggggattcaccatatcaaacacatacatagattccgagtcgaaacaaactcagatctacaagccccatgaatcgacgacctaaaacacaagggaaaatcagaaaaacgaaggggaaactcaccgaaatcagctccaacttcacagccgcgtcgtagccaccagcaaaccaaagaccacgagaagagaaaaatgaagagatgaatcaacacaagagcaacaaatagaagaagaaatcgataaaaaatggaaaataaatctgccaccttcacctcccgcaaactgcgcaacaggactgcacaatcaccggacggaatcgccgccgctcctcccgacggaaacgccgccgcttcgcccgacggaatcgccgccgcgtcgcctgagacgacgagaacgagagaaatatctctctctctccctctatctgactcactctctctctctctccatcggcacaaaaaagacaagcgcggatttcaaaatttgaacagtgcccatgggtcccacacaggctgtcgaaaaaaaattctgatgtgggtcccacataattaccacacacaaaaaaaagcccaaaagcccagacacaaataaaaagctcataagcccacacaccgataccacaaaacgaactacgagccagtacgaatcacaaagaaatccgacggcttaaaaaacgaatgatagagccaagaaaaaacatgcgattgccaaatagccatcccgtattgtttatgtgtaagaggtgggaccatatattaatggtgtggtatgtgtttatatgtagctattgtataaatgacatattagattggctatagatgaattggagatactagttggctatactattaaacttgttcttacgagtgacaattaaagatttgttattggacccacaaatcatagatatacgaggacctacatatcatagactatgagtggtaaatatttaattgcgacattttaaaagtggcaaagatgataaatgtcccctcaatttaagacttccacacgtgccgttgctttacatttcttccacggttctttctcgttttgttttcttgattcctattaacattttataatcgaagattatagccgttaaacgatgtaactcattttttaaatactccatccttttatattagagaaaagtacaaattaacccctgaactattgggtgagtacgaataacaccccctaaactcgaaaaccagacatcacttaccccgaacttttaataccggccaagaaaccccccccccccaagcactgttgtgagcggtttagagttcgaatagcacacgtggcagtccagtcagcaattttttttctaaaacaatagcgggcccacttgtcagaatccccacctctatttctctcctcctctcgttctgaagagtgcggcggtggcggcggccggcccgctctggaggagtagcacgagtgtgcatgcggagaaatacggtggcgcgggagaggggttgacgcggcggggcgcggccagtggcatggaggcggaggcgagggccgcgcggtcgacagcgaaggtggggcggcggagatagagagccaccaccaccatagcctctgccgccaccgccaccaccacaacctcttccgggggagaacgacgccggagctgtggtcgcagacaaagacggcgaacgagaggaccaaggcgcaggccaccaccacgcacaacgccatggaccacggtcgcccgagttcgataaaatcattactcagttttttgagatggagataataattgatctcgatctgatgtgtccatggaattcggaacgtttgttgcttcaaatcgattcacagttgagcacttgagctcctccgccatgcacggtggcccagagcttggacgccaccaagaaggaagaagtttttctttttatttttttttgtttatagctctccgccccatggacttccggcagccaatgcccgtcgccccaccgacggcacggtggttagctggcgatgcgtcgctgtcacggtgctgacacaagccatggccgcctccgccgccgcaccttcaccatcgaccgtgtctccggttgcaccgccctcgcctccgtctccatgacgctagcctctgcaggcgccccgcagcttcgccctctctcccgcatgcgggacagcggggcggccgcgcgtttctgaaggagacggagaagagagagagaaaagatgggtggggaatctgacaaatgagcccactattttttaaaaaaatattgctgattggactgccacgtgtaatattggaactctaaaccgctcgcaacagtgctcaggggggtttcttgttcggttttaaaagtttaaggtgagcgatgtctggttttcaagttttggggtgttattcgtactcacctaatagttcagggaggtaattcgtacttttctctttatattatactcactccatttcaaaatataatgcataatcacctttaactaaaaaccaataaacaatcattatcacctcattgttggctcatcctaataaattagatgatgtctcgcgcgttattgcggaatatttgtattaaaatggaatttaaaaattcaagtacactttgcgagataaaaaagtagtaagaaaagagggaaactgaggcaatacagcgtagcaacttttgcgaggaataaactgatagcaatgcttcactttcagtgcactgagacctcatgtaaaacaccacgatagcgcctcacagaaaataggatcatatttaagcacgatgaaccaataggataaggttaataacaaagagcacgcttgttacctgttgcagaggcaagagatgaatggttgtctatgaattttctctctcaacaggtgtagctagctattccgaaactcagtttattattgatcaaacgataactttcaaatctagggcaaggagaagaacaatactgaaaatactgaaaataattttcaaatcttgggttagggtttcatggtcaaaagacccatttaacaagcccaatgggcctaattggttggcctggttcgctctctcgctcgcagcttcaccaatcgccatcgcgctctcgctctctctcgtggtcacgccatggcgctggtgtggcgtcctgggaaggaggacgcgcggggggggggggggggtgctcgcgggaggagcaaggtaaggcgagcgccacacccgagccctccacccctgcaggttagcacacaaggtaatttatggtaacaatatcctccccaatgtaccaatgacatggcacgaagtgcggttttaacattgtctaatttccccctaccttcaattctctcaacgctatccattttcagccatctactttatatatattttttatttcttatgcagcacttttgttgtttgaaagcaacatgccatttcatacattcaccaacaatatgtttgccataaaggctgacatagttaccaactgacattttccacattatttcatttttaagataacatatatgaatcatagcttaagcttgagagcgaccaaagtttattcagcaattcagcttccaagctaagacggcacacattgtgatagatggaaagttaaacgtatagaacaccaacattgtttagatgaaacaaatattaatagcaaagactattgctaaatctatatccatagtcggcgaaaatgcatgacagcaatctcgagaaaatggcatccacaattcttcgaaggaagcaaaatgttataacaattatcaaaccaagccatcactgttatacatctgtctagcaagaagccatgatttgtaatacaacccaatagcccaaaattctttgcaaatatatgctaaacagagtataaaaattcatctttgccgattggtgagcaggacttcctcgatgagcctctatgctagtaatgctcgatctttgacatgctacctaggattagattttcggggttggagaaggcgggatagggtaggagggcggtaagggtgggtttagagggatgtctagggcggcttaagaacaatggtcggtggcgacaggctatgtagatgggagggcggcagggtgcttgaattacagggatggtggagggcagtgggaaggatcagtagctagggaaaaggacgtcaacagatttggttgaaaggtagggttggcagaagtggatctggcgctaggagccactggatatgggggatgagtagcagggtgtgggaatcttaccggagctattaaagagggtgatgacacccacacggaggaggagcacaagaagggagggaagcggaggtgtgtgtggatgcgagtcttgccccgctgctaatgcgatgttggtgaggtggaggaggcgttatagatggaggcatggcgtattggattgggcatgatttgcggcaacagactagagtttgaggagaagagatagggttccctgagtttcacgaatcttgatgagatctgaaccaaacaaaaatgaactgatggatagagaaatatcatgcagctattaataggtggcctccaatttagcataccatcataacttctgttaccttttcctatgcggtggcgtgattcagttcgatgcccggaaggagcatatcgttcgacgacaagctctgtgatcgtcatcgccaccgctgacactgacagcaatgcgtccaccactagggcgaggtccttgctatggcggttcttgaggtgcagctttttcagatgcgggaagcccaaggaaaagaggcgagcattgacgaacccctacgtcaaccacggcaggtcctccaggacaagaatggtgagcatgcccaggtacgacagtgacaccgtgggccatttccgcagtgcgagcttcgtcagacgcaactaatccgacggcatgaaccagtagagcttacggatgacatgcggggatggggaagcttgccagagttgttgaagtgggcgacgacagaagcttggaggaggagcaggagaaggtagggaagcggatgtgtatgagattttgagtcttgccacgccgctggcgcgatgatggggaggcggaggaggcagcgtggtgtgttgaattgggcacgatttgcggtggcgaactggagtatgagatcaagagatagggttacctgatttgcatgaatcttgatgatatctgaagcaatcaaagatgaactaattaataggtggcctctaatttagcataccgtccaaacatcagtttccttttcctacgttaatatgtgcttatttacctccttctttgttccaatttgtgtgcacactccattggcatgtgacacactagcgggtgagttagtggttggccatggtagtgagtgagctggtgggcagctgtattgagacatatttaataatttacactaatgtcttctaactccacgcttttgttgaatcctacatgtacaaaagaagttctaatacaaataaggtgaacccactttgagatatacaaaatcacatattttttactcattgggtgattgaaaatgtaaaacacattagttgattctccaactacaggagatgtggcagcaccgtcaaattagtgttcggggtagtaggaaggacgggagagatcgaggagatgaggtcggtccccggtcctcatgccggagggggagggggatcggctaaagctaagggagggataggtctatcatataagcgtcgtaaaaatcttggggaaatactagccataaaaatgttattgacatttaaaaaaaaaatagttgcctactgaagacacaaccaaaaaatgcaaattaggaaaaactgtaactgcaatactatgaagttgaaggtttttatagatgcacgtttaagcaatgcaacttttactctgcatatatcaataaaacaacaagcttaccaataccaatagaacatagggttattgtctcgtgaagagcccaagcttgtataaaatgtgtctcccatttgaccgaaatgtcccaaaggaacacacacaaactggacataggtacacaagtttctgttgtcaagatttttattgatgacatattaatagcaaagtctattgagaaatctccatccatagtcaacgaaaatcatcgaaaatcagcatgactgctgtctcgagaaaatggcatccgcactaattcttagaaagaaatagaatgctacaacaattccgcaaccatcactctgcctcgaacagtgacaccaatgccgatctcgctcatctctccggggccaaccttgtgcgccacctctagacaacaacctgcatggctgattacgaggtggccgcacacatgcttggcgagtgtgagcgtagggttgtcgaggccgagatctgtctccaagccaagatcgatgcacttcagatggagtatgatcttctagccaaagaagtgccaaagaaggagaaagaggaggtgcgccttgagaaaatcatcgttgaggctggtgcccgctttaaggccatccttgttggtattaacatgctacaaagaaggaacgaggaattccttgtcgattcacaacgctacatggatgaagttgaacccaaccttaagtctgcaatcacagtggttgaagtgctctagaatatgtagggtgctacgtgccccacctccagccaacaatgaacatagttgaggctaacgaggtcatcaccactgtgcctgccctagatctccctccaggcctagatttgtaccatcagaaagtggatctcgctatgaaagaagggaaacaacaccaagaaggtcaatatggtgagaatactaatatcaactgttgggaagaggagaaatagatggtctgtaccaaagcgcacggcatagctgtgttccaccatgaaccacggtcagatgttggctattgtggatgagatcatgatccctaccctttatgtggatcttcccttggtcctagatctgctacagcaggaagtcgatctcgctgtggaagaagagcaagagtgcctagaatttctcgattgcaagaatactgacatcaatagcctggaagaaaaggaagagatgatctgcactaatgtgcatggtgtgcctgcattttgccacaaacaactgctaggtgtggccatggccctaaccacagcttgcccccgtcgtggatttgcctccggtcctgcattttcaccaacaagaagtggggctctttgtgcaagaaaggcatgagtgcgggtgtagtcaatgtggcaagaatactaacatcaacaccaacaaaaatgaggtaagctgcaccaatcattcaagttcttctagcaagagaaagatggctgacatggacaacatgaccatcccaccagttttgcgcaagagacctcgttgcatcgacaacttcaagagcaccaaaaaatgagggaggccatgcaagagttcaatcaagccagaaccaaccatgtcaaatgatttcaaatgcattctacaattgcgattgccactatcatccacagttcctgcatccacgaatgtatcattgttggatttaccaattatagccactgtacccccctccagttgtgatctcgttaggtccacacttacttttggaaaccgataatcaagagagaaattggaacaagagatcactatttactgggttgggaagtgttgatcaagaatatggaattgaataggaaagtgctcccttgctaccatcatctatgcaacaaccttcttcttccttggggctatccatgggtggttctcaaatagctacagcacaagtagcaactagttttgcctctgtccccaatatgagcccacccttggttaaagaatcaaaccagggagatatagaaatgcataacgaattatcccatttgcacttgaataatttgatgaaccaactttcttgatgcttggatggaagaaagtggggcccctttatcaattagcaagtacccttctctttggtgctcccatccaacagtaaaagtgcctctctcgtgtcaaaaatggaaaccagcttgtgggagtctcaggaaaatatggttatgagattcatggaaaatgtggagctttgcatgggagctatttgcgctctttatcgccaaaagaagctaatggttgaattgacatgtgaagaacgaactaagtttactacactcaataaaagtcaggcttacaagtatgttaaatattaggtttgaatgctaggaaggaaaattattcatatttttacatattatctgcatacaatcttgagaaaatggtatccacataaattcttagaaggaaacaaaatgttatgtcaactatcaaaccaaaaccattacagttattcatctgtctaacatgcagccatcatctgtaatacaaccccatggtccaaaaaaaaaaacatcgcaacaatatgctaaactgagtttaaacaaattcatcaatctttgcctaaaaaagaacacaaaatgtttctgacaaaagggagtctcataatctatcccagaacaacctcaacgtcctctctgaaccaactccttccacacaggatctgccccttgatgccgatctcctccattctgctccaatggcggcgctctcctcctccaccttcctgctgcctcaccacctcccactcccacagcccatcgtacctaacctccccgtgccggagcagctccacctgccgtagcgccttgcacaccttcaccacttaccttcagggttttcaatttcgaaattagattttatgccggggtgaccaaaatttatcggtaatttcagaaatttctggctgaaattatttgaaaatttgactgaatttgaatgaatttaaataaaatttgaccaaattcacaaaaaattgcaaaaaaccaaaaattttgggtgagatttgagcatgctagtcagctagtgggggcgaaattaccgaaatttcagaaatttcgaaccggaatttcaaaccctgcatacctcacgaatgccacctgccccggcgtcggcccgaagcaggccaccactagctcccctagcttccggtgccggaacatcgccggcggccacatgatctctcgccccggcgccgccgccgcggccggctgatcatcagcggtggcggcgacgtggacgtgcagggactccagggacggcgcggcctgcaggaggaggcgcggccacgagacgtcccaggtgggcggcacatcggcgacgaggagccgcctgaggctgcgcagccgcgtgctgacgcgccacgggaggatccacctctccggcccggtgaaccggacgacgaggctggccatgcgctcgctgcggacgtgccagtcgagcttgtacttgtccggcccggggagagggtgctgggcgtcgtcgacggtgctggagtcgagggagaagctgaggtggactcgccggaggcgcgggacgtccctgaacaggaccaccaccgggttggcgtcgtggatgcacacgccaggtcttccagcgcggcggcgtggttcagctggatgccgaggaacaagcagcgctcgacgacgagctccgtgatcggcgccgccgccgccgccgacgatggcggtggcgcgtccaccaccagggcgaggtccctgcagtggcatttcttgaggtggagcttcttcaggtgcgggaagcccgaggaggagaagaggcgggggtagacgaaaccctgcgtcgacctcggcaggtcctccaggacaagaatggtgagcgcgaccggcatcgtcgacgccagggggacaattcctcagcgtaagcttcgtcagggggtgcagg

SEQ ID NO: 78290 - DNA, 534 bp, Oryza sativa
gacgatgacgaagccgacatcactatggctccctgagctcactgccaaatccgctgggacggcgccacgcgatttttcctctgccgccactgcgtccacagctggaggtggatctggagccatcgctccaagcccctcctcagccgccttctcgtattctcctgccttaggtgtagactgcagagagagatagagcaagggagggatggcttgactgggggagattacatgtgggcccatgctttttttctattttctttgctgactggattgccacattggcgtcacatgtgcaagcttaggtcaaaacaacctaaaatagtgctcaggggggttatttatctggtttgaataattgagggtataaaacgtatggtatttgagttttttttgggggggtaattcaatcgaccgtaatagttcagggggataattcatatttttttcccttaatatatctctatcctctgctattataaaaattgaagatgtttttaccatcagaaaatctagggaacgaagtcccatagacat

SEQ ID NO: 78291 - DNA, 1290 bp, Oryza sativa
  unsure (1)..(1290): unsure at all n locations
tgagattnntttttggcgctctcgtgatggatattttactatcgaaacagcaaaaaattcaaaatccagcggtcgccagctaacttcaaacactaaaacatagtaactgaacaatagctgggctggcgatagctagaagcctagaaccagaggaagaatatgcacgaatcactgaggtcgctgagctgaattccaactcgaaaaccactaaatcagagcgcagaaaaagcgggttcgcccatcgccgaccaccactcctcctcgccacaaatttacccccaaaatcacaaaaactcgcagcaacccaaacctcgagcagctagggctagaattcaaactcccgagagcatccggatcagcggggcgcctcacctgcctggagcccctcgaaatctccgtccacgctccccattcctcgccgcccgggccggcgcacggcggcctcggctcagatcgaggccgccgccggcgagattgggcggattcgagctcgggcggcgccgcctcggggcaatgcgggggctggttttgttgctccgccacgcgtctcgtcgccgtcgtgcgcggtgcgccgccccccggccgtgctttgtgttgtcctctgtgtttcgcttttggttttggtttgggttggtttgtcctctcgcgcaggtcgcgggtttggttgtgntcgcgtgagtttttttttttaatttcgttttcaaaattgaaacttcgcttgcgtgaagtttgctctggtcgncgttaccggcaattcgaattngtttaagaaatagtcgnttttttccattaacgtcacaactactcacatgtatatacactatacactatgataaatccctacacagtacacacgttaagactatatatgacacaagactaaaaaagtaccacgttaaaagagagcacgataagtttgttagtacactaaataagtattgaatgatgttgatgaaagtgaagtgggttgaaagttatggtaaagtgagttgaaaagtgaataaagacaatttattgtactttgcccagataattgggtaacccacaatatnttggtcagatcataacgggggtcaagtgttgataaaaataccttggtgcttagatgaaggaaataaaaaattgttgttttcctttgccttttaacagccgacccccccacaactcttttttttnggccgggatgcagcgatgcgccgnaatttagggggggggaaaaacatgttaagaatcggggcggttttttaacctcgcccggaggaatttctccaacttctttccgccgggttt

SEQ ID NO: 78292 - DNA, 11784 bp, Oryza sativa
tgacacggaagtcgagcgccggaagctcgcgcgggaggcgcgcccagcggcgggacagcgcgtcggtgccgagcgcggagcaggtgccgaggccgcgcatgacgatgagcaggagctcgtcgggcagcgcactgaggcggtcgtcgccctcgctgtgggacgccgcgcgcggcggggcgctccgacgccgacgtcgcggacgaacagccattgtcacggcaacactgacacaagttgccgaacgatttgtatttgaaaaaatatataaaaaagaaaattgccgaaggatttgtatttgaaaaaataataataaaaaagaaagttgccgaaggattccgattcggtctcggactcacgccggagtaagaacaatgtcactaaccaacacagtcacctcaccccggaaatcatcggttttcctgcaattccaaggtcacgacatttgttaggaccaaattgaatttacttgcaaaatacccgtactatttttttacttaagacactaccaggcttttgttaaaattttgtacaatattaaggaaaactatataaatggagttaaaaaaagggtgaacaaattttacaaactttgcaaccattcaagaactgtttgttgcaatgaatctttcatcctacaactatggagaactactttcttgaacaaagcaaatcatgattccacgtctaaccttgtaccttagaaaatacaaccatttgtctccttccagatatgccaacaagaaaaataagaattctgttacccttaattagatatgccaacaagaaaaataagaattctgttacccttaatttgttagcggattaaacaagaacttaaatgtatggtatcactaaacaagcaaaatgtgttactaaccggtgctaaagatgatttttagtctcggtttgtataattgagactaaaaatacccatcataagtcccgcattgtgtgtcccagttacataactggaactacaaagggttgccaaccgggagtaaagtgattatccccagcgatggatcctacgatgatagttgaatatttttgcttgttcaataaccatgtgatttacattgtctaactatagcacacaactaaaagaaattaatgataacatctaaatatcactattttcactactttactactagagaacagagacttataatatcgaaaaatcaatattttcactattttaaatttaaccatatagcatcgaaagttactagtttactttaacaacaccataagttaatttcgttctataatttagccgcttttgctgagtaggcgattgaaataagaaggaatttcaatcacctaggcttggccgttggatcaatggccagggcatcatctacaccattggaccaagggaggcaggaagagaggaaaggaagggaggagggagtttgcttatcgaccggtgatcgggacttccttggcaagcctacgctaccgatgcctaaacaccgacatgctacctatgtattagcgttctagggtaggagggcggttagggtggatttagagggatatttagggtggcttattacctatggttggcggcggtggcctacggagatgggagggcgacgaggcaccggaactgcgggtatggaggagggtggtgggtagggtcggcggtggcagcaaaggatgtcatcagatctagttgaaaggtatggttagtagatctggatttggctgtgtgagccacccgagatgggggatgagagatagggcggggaagcttactgaagttattgaagagggcgacgacatcggcgtggaggagcagcatgggaaggaagggagacggaggggtgtgtgggtgagaatcttggcccgccgctggcacgattttggcgaggtaccacaaatggaggtgtggtgcgttggtgtggggacgatttgcggcggcggggtggagtttgaggagaagagatagggttagggttacctgatttgcacgaatcttgatgagatctgaaccaatgaaaaatgaactaatggtggatagagaaatattaggcaacacattaataggaggcctccaatttagcacacagcccaaacttccgttaccttttcctaggttaatcattccttctttaccacttttctgttccggttcacgagcatgcaccattggcaagtgacacattagtgggtgagttatagaaaatatcacatatttgctactcatcaggtgacgaaaaatgtaaaaaccattagtcgaatatgcccaccatcgatccatgtgtgtgaatcacactctagctgtccttcttgatcaaaatgtcttttccaactataggagatgtggcagaaccactggattagcattcggggggttgtcatgggagatcaaggaggagaggtcggtcggggggatttggctagagctgaagaagacgatgagatgtcgacggatttggcggggattcgggatgagagagggagccgctggtgggcctcgcaaatgcttgccgatgaggggaggtggtggggagggtgtcggcaacctgacagatcaaatgtacaggacaaggaagggatatgtctaggataagtgttgcagaagtctctgagcaaccctagccataaaaaatgtaatttccatttaagcaaaaaaataataatgaatacactacccaagaatgcaaattaggaataaccaaaagtaaaagttataccatgaagttgaaggtttttacatatacaggtttaagtaatgcaacttttgtaggtgattgattagcatagcctcttgttaggcaatggtgtagcctatgtgcttgagatcattgatgtgcatgagaagaggatagatgtggtctagattgcaaaaaaaaaatgtcaaagttttgtaccctggggtgaaagcacacaatgaaactttcacaaagatgctcaaactacaatttactcattaataacaaatataaaacttccatcgaatgagagaaagagtttatttttggattttggcaaaataaataaataaataaatacacacatatccaagtgaattggagtcctgtccacagagaatgtgtgtgttagatgcaaacagcacacatacaagggttgtggaaagatttgagtaattatggccatcaaagtgtaactgacatttataagaaaaaatatatatgcatgataaatacacaatccaaaaacacaaattaggaaacttcgaaagtaaaagttataccatgaagttgtgtggcatcctggcccaattaggaccgacgaggacatcgggtcctttgagggtgtgtgtgttggggggggggagctcctgactcaattaggatgtagcatgtgtggcccataagagctatgtgtacatgtttagtaccacagtgctactttagcaagggtgaccttttaagtaggcctgtccgtcgattgtgttgggctgcacagttatgaagggcgggcggttacaagttgaagctttcttatgtgcaagtttgagttatgtaacttttaagtgattaattagccatatctatcctctccaaagacaaaggtgcaacatgcatgcacacaggtgggaggctcattggcatgcacgaaccattgtactcgaggtcattgatgtgcttgcagttgaggcaatccaaattgccgaaaagggaatctccttcaggagttcgcatcacatagcgggctttggcttctatctatttacggtgtgtttagttcctgaaaaaagttgaaaatttgaagaaagttgagagtttggaaaaaaaaactagaagtttatgtgtgtatgaaagtttttgatgtgatatgatatgatggaaagttgagaatacgtgagaaactaaacacggccttagtggaaggagccatccctatttgtggcaaggagtggatagtccaccaattccaattataatttgccaatgacttgtttcatggctttaatttgagccacacatcgtacgttggaaacaaaaataaccacattatagcaggtcaagcagtggaaaagaagacctctgaccacatgtttgttcaagaataagctggtgactagtaattggattttgactttttcttgcattgttatttaaaaaatttgtacaaatataaaaaaagttgtacataaagtactttagataataaagtaagtcacaaataaaataaataataatttcaatttttttttaaagacgaatggtcaaaaagagcaggcaaaagggaagaaaattatgtaggactgaggtcctaccctcctccgaaagacttggctcctctatgtgacacctgtcccacacgaatctcagagcagcttactccctcgtctctccagttcccattctcttcctttgctcggtgaggcagcgagctcgcgtctgaccagcgagctttagccgtgcgccccctggcgttgagcagcatcaagtccaagctcgcgctgccggcttgccgctagtctgctagaagaactctcatgatttggacgagactgcgctgtcgactcgaatctgctacatgattattcactgattcgatttttcttgcctcatagcgaaattattcaatgatttgatttttcttgccgttgagtttgctctgtatggtgtactgcactgataatcattgctggtgattgacttgaaggatttctttctttttgccgggtgagcattttaggattatagcgttaatttattgatgtttcttctcgacgagcgcctcatgtgagcttggatgctttcacgttactgatatcgtttgattccggcgttagcgacaacctgccgagcttcatgccgctcacccgctggtcggacgcgagctcgccgccttcaccgaggagaggaagagaatggtgaactggagagacgagggagtaagctgctctgagattcgtgtgggacaggtgtcgcatagaggagccaagtccttcggaggagggtaggacctcagtcctacataattttcttccagcaaaaagtgagtagcaaatatcaatctaaaacttccatctaatcagattaacagatttttgttcggacactttgttctcaaaatcgaaatcatagaaatccacgcgagagaattctgttgggaggcatccacgcgaatcggagtcgtccgcacgaagacggagatttggtcctgcactctactctagatcgcaaaaccgcacgtacggaaccccgcggccatggccgcgcccgcgggcaacgtcgagacccctcctcgccgccgcgtgcgccgccgcatcgccgccgccgcggccgatgacggcggcgaggtcgacgacgatggcctcagcgtgctgcccgacgaactgctcctcgtcatcctgggccggctcgacacgcgcacggcgctcgccgccgccgcgctctcgcggcgcctggaccgcctcgcgcgcgagatccccgcgctcgtgttcagcgtccgcgacgtgctcccgccgcgctaccacgcctgcgtccgcgcccacggcgacgccgccggcgcggacgccaggaagctcgacgcggcgatcggccggtgcgagcgccgcgccatccgcgggttcgccgactgcgtcagcgccttcatggagccgcgcgtcgccgtcgccccgcgccgcgccaggagtctccggctcgagttcttcgcggcgcgcagcacgggcttcgtcgaggacctgatcgccatggcggtcggcgcgtggggcgttcaggacctcgacatcaccgtcgtcaagccggcgctggtcgagcagggcccctgctacgccttctgcttccccgaccaccgcctcagcgcggagtcgctccggtcgcgcatccgcagcctcgccgtgtccaactgcttcctcccgccgccgtccgagctccggcactacgccgcgctcaccaagctcgtcctgcaggacacgcacccgcggacgcccctcgccttctaccgccaggtgctcgacgcgtgcccgcggctcagggcgctccacctccgccgctgcggcgcgccgtggtacgccgcgctggtggtcgacgggatgccggagctccgcgagctcgtcgtggacggctgcggcttccacaccgtcgacctgcgcgcggcgccggcgctggagcgcgtggcgtgcgtggacggccccgtcgcgctggccttcggcggcgccccgcgcctcgcccgcctcagcctcacctacgcgctcgacgaccgcctggtgctcgtccggaactggaggctctccggcctcctcggcgacgccccggcgatggcggagctcctcgtccgcttcaccggcgagcccaagtggatgacctcgggaccgctccgctcgccgctgcccggcctccgcaggctcgtcgtcgccgacatgccgtccaactgggacgtgtcgtggccgcgcgtcatcctcgaggcggcgccatgcctcgaggtcctccacatccacgtccaagaagaagaagacgacgccgggacaacggcggcggcggcggcggagataccatggccgccggcggagagcgcgcggcacgagcgcctcgcggagctggcggtggtggggttcgccgagacgcgggggcaggtggggttcgtgaggcacgtggtggaggcgtgcgtggcgctgcggcgcgtcgtgctggtgaggcgcgggcgcgtcgtggtcggcagcgaggggcggtactgggactggaagctggtggcggcggaggcggcggcgccgcgtgagggggaggtgggaggtggcggcggcgacggcgagcgcccgacggcggcggcggagtggagcgaggtggagaagatggtgatacggagccaggtgaagagcgcgtcgaggcctgacgtggaggtgttcattggatgacgtatgctatcacgagtccacaaacactttttggacctagtgccgattgtatgcgtaattgcgtataaagggtgtatatgatattttcacatctaaaatcttaaatcttagggataattgcatatttgcgctcgtttgaagcttatctattaaatgaccctactttcttatagtttgcttatttggctcggcttttcaagaatgaataccctgtctgaccctatttccactacaacgttacggtttcatttttttaaaaaaaatataattattattcgtaatgaccaaactactctcaaaccctatccattccctccccctctctcgtattccggttgaggtggcggcgcacggaggggacgagccggcacggccactcatggagggaggtagcggctgcggcggagggaccggacccgcggcaacgcgtgtgcggaggaggctgcgggtgcagagaaaggagcggcgacgacggcggtggtggcctctctcccacgtgctggtgacctccggcgcggcacagggcaccattccctccctccatgggcgcgtcgtcaccgctcgtcctttgtgcgctggcctgcttcctccgcacacgtgatgccgctgcccaccctccacacatcgacgagctccttcgccacacagggcgctgcttcctcccttcccgcgccccggcctccgtcttcctctgtttgagccccgccgccgggtcggccgcgacgacgacgacgccgtggcaaagaggatgggtggttgacaaatccaaaattttgttatattttatttatatttttataaaatagagtcaaataagcaagggtagaaggggcaatttttgctccgattaaaactgttacatgctcttaatggaatagggtcagattgtatcttcaattttgagaaaaatggtcaaataagcaaagttgaaagaagatagtcaaattggtagttagtcctcaaaacatggtcaaatgcacaattgccccaaaatcttattattgtgtgtgaggcaaaggtccgattggttggtaactaagagcatcaccaacagattatctataattttctcctaaaaatttggttttgggtttcttaaactaaaaatagaagtgaaaaaactcctccctccaacagatagcctaaattaaatccccaaaacttaaaaagtgggcccttctgttaaactactaacataaaattccgtttttttcttttatgtgcagaaagatcgctatctcccacgctcgggaacggaggagagaggcgggattgcgagattgggagcgacttccgcgcccgcatataaacggagcaaggaatggggagaagggaactccaaaactcgggtaggagagtaggggatctgttggagttgtttttttttttttttgactaaaatccctcaaaattagttttagaaatcatataggtagattgttggtgatgctctaagggtgggttttgatgggaggttttggatggataggacatgacgacccttttttttattgtttattacctctctcctaaaataaatttatttttcacccatctcacacataccaaaagactaaaatactcatattttttttccaatctcaatacaattatttttcactttatctacttccaatataattattctttgttttcacaaatttcaatgcaataattacttaaaaattaaatttattttaagacaaatgagatgagtaaaaaaacttaatatgaataggaggaaataatttatattccaacctttgcttcaaccatactccagttgtaccaaatttcagatctcactgtccatcgctgcccgaagacaaatcgtgtccacggcggaatcacaaagcccccgatcggacggccgataaatcgccggcgatttgatccgacggctggtaaatgctcaagcgcgactcatctccccccaaccttctcaacccacgaggtgggatctcacggcctcatcggcgggcgagatgaacgccttcaggctcgccggggacatgacgcacatcatgagcgtcctcgtcctcctgctcaagatccacaccatcaagtcttgcgctggtgagtgactgatcagccgactggcgcctgcttaagatgcatttttttttactgtattgagtcctggattggttgccagcagctcaagaaaggtagagttctggatcttgggggggaataggggacgctagcacaatgctgtttagtgagggctaagattggtggtgcttgtggatggattctgaggctttagagactggaagtttagagggtttgaggaaattaatcttggctttttggatgcaattggaatggttaagatgtaggtttggtagttgtacatttgaggctggatcctggaggaaatgttggatcttggcttgctctggtaacggcggtggcgttgcataagggcctatgctttttggaagatttcagtgatattgccactccattgttttgctaaaattagagattggtaggttagattctcctattatttttgccttcccccatcttttttctaacaatactgattgattgttagattctctggaaaatttgaggacaatgttgtgttgtctatgttttgtaacgcacttttgtcgacttattgattgttattgtgttaaaaccagagtggtatcatatatggggacctgtcctggtcatttgcatttgtgtttcttaaggatcccatgtacagaaaattttcatgtcctggttcaatcatatctgtccccaaggggccacatgacataaaattttcatatcctggttttttgttgtgaaatgatagatcaggtatatgcggatttatcacatggaacggtaaaggtattgaacttgtcatgtatccattggcatttttttcatttttgctactcaaaactttttatatatgtttcataatttgaaggaactaaacttgtaatagtttgtccattaaagaagcctttttgctggtcactactcactattcagacccgatttaactgcttgcacatcatgggtgtcatgtttgtggttcgtatgtaagaggccctcagaattactgcagtgctgtaccacttttaaattatgctagcgtgtgtcagcatgcggccaagtaatttacgaattgtattcatagaaccagaacattgaatggctaagattatgtgttgctcagaatttaataataacgagttggtgaattccaataatgtggttgctctcataagtgcagcaaataccatcattcctgtaattttcaatttttcccttgtagacacattagattttggaggatgcttgttttgaacaatgtctgtatcactcactcaagaagtatcatgaacataaaatcaatttttaatttcttttttcttgtaggtgtttccttgaaaacacaggagctatatgctcttgttttcgccactcgctacttggacatatttacagactttatatccctatacaatacagtcatgaagatgattttcctgggtagctcattctcaattgtttggtatataaggcgccacaagatggtcgcagatcatatgataaggatcacgatacatttcgacatcaatttcttgttctaccatgttttcttttggccttgcttatacatgagaagttcacttttagggaggtacttcatcaaatcaacttcttgaagttgagaaaatataagcttccaatgataatttatctcagcttttaggtctgaattgatatattcccctttagttttattacttctataagttatgaccaaacttttttggggtttatccgaattaggtgatgtggacgttttccatttatctggaggctgttgcaattcttcctcaacttgtactactacagcgtacacggaacgttgataatttaacagggcaatatgtgttcttcctagggtaagttttgaatatggataccattttcttttgagaaaacacaactttcaatattttctgatccatctctgaagcggttaaaccccaattgttgcttgtgtcttgttgatgttagttgtgctcaaaatatagtccacatttaatcaatgagcacataatctttcatcttaattattctttcaggctcctaagttcaacatagtcgagcactgatcattttgcattatcatgttaagttttttgtttaccctttccaatgatttagctgtttttcttccatggataataagatgcatatgcaacgttatcagttagaaattttcaaatgatgtacaccataatgtattccattgtcatctatttaaataagggcatgtgttgttaaagatatttcagacttgaatgatgtgtctaatgtctactgtttttttagtcaatgagaaacatggtcattggaaatagattcataccaaatatggtttcagtaagacaaaatcctaaaattaatcagcattgtatcaacatggtgactatgttgcaaagtaaccatttttttccaggttcagagaacttctgtggagaacatgcgatgtaacatgaaactgtccccttttgtcattaccgtaatttgtttctccattcatctttttggtcagtttgattgatggaatcaattgtccctatttgtgcttctactccacatgctagtgcttgcaaggattttcttttttgacatttgacttgtatatcatcacattgtccttgttagaggtaaccaggccagaaattcagaaacatgtacacattataagtttacgcagtggactttatccatttcattttcagattctatgcaccattattctccattggaagtcagtatgttctttagttagaaatcttgacgttttcattttcgcattgattgacatgatgcagcgcataccgagcattatacatcctcaactgggcctaccgctacttcactgagccacactatgtgcattggataagtatgtcata

SEQ ID NO: 78293 - DNA, 4082 bp, Oryza sativa
ttcattgtagcaaaaaaaatcataatcatataaaattaaatttaaatgaatatccaatgatattatttttaacaactaaaatttaatttataataaaatacagctttgaaagaaggcaccacgttcgctgtggaggctagaaattcccacattaatcggagaaaaagaaaaaaacgaaaaggagagtccaagtagaaatacaatctaaaaatagctgaaattcagaattaaaaataagcaatactgaaagaagtttctatataagaacccaatacaaaattaatcaaaattcaaaataaaaataaaataaaatccaaaattagaaagaaaaaaagagacccaagtagaaattttttttaaaatagctgaaattcgaaattaaaaataagtaatattgaaagaagtttccatataagaacccaatacaagattaatcaaaattcaaaataaaactaaaataaaataaaaattagaaaataaaaggatagtccaagtaggaatacaattttaaaatagctgaaaatcggaattaaaataaggaatattaaaaaaagagtccatataagaacccaattacgagattaattaaatttgggaataaaaaaataaaatccgaaattagcaaaaaaaagaagagttcaagtaggaatacaatttaaaattagctgaaatttggaattaaaaataaacaatattaaaataaaaatccatataataacccaatacgagattaattaaaattcagaataaaaaataaaataatattcaaatttagaaaaattaaaagagagttcaagtaggaatacaattttgaaacaactgaaattgaaaataaaaaattaaaataaaaatactaaaagaacacaatacgataataattaaaatttgaaaaaaataaattctgaaattagaaaaagaaaaataagattttaattgaatacaatttataaataactaaaatttgtgataaaaataaagactattgaaagaaagaccatctaaaacacatgacgagataaattaagtaacaggcctataaaggagtagagtggtggcggttgatacgacatataaaaactattaataaaacaccaaatagaatcctaatgacgattaaaaggagggacgataggcaggccatgaagcaaatgagcaatgcgattgccgggactactagaaagtaaaaaaaaaccccattgataatcatattcaatttttaaaatctcaatgacaataaaaaggagaagcagtgggcggggtgtatagtagtatagtttcagagccgctgatgtttgacgtgacttctagaaaataaaaaatgaattccaacgatagttatgctcaatttttagaatcacaatgataataaagaaagagtaggcggcggacgggccataaaggagcatagtggcatcgtttgacgagacttctaaaaaaatataaaaaatgaaacccaacaagacaataaactctaaaaactataaggttcaatttttaaaggttccgaacttcgaaaaagtaaaaaaaaacaatgataatcatgttcgattttaaaatctcaatgaaaataaagaagggacgcagcgagcgagccgtagagaagtacaatggcaaagccgttgacggtttggcgggatttctagaaagtaaaaatgaaccaaaacgataattatgttcgatttttaaaatctcaatgacataaagaaaagagacagtggacgggccatagaggaatataatggcaacgtttgacgggacgtctagaaattataaaaacgaaacccaacgtgacaataaactctaaaaactataagatccaatttttaaaggtttcaaggagaatgaatagaaatagtggtagatcgagcaagcaaataaagaaggagatgtcataaggggtagcaactggtgtgacttttaaaatatatataattagaaacacggggatgataaggtttaatctttcaaactcttaagacatgagatagctatttaataaattttaagtaaaatcatactaaaaaaatatatgattttatttgggtgctagccgcgcaattgcgcgggccacccagctagtttaaatgatgggaagaaaattacgattagttaataagagaaagtggctgaagataataacttaaataatttgtgattgtttgagaggatgtggtaagtagagaaatagttctattttaggacaagacaccgataaaaaaatagctatatactacctctatttcaaaataattataattatatttctatgtttagattgtgtttgagacttgaacaaagagaagaaaagatcattgctttttgtgttcacgcttcacaaattattaaatggtgtattttttgaaaaaaaaattctatggaaaatttgctttaaaaatcatatttatccttttcaagttaaaaaataatcaatacttaatttattacttcgttcgtttcaggttataagactttctagcattgtccatattcatatagatattaatgaatctagacacacatatatgtctagaatcattaacatatatatgaatgtgggcaatgctagaaagtcttgtaacctaaaacggaggtactatgtactaatagcttatctagttttgcatatcttcttaatcttctttattcctcatttctcaaacatagctgtggagaaatgctatgggaaaaaaatgatgtatagccaaaaatgagagggtggttgaggataaaattgaaaaaaaaataaataagaaatgattgatggaacaattactactttattatgataactttttaaaagataataaccgtttattatgacggaggtagtaaaaaatttaggatgaatgtagcaccgcagtttgcaatcgccaaaaaacgagcgtgatcaaactgtggggctttgcttatgtcagggcgctttgtttatcaactaagcgtgattagggtggacctgtattttgggattctttgaagcgatgcgatgcgatcaggtggtgtagtgtcaactcaaggcccatcacgatatgcaaaatgtgattttattagtataaccagtagctaagctatcaatgtccgttcagagattctagcatgggcttttattaggttacgcttggatgtcagagttgaattgggttggtgtggacatggaggtccaatcagggttgtggaaaaccacgaaattttgaggtttcgatgtggaacggaagtagattttgagtgaaattttaaatagtttttgagaatttaaattgaaacagtaaaagttttgactaaaatttaatgaaagtttgttaaaaaaatgtcataccactagtgccgtgtttagttgttttggcaaaaaaaaatgacgtatacggacacacatttgaagtattaaacatagactaataacaaaacgaattgtagattccgcctgtaaactgcgagacgaatctattaagcctaattaatacatcattagcaaatgtttactgtagcaccacattgtcaaatcatagcataattaggctcaaaagattcgtctcgcaatttcaatgcaaaccgtgcaattggtttttttcgtccacatttaatgctccatgcatgtgtccaaatatttaatgtgatggaaaaattggaagtttgaaggaaactaaacacagcttaggttgggttccggcactcattaaaaagatgaaccctaggtctaattcaataacaattataattggtacaatatttggctcgaattcaaatttaataagatgaaaatattgtttttgatgaaaaaagttactactagatcgctagcaaattccaacaatattacttaccaaattttgctgtactctatctctaaggaaaagaataacttataagggcgaatctagacaattgttcatattcgcacatagaagttgtttctttaattgtacaagtatatgatttcacatatatgatttccgggagtttctccacatctattaacatcttccacaagctaatgttccaaactcatcgcgttgtgcctttttcccttttctccatatgtatatcatgaattgacaattattttctggaagcataataattaagaa

SEQ ID NO: 78294 - DNA, 12770 bp, Oryza sativa
attgacaactcaactaatgattgtaacttttggtgttgtatcatctgaaatgtgggtggcttggcatgtccaaccagaaaaaacaaagatcaggaaaaaaattgttttcatacagttctgagaggtgtgacaatagaacagtgcagtagcatatgttgaaattgtggtgtgctccattatgaggaaaccgcagatgtctatgttgtacatttgaaaatcttgtagacgatacactgtaaattaaagagataattgcccattgcactatggagatgaatattactctgggtgatcagttgtttgtcaagagaaccttgaaacttttaagacagtatatgtgactctttctacagcattgccatgagctgctattgttaaactctttgtcatcattttgatcagcctaaaatttaaatcgtaaaatccaagactttctagagcaatgtgatgtgcatgtttagtttgaagagatcctatagtgacagttcacaaaaatcatatatgcaattgttggagctgtgacttgtaagtagcatccaattttgaaatgttgtttgaataaattcaggactttgttttttgtcacttctgccactttaactttagcttttggaccactaacaaaagaagtataaaagtattttacctttgaaattgctttcgttgtttatgtccagggttgacaaatatgatagtaaatcacttaattattgtggttataggacatagagttggcatgaatttcgaaaccgttcgaggccaaatttattcaaattaaaatccaaatatttggcaaaaattgtttgaattttaccatagccgaacggtaatagttgtaaccaataaaactgctcgggagcgttgttccgtgagtgaacgattttgtgatccttgctttggtcatgtatgatgtatctctggcttatgcgccattaagaaaaaaaacttccaagcaagtttaataatataaccaattactagcttcaaaaaattgaaacattatctatagccacctaatatcccactcatataatagtcagttatagatatatattgcatcattaaaaccaaatccactcatttctcacaaactttattagaggtcgtgctatagctggctacaaatctataatctattttttcttctctttgctctccgctcttctccacataagaacatatgtgatgtattaacttgtgcagcccacttacaccacaaaagaacaaatgtcaacttgtacaacatgcttatatcgccttattgtactcgctataatgagttgtctttagtagttcgtatgaatccaagtcagcatgaactccctaccacaaatatacaaaatagcagcttcataaaagacaaaactacaaaaaatccagcatgtacctttttttttacagccaccaagaaaagatgaacctacccgactctctcaattaacgcatgacccatcaaccaaaacaagggttaagccgaaggagaagggcgtcgctgccccctccccccttcctccaacatgcaacttactactacgtgctattaatatctaacctatctaatcatcaattatgtaaaagaaaatgggtctaacaatatactccctccgtttcatattatattataagtcgtttgacttttttctagtcaaaatttattaagtttgaccaagtttatagaaaaattaagtaacatataaaatatcaaattagtttaattaaatctaccattgaaatattttgataatatatttgttttgtattgaaatactattatattttttagaaacttggtcaaacttgaagaagtttgactagaaaaaaattgtcaaacgaattataatatgaaacggagggagacatcactatgtggctaatatttcaatttcaaatctctgaaatactagcacttgtaatttctttgttcattttgtctttttttgtctatttatttgtctatttatctagatttttagctcagatgattttatcatcgtttataatttatttgctcattgcttataaagctgaattgaaataaataaatatgttacaaattatagctacatgataagcctatatattatattatcattttttatgttgatatgatatattacctatgaaaaatcttaaaatttgtgtatatttttatactactttttttattgtaatcacttattaagttgaaccccctcatactgagatcctggcttcaccattgaacctaaacacatcatttaatttcatatcaacccatcgtccaatgaaacctaattcttggcctcattggattaactccatccatcctgtcccaagttagtactacttaccaccctttatcagttgtgagaaacctcaatggtcacggtttcccttctcaataaaatcatatatgcaattttgtttgagcaaagttttgttgttcgtgtctaggattaacaaatatgatagtaaatcacttaattattgtggttatatggcttaggctgtgttcgggaggaggtgttgggaacttctctccttggcacggaaaacgagatagccgattagctcctgattaattaagtattagctaaaaattgaaaaatagattaatatgatattttaaagcaactttcctatagatattcttttgttaaaaaacatattgtttaatagttcaagaagcgtgcatgtgtaaaacaagagagtaaaagatgagaacttgtagttctgaagacagccttggagttggtagaaacagttacataaaagtttattcaaatcaaaattaaaatctttagcataatatgattgaatcttatcatgatcaaacggtaataattattttccaaaataatgctcaagagtgttgtcacatgaccgattggttttatacacatgtcttttgcttatgtgacattaaaagaaatgagttgcctttagtagcatcgtaccaatccaagtcaggatgaactccgtaccacaaagtgacaaaaatagcagctccatataaaaaaaaaggcaacaaatcggtgggtactctttcggacagccacccataaaagatgatcttattcttattactccactatctcaattaacgtgtgacccatcaacccgaccgcatcgcataaactcatatcaatatccactccctagttctcggccttatcagattaactccaaacatatccatcgatcaatccatcctcctccaagtttagcatagtatttaccactgcccccacaccccctccatccatagcatcaaaatccaaccctagccagtcacaccccttccaaaacaagaaataaacacaccccaaacacgcagttgacaaaatcaacactccctccaacaagagattcaataatttaacactcatttaaaatgataatcgattattcaacatcctagcccgctttcattcacctaaatggtcccacgtatcatcgtcacaagcgccaattaaagcaaaattgaccacgaaaaaaatgtgtcaaatttctcatctgtgtcacccaaggccgtgtgaaaaatctcggattgggttatttaagggctaagttctctatttgataggctaagtttctaatttaaaaaggttacatatatccggttagatataaagaccggataaaaatacccttctctaaaaaaagcctaggtgaaaaatggtgtgggttaagctggaccttcgccagtttggcaccatggctgtggctgggctgggattggaatttggaaaggccatcaaggccttccttactttaaaaaaaaaaacgtgtagagagagaaaatcagacggatgagggggagagagggagagagagagtagcggtttgagcacgcggcggcacggagacccacgagagagagagagagagaaggtggcaacggccctctcgcccggaaaccagcccacccacaccaacacactcacactgccctgccctatcgcaatttccatttccatctctcctcctctcctcctccacctcgtcctacaaatgcggcgcaggacgagagtcagagcggagtagtagcagacgaacacgacgacatcggagcgctcttgtctcctcctcgtttcttctgctcccgagtcaagcagatcctccaagcccagcgagggggcgggcgcgccgccgctgccgttgttgttgtcggccgcagcgcagacatggacccgtccggcggcggcggcggagtcggagtcggaggcatcggcggcggtgaacaaatgtgggtgcggggtttacgtcttcgggggttgctttgcggggctggtttggtttggtcgtcgagacggcggccatggggaggggggggaactggaatccgcgagtgtttatcgcctccttttgggggatggagaagtcttgtggttgtggcgatttggtgtttagagttttggtagatttggggggggggggggtgatcgcctgatcgggtctgggtgattcgtgtatgttagtgtgtgtgtgtttcttttttttaattttaatatcacttgctgaatatgttattcgtatgacgatttagttgctcttgttggaaatggcttaaaaaccgtgggtatttaggttgatgcggctgggaaatgctaggatactaggaggaggaggacatgactgtccttagatttgtgtgttagattggaaatgtttcacttcaatttttgggctcaaggggtttgggaataaatggacacatactgtctttgcaatgccgtgtcggtgataatcaattccggtttaggagtctgccgtagcacgaagtgataacatttattatgatctatgtagaaactataaggaagaactcattatgattcaagctgtatcctgtttcgactgtccgcggaactgattactgtctaaaaatggcacgctatttcgccgtgttactttgattgcatgtctgatcttgtaatgcttactgcagtctttgggactggcaagcggcggagcagtgcgagagcaatgctgcaaatcatggtacatcactcaaaatccataaatcataatagcatctttacacagattcggagcatctgtttcgagtttccacttactatttgattgtttctttttacattagatgtttctagattcatgtgggactgcctcaatcaagatgatgatgacctactgggattgctgggcaatcaaactcctctaagagattgtcgcggcttctttgatattgatggtaggtagtttcttgttcttaccaccatcaattgttattcctctggaatgtttgcttaaatggagatgttactcgagtcagatttcacctgcaaggagacgttggacctagaggaatctcgggaatcaaagcgccgccgcatattggagtacccttctgagtctaatcaatcagaagatggaaatcgtgaaataagttctaccttgggcacatctgaggtaattcactagcacctagatatcttccaagttagtgcattgtgctcttgtttacacttcttacttcttttcctgatccatgtcttaggtatcagaaatttcattgctttgcaccgatgaaccgcagagcttcaattgggattcacagaacaattcaaataattttggtttgtcttttgtttttcatattatattgtttgacaacttaaattgctatgccttttttgttagctaactgaaaatagtggcatctgatacaatagattctttgtcaactggagcattctaccaaccatcaaatagtcattcgaaaaattgctctgatgaaaatcaaatgcatttcaggcatgaccaaatgttagctactctctgttcccacagaaaacagtatttactttatcattatatttcaatgatgacatgttaagcttggattcatttttaggcattctagccaggagagcgttacatataccaatgatcaaagtggtatttcaggtcagtgcaaagtgtacgtctacagcgttgtttaagtcaaattttcatttgtttttaaaacatggcttgtaatctatgcatgagcatcccatctcatcactgtttgtccttacgtccccatgcgagatatctgtagagaacatttttgtttgctgttttccttcgatgcaatgccatgttttcagtcactgcaaaattctatactgattgacggacatacagtttgagtgcctcgctgaaactaagattttgtagttttggcaggaaacttaccagttctttctatctataacaggaacaactgagaatgattcagtgacagaaagtcttctaatgcaggagactaggaagctttctacacttaaagtatctaaaggtattttcagtttgacagtatcttatcatgtcatcaacatttcttactttgagttttgtctatgctgatcatttgtctctgctgctatactaggaacctcactggttaaggcgaagcagaatttaactacaactatagcatacccttttaccctcatcaaaccatcctgggaggaaggagatgtcatcactctaaaggatataaatcagcgaatccgtgctcctccgaagaaggctccagaaaccctagggacttcagccttctctggcaagccagtcattggcaagacaaggatcagaactgacgggggcagaggcagcatcacgatactaagaacaaaaggttgagagtccaaacaacaagtttctcagccattacctggattgctttcagcaatttgatctccacagctctccagtttttttttttttggccatggatttggtatttaggatgactatcaatggctaactcttcaaagatttaccattcatcctgtgtacattagcggcatgcggctaatgttaaatatatgagagttttgtgttcagaaaccatgtccctctactcatctaacttatgttggatgttgttcagggttttctcccatttttctgaatagttgtccattctcaaatggacgcgtgtaatcgggaaacatttgattattttgttgcttacaatatatagcacagatacaggtgagtttatatacgattgcatccagtactgcattttgtatacatcctggtaacaagaagaatatgagatatccgaattcctactattgtatcagattcctctcattccttgacgcagcggtcaatcggatggaacatgaaacacatcttaaattttgatctcctgtagcggcactatgatccaagtgaaattcttggcacagaagctagtagttgatgattgtcatcatctcttactcggatagagaacccagtagttgatgattgtcatctcttactcggatagagaaccaggagttttcgtgaaggtgtcgacattctaggatagagagggcagaagaactcgaacatcggcctctcctctataaattattaagtaaataccgatcttgaattgagttctgatggataggttgcaatggcgaaataacaatagataatacttgctatctcttgcaagatcatgagtctatgatcatgtcatcgtttataaatgacgctagttttatcgaacacgcaagaaaaaaaggtttaaacataagatccccactactgtggtgccaaaaaaaaaagaaaggagaaaaccataagaatactcaagattaaagaggacgcgaccacagacaccaaaacaactctagccacccgctacctctagctaagccaagcccctaactcttgctatatactaaaaaaaaccctttctctgaaatccaactacacgcaaggagaggattcgttaaacacacaatttttttgtgtatgcttccaaagtaatgagaaaattcaggccatgcttgagcacctttggaataatagaattgacctttatccaccatttacaaaaataactatcctttggtcgtgatggaagatctgcacaaccataacggctaaagaggagataccaaacttgtcatgagaagacaacctatcaaaatttgctgaatggccttctcctcttgatcacacatcgaccctatttgcgagatttgatagtgtggcatccttttggaccgaaaattgataagtagacttattaggaggttgatttctaattcaatataaattgaaggatatataatcgaacttcacacattttatttttataagtcattgtattttttaaaacaatatttcagattaatcatacaattagtgtttttaaaaaataaattccagtataaatgaaaccatataatataattagtttagaaaaatcataaattctagtataaatgaaatgatacaagcaaaatataataattaacaaataactatttttctcacaataactaatttcctacaccatatacaacgttttctctttttttatcatcacaaattgttttcttccttttttttacaccaattgttttttttctagtagatggcaatccggtgctccttgtctgaactctctcaatctcaacttctcaagtggcaactcttaacccccttcaggtgtcaaaaaaaaaaaaaaaacctctcaagtctcaaccccttcaatcccagccgccaattttaggatccaacggctcctagatagcgtacggcaccacccgtaaaccgtgaacaaacccagcccgggacacaatctgcgccgcacatcaaaatcgggctcgagtcgacacacgagcgaatctgacctaaaccctagctcgcctcctcctcctcctcctcgccgccgccgccgccgccgtcgccgtcgagcaccacccgagcagccatggcgaatcgtaagcgagacgaagaaccgccctaccctctccctctcttgtgtcctgctccgcttccgactctgggggcgaatgggtggtttgtttaattggttcggtttggtttggtttgcagcggcagcagcagcagggccgtcggggggagcgaggtcgttcctgcaggccgtgtcgaccgtcaccgaggaggcgccgtcgccgctccgcgtcgtgcagatggagggcctggtgattatttttcttctcccctcccgttttgtcccttggtagaattcgaagcgcgtccgctatgctagcatgtttgttttgggcgacttgcgcttgggatgaagtaaggataagctcttgatttcgggaggatctgtttgtgtgatgaaacgcccgcagtgtgcgatttctcttcacccaaatgtgttgtttagctctttagatcgaggtaattacatgctttgccgtgtaattagatcggggtcctttggctctggaactggagggatttggtgaggttattacgaatatagttgtcccttttacaatgttttcttctacacatgatttgaaagtgatcggaagacttcctatcttaattaattacattgaatgacctccttcggtcattccggcaaaaaagaaagtgatcatctgcattgtgattgttgagaagaagtgtaggagaaactagggagagcagagggtgggagaaaattcttgcttgattcgcagcgcaataggagcctccaagagtgctctagtggagcacaaccatattgcacgacacacatgttgcttttagtcatgtacttatgttgaccatactctactagatcaaatttgctgcacctttacattggatgattttctgagggccagccgcatttttcttttgccctgtgtttgaataggcatgtttaggtatagtactcttatatttccactcacaaatttctctctctctctctctcaatcatgcaggctgtcctgaagatcattaagcactgtgaggagtttgcacctgctctagttacaggccaactgcttggtttggatgttggcagtgttctggaagtaacgaactgttttcctttcccagtgagtatttaacatctataacatatttcttttaatatgacttgagtattcttgtggttgtttagtttatagattaacagctactttaatatttgaccacagatgagagaagatgatgaagaggcagatgcagatggtgcaaattatcagcttgagatgatgaggtgcttgagggaggttaatgttgacaataacactgttggatggtatgataagacatttcattcaatacctattgctgttgttccatatgataattaacctctgccgcgtgcttctgcgagcagcctttgagtttacacgtgttacaactctgtttttgtagtctttgatcctctgcctttaatttatatgtgcataaatagttcattcgtatttctttgttctgaccgtttgttcattattatatttttggaatgttgctaacatctttggctgtagttaataatgcaggcaaactaaattgagatatgctcatttgtcaacatagtttagtgatgctgttgagtatgtgacactgaaaagtgagaacaaaataaatgtggaattttgcctctatgcatacatgtatagaaatgttgtttgtgtcatgtattcaccttgtctctgtttaaaatcaatggtgctctgcttgtttgcttggactgattattttatctaatcctcttttggaaacacttcatgagagtgttaaatttcttattgcatgaagcaaccaaacatcatcaagcttctggtagcaacctttagttatcgtgtatgtggttaacattgaccttaaagtggctggttttgtgcttactcgatgtattttccagtcttttgcagttgcattaacgacatattaacctgtgttgcattctagctgtttcatgcctcgttcaaaatatttgctatatttttaactccaataatgactaattatccaacgtatttcatcttgagcttaagtgatgtgtcctattatttgtattatttatgttgtggttttaagttttaacctccattcttgttgtacttgtttaacagattttgcacatacaactatcataatcatccaacaaagctgtagcctgttctgcttcatgttttgacccttttttttcccatgcctgtgtacaggtatcaatcttgcttgcttggatcttttcagactgtggaactgattgaaacgtttatgaactatcaggtatgcaaaaataaataaggtgcaattgatcaatctttccattgctgttgggttatcctctcccagctttgttgacctactgcagtaatagttttaggccaacttgcgcattaattagctcaaaatagctagcacagcatgaacaaacaaataggacagcaaacagtgcacctaattagcttctctaattagcatgtaacctattttgacacgaatcaaggttaagtctctgtatgcattacaatatctaacctgtttgtacatccaatgtagtatacgcagcagtacatgcatatcatatatcaaatatctatgagttggtcataagagttgcgtaattttctgcgatgttgcatgcagaacataacatttgcatgttacaggagaatatccggagatgtgtgtgcatcgtttatgacccatctaggtcaaatcagggggttctagctctcaaggccttgaaactcacagattcattcatggatctttaccgtaacaatggtttaactggagagaagtacggtttcttttatgtaacccagtccttctaatagtttttaaagattgcatatgcaaatgactacatgtttttacaggttaagagagaagaaattgtcatgggttgatatttttgaggagataccggtatgtacttagttatctttcatgtcaatatgtacaatttttgtgtcctgatgtatcctgtcttattgtctcatagattaaagtttccaactctgcacttgtcagtgccttcatgacggagctggaacctgaatcacctgtttcacaggtttagagttaacttgtgaattttttttatgtggcatctgttgtcatcatcctttagcagctacctaggatttatatttatcttcttgttacagtgtgattttgaccgccttaaattgtcaactgctccattcatggaaaggaacttggaatttctgattggctgcatggatgatctttcatcagagcagaacaaggttattttttgaaatgaacttttgcataaactatctgatgttactgtgacaaatatattttatatgactgggtgttgtccttctggtgtagttccaatattactatcgcaatgtctcaagacagcagtcacagcagcaggcatggctccaaaagagaaggtcaaaacaactgcttgtccattgtgatattgatcagttcattagctcttggaatgtgccaactttttaaacaagcgcactcttcctctcggaaataagcaaagcaggtgctgctatgaatatggcaatttacgtctcatattttttttgctactgacatgctgcaggcaagagaatatggcaagaaaagctgctggagaggagccattgccagaagaagacccatccaatcccattttcaagccgattcctgagccgtcacgtttggagggttatcttgtaaccaatcagatctccagttactgcaaccatattaatgggtatggattctcgcaagtttatgcctattctctaggagttccataatgcctgtgtcttttcgtcaggaatgaaccattagatgtagaaattttactgtgattattatggtcgtacagatgcatgtctcatgattgaactagtaacatgcaaaagtattaaatatacaatgttgttagcatgtagtggtgtagtctgatacacaaaatgttcctttttgaatgatccatttaattatggcaatggttacggtgaagtaaatatggcaaaatttctcttctggctcttgtttccgtcgta

SEQ ID NO: 78295 - DNA, 2394 bp, Oryza sativa
  unsure (1)..(2394): unsure at all n locations
tagtggnnttgttggcgctgtcgtgtgatggataatatcgcatatcgaacggatccaagaacacggagacaatggcgacctagatccccaaatcaatcgccatcaaatcagatccaatccgagaacgggtgggtacaggagcgaatacctcggcggcgaggtactcgaggacggcggcgaggtagacgggagcgccggcgccgacgcgctcggcgtacttgccggccttgaggaacctggcgatcctcccgacggggaactgcagcccggccttggagctcctcgacgtcgccttcttcgcggccccggcgccgatcgccttcccgcgtcccgccatcctataccccacccaccgacgagagaagaaaccggctgcgcgagcgagatcgacgcggcggcggaggcggaggaagcgcgcggcgaggcgaggggaggcggcggatgagacgatgttagtggtcgggggcgagagagagatatatatatagggttggttttgggtggtgggtgcgggtggctagccaatgggaggcgatcacgcggatcgtggacgtgggccgtcggatgcgatgggacggacggcggaggatgcgcgtcggggatttcggtggatccggaagcggcgggaagacgggcggagttttcggtttgggagggagggagggaggtgcgcgcgaagacggagacggcggatcggtgacgtggctctctggttttcgtgtcggacccactggtcgatctctcgtcgtggttcgagttttgtatgctgtggcaaattggcaaatagggagacagggagggacgtgaaggagagtatgcaacggcgcaaacgcgtagtagaaagcaatgagggagtagctattttcggcgtagatttattttttttcacgtaccgtttgtcttaaataagtacaactattatccatttaatttaataatttcatctatttttttcttttttcaacatattatataaccccatgctacagagtagtccaacaaggttgtataattcagtgtataaagtggagatacaaagtctagaggtgagactctcttgtcttattcaatccattcaccaagtgtacaaatgactggcccctcctctttttatataatgcattcgcaaatatgcaaggttcggtgatgggtccaattagtgtatttagactaggccttcatggactcccccttgacactcaccgtgtgatgtctatgccctattaaagcttcaaaaaaacccagtcggataaattggagaaatagtacatagcgtacgcatatactccctccgtactcgtaaaggaagtcgtttagtacaatgtttaagtcaaaccttaagaatataaatcatgaataactctcaagttattgagtttgaaaatgtaaaaattatatcgatagatttatcttgaaaaataccttcataaaagtatacatatatcacttttcaataaatatttttatagaaacaagaagtcaaagttgtgttctatacaccatgtcgctgtctaaaacgatttcctttacgagtacgaagggagtatgtcgcacgaattgcctcattaaaacccttaataagaaactagaggaaaacttgtcacaccctaaaaatcctaaatatataaattgttgtttaattggaattattagaatttattttaaaaagcctagaagagaagatctagttttaattaataaattccaatataaaatgaggccagataaaatttcattaaatactttgcttaattctataattcctagatttttctgggatttatttgagctaaggaagtatttttaataaatggaattgcatttcatgaataatttaaattgaaaaaggtttttaaaagtcttttggctttgggccgaaagtcggcccaaaacctctctctctccctcggcccagtcggcccaatccggcagcagncgnccgcgcgcgcgtncgnccgctgacaggtggggcccacctgtcagtcttcggcttcctcgcgccgntgncggcgnccgagccctatcgtcgcgccggcgtcatcttcttccaaattcggccacgcctttccggttccggtgaaatccatagaggggaaatgaatcttcggatctctacctttccctttttggaatcgtcggcttaaattggttggaaattcgtggaattcatcttcaatcggattcgtntctcttcccgaaccctagaaccttctttgncggnggcgggcaaccggggcctttcaacgctggcttctagccccttttaaaaggacccccaagcccgtggttaccggcgcaacccttggctttggctttttgtggccggttgaagcctaacatcgggtaaccttaaggcccccgttgccgcccaaatttccaccctggcgccgccgt

SEQ ID NO: 78296 - DNA, 2629 bp, Oryza sativa
  unsure (1)..(2629): unsure at all n locations
tttttttttttttttatacaggaagttctcttttttcaanagggggtggcacaccatatgtgtttaaatttttattaaaaatggttttgaatataattaaaagaatttgggttcatataaaggggtcctaaaaaaagtttattgaaagaaacaaaannnnnnnntnnnnnnnnnnnnnnnnnnnngaaaagagaagaaagtccttttgaattctttgttggggtgggccacggccccggtaattcataggttttttcccatcaaataaataccccaggggggaagccggtgtattggtccaaaaccccccgcgcgttattttttgacttccgcgagtttccggttgttttgttatccatgantttatagaaanatctgcaaaactattnnnccccaannnaaaannnaaaaannaaaannanaaannnntcaagtctaacatgttacttattatatgtaagtgaccgacaagagacttagatcttcatttaatattctaggctatgtgaagagaatagaaaagtatcatcccttacttctaataacactcactttagtntacattngctagtgtacagttttattgaccaatacccctanncagtgccctcctagggcttcgagagaccaccccgggttgccgagtttcttacgacaacctgtcatggccgtccaactggggctaaatacggagcagtaacctccccagaaaattgtcttaggaatatatattaacgtagaggaatgcccgtactgagctgtcaccatcagcatcccacttctactgtcccgcatcatatatgcccaattaatgatatataataatctaagcaccatgcttatattgtcaaatattactctgtatcctctagaataatatagagcaatcatttgcatgaacattaaacccacaccattgcacctctctggtaggctagtcacacaactatatcaacacaaatacaatgtaaaaccagtactcagataaagtaaagtaccaaaggtatataaagaagaatattctattaattctggaagtcttacaaaataagaaagaaaaactactagagtcataccgaaatcttctgaagactcgaggactccgagaactatcctattctattccacttagcactagagcactaaactaaacttgagatagagatcaaagcttcttgcttgagtgtgtgatggaatgaagaagtgacccctttatatagcctcccaatgacggttatggcagttgaaattgtcagaaatgccccgcaatagtcattgggagtgcatctgaagcgtccacgtggagggacgaactgaacggccactgtcagggttcggccgaacctgggccggcccagtagacctccagatttggtagaggggttgacaggtaagtcctcatggcgtttatgatagttatggcggtatctaggatggttgcacctgacatgtgggcccctttatccttgagcttgcttaggagtgagtttttcttcatttcttcttcatttatgtgctaatctctgcaaacaaataatactctaagtacaagtggaaataaattattctaaaataaatatgcattgcaagcatagctagttctcctttatttttagttatattgacgatcgaaactggtctataacgatcgtcaacaaatccgcccaagcttgaaactttgcttgtcccgagtaaatgactcggaaaaataaacttggttgttgatcaggagtttctaccatgatgtatatctcaaatgtacaagtgcaaagtttgagtactctctcttatattagtaagtaagcacggtggcttacccataagcccaatccccggggaacacatgccttttcgtcactgttgaccgtcgctatcgaacaattttggccgtcaatattactaaaataaggaaaactagtttttcctggcatgccgatttgtgttagaataaaaatattttccactagcactaggctttcaaaacttttgtagagaataaacataaaatggaggagaatcgacaataatttgacgatcattcaatcggacgttatcgagaatcaaacatatggatggatgggccaagaactcagaaatgacatgaccaactgagccaaaattcacgagtctcaagtgaggaacagaaaaggaggccatcgaccaaattgtgggccggttgggccacccctgggttcggccgaacctacccagccgtagcgccaatcgattcaggttttgactagacggctcagatggactccctatgacggttggagggtattatcgacctttccaaccgtcataactcagctataaaaggcattcacctcacttcctccaacacacacctcaagcaagaagaatcaagctctctctctagtttactagtgttctaaagttagtgcagtaggaatagaataagagtcttagtcctagaagtcttcggaaggattcaggtatggttctagtagctctactctcttttgtaagacttgtactttttccggnngctgntacaagtgtcagcctnnnnnnnnggggggnnatttaaattccttaatgttgaatgcaaaaatgaagaggataagggattccttcttaatattacacatccctcttacgttccata

SEQ ID NO: 78297 - DNA, 1178 bp, Oryza sativa
gcgccacgcgtgtgggttaggtgagcacagcggggctcacctacccgcatttatagcgggattggacgagcgcgccacgccgcatttaatgcggcgcagcgcacgcttatccggtccgcgactggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcaacgcaagtatggcaaggaagtcgctggccattaaatgaaggttgaaatgggcgtccaccggaaaagcgggcgagcggggcaggagacgtgcgctctgcttgtcagaggtcacttccggctgtagactagccctcattgtaaaaagcatgtttcccttcttaggcagctagaggcccatgtggtgacccctgaccagataaaaaggaggcccaggcctaggaaaaaagaaagaggagagaagaaaggaggggagttgggactctggcaaagggtttctagagcctgaacttctttcgctctcggcctctctgtattccttcacacacagatccaccagaacacaggagtagggtgttacgcttctcagcggcccgaacctgtctacgtcgcccgtgtcttgcgcatttcctctctcgctgacgttcctcagatcgagggcgaagaatctcacttagcgcccccggccgaatcggcaaaggggggcctgcgcggtctcccggtgaggagcctcacgctccgtcagcatactataacactgatagatatattataataccaacgaatcgatttttttaaccgccactagcttgtatggtgtacagtacacgcatgtaatcttctactctcctcgataaggggagagaccgagagaggttttcgctggaattatcgtcccccgtttcactttgtgcagttctgcgagcataacagagtttttgttaactcggtgaagtttccaacgaatctgagctttcgttatgcaggacttgacttggacatctttatttacaattccatgaaaatatcgaatttttttcgtttttagattttttttttaatatttacagaaataatctatcgaccaaa

SEQ ID NO: 78298 - DNA, 2584 bp, Oryza sativa
  unsure (1)..(2584): unsure at all n locations
aaaaatagagagagaggggggggcgccaaataataaaaagggtccccccttggggtggggggggggggcacggggggggnnncnccccggngnccccncnnngtggtctttcagatgaataggtatgttttctccaccaacaaggtgtttttttttttttnnnnnnnntngttggggggngagaagagaaaagaaaaaaagatgaggggagaagntgtttgccggccccattcaaaaaaagggggatctattttttttttttnttagagcacccaaaaaaaaaatatttttcaaaaccggggtgcttctctttagagagggtgtctcatagtgttgtgaaaaaagagtgtgaacaccacaagagagacaagggggggttttattcaacaaaattttcttatttttttagggacaagggaatttgtcaaaaaagcgtgggttaagatattaaatccttagtggcaaaataaagggacaataaagtggattacttatgttncatccagtccgcattccttncgttaataaaaattctaagcaattttctgggagggtactggtcngtatttagcnccagttgacggccatgacgaggtgtcgtaanaactcgcaaaccgggttgtctctcgagccctagnaggcactgtaggggtatggtcaataacttgtcacagcaaatgtaactaagttgagtgtatatagaagtaaggaatgattatnttctatttctctttcacatagcnntaganttattaaatgaaagaatctaagtccttctgcttcgtgtcactctaccatataattaaagtaacccatgtttagactttgatatatatatatatatatatatatatatatatatatatatatatatatgtaatatatataagttattagcagatttctctttcttataaatcttccattgggattaaacaaatacgataccttggaatacttccgggtgaaatgctacaatagtatatccgtgcgcttgcggattacttctgtaaccataaatataccagggccatttccacaccattgctgggaattcatatttctagtaatgtcgttaagaaataccaatagctgtcagtctgaccgtcggtgtcccgccggttggaccgccgaacccgagcaaacacaaatcgaagatctctctcaaaatagattgaaactttattacttctctccgtgtttacaaagtgcaacaacaacactcttcacgaaaatctcgactacactcgaaaccctaacttttctctcaactcaactctctcaaaaacgataccaagaggacacaccctccctctctttatatacctgagataggtagcctaaagccacgaaccaaccttgtactagaagtcctaatcccatagaaaaccttcccgtataagaaataaactttacatactccaattataccaaatttggactattttcaaattcgactccacatcccatacgcacacaatatctccatcgtatgccatatggaatcttcaccaaccacgtgcattgatctttagtctaagcatcctgcatgatatcctgatcgtccggacgtcatcttctcccaagttgactcccgatccatcaccggcaacactcacccgaggcatcaaaaccacctatacatgcatcaaccaagaaaccatattcgagcacaagttctcaccaacctgactcattgttagcaaacaacagtattgcatattcatagtacccatctagaagtgataaacatgaattatccacggatatccagcgaaacaatccgaaaccgaaaccgacacagagttggctggtcagaccgtgggctggccggtctgactgcacgcatagctccgatctgaccggtccaaacagtcagcagcagttcctgttcatcacctacaaatcaatcatctccaaaaccacttcgctaataatcttcaaatatcaaaaccaataatatcaaatgccaattggtcatttaaaataaggaccgacacacttttgttttacagcattgattacatgctaatccccaactaggacatttcaccagttaggcttgccagaagtcattccttcgcctatgctatagtccctatgcacttaccgttaggtgttgcctctttatttaatcgnagtgcttatgatatgangtccgaatataantctattctaaacattatgaaaactacaagtnctgctcatcgactacattcacatattcatctcannactcaacatgtnntcttnctacatctcatggnaataggtctncgagggcatgcatttcagaagtaaaagctcntcaaactgatgtgnccatggatccaaccacgaaagctatcttgtacaantgacatcatggacacttgtataagcanggnncaaactangtnngaagggggaaggtcccanaaccanttaggaaatttttagcttccattcattagttnacattagtgtcaccgtccccttnaattaaaattggaaaatggtcggggctttttattgagatgaaaattaccgcggcacttgcgcattaaaagcgggggtggactcagttattccccccgttttttgg

SEQ ID NO: 78299 - DNA, 1259 bp, Oryza sativa
tggtttcttctttttatttttctcatgtgtttttctatggatcaccgctgcagtgttatagccttataggtatgtgtaacttgaattgtgctatattatttgtcaataatagtgccattttgtggtaacacatgctgttataatgagttctgtggcctattggttatatatattgtaccgttccggattctcacttcgtgagattacctgatccttatacgaattatctgaatgattgcgctcatgcttacgttcttgccttttgtagctattgcatcgcaaagttttcatcttgtaccaagctggtgcctggttcatctattgggtttcataaaaaatttctggcagctagcaataataggaaataacacaaactgttttgagcaatagctccaatgggctctttggaacatatagtggttataatacacgaagtgctggttttcctacctactaatatacagttagattgcaatctgcaatattattttggtaatggatatatcctttgtttacagccattacatgtttcagtttttttactggtcttcactaagcaacttttgctgcttagttgtcacctgcatcagaaggcagagaataacttaactttacatgagataggtgagcccaattttattgaaacaatattttccacttgcaattttgtattcagattaactaaaggttgtccccaatattttctcttctcagtatagctttcagaggtgaaaagagaaaaaggagaaataaaaggaggtagcagatcactctgcatttcaagttgctgacctagcctaatcaacatgtcaaatgtcagacgtgtattgagtttgatgtactaaccactacaacttattgaataagtatgaattgggttttttaccattaacatttaactgctgcaatggataagtacaaatgaggatatttagtattaacatattactatcttttatagacacttgtatcagtctatctccattacaggtgtaacttctgttggtttgttgatatcacaaaaggtaaaagaaaaagtcgccttaactataagtctgtaactgtacaatatggcatatggttcaggtaatatatctgtaaagctttacaaaatatctccaaataccaatctaatttgttgtccagaatttaatcttactaaaggatatcttaatgactgataggagttaggactttatccaatttggtatgttttctggagctatataaatttagataattgcttatggaacaagttt

SEQ ID NO: 78300 - DNA, 3545 bp, Oryza sativa
  unsure (1)..(3545): unsure at all n locations
gaacccgattttttaataggagaataggggtaggagcggcgcgagacacacatctttttgttttttttccccnnnntttttnttttaaaaaaagaggtgtggtgttgttttatatatatagggggaaccaaaannnaagacgccaggggnnnnaacacccacaccccaaaaaatataataaaagtatgtgaagaaacaacccccttttagcccaaaatttttctttacaaataaattaggccacccccaccagctctcaaaaatagactctcgaggaaaaaaaaaacaagatgttttccacccccaaagagaggcgcctcaaccggcgatgaccgtaaaattcaccatacgttgcccttaataccttgacaaggagaggccacacatggtgggtcaacaggcccaaaaactttgagttcctgcacacacgatnaaaagcgttgtaactctgttccccacgtagttccgtgaaagataccttgccttcgtggttcacatgaaagccatgagaatcatgtagtcttctcaactcatatctcaatgcccaacttctgacaacgagtatggcatcaattcacagtggcacttcatcccacaagcatcttagagacggcntttccatcnatatgacntttgagatagagaggcttcatatgacggtntgattcatcgggcttctcaaaaactgcatctttaggacctagtgaaaagtgagcaccttcggcttcatccatagcaaaaattccataggcaacatacataccatgttgatatccatgtcttctttaggagatgactcatctttagcaaccaattgttcttccttcttctctacaacaaccggtttttccttctctatggttttacgcctccataccggtggtggtcgcaactcattgaaccttttatccctttgctcttcagcctttttctctcttatttcttgggcccgaagacgttgcaaccttctcctttgagtagccgttaaatccttaggtatccacctaggtgtcacgtcccaaaacgaccctaaaatatatcctttaaattatgcctagaataattaaaatccgtgcgaaagcctccaaaaattaaaatgtgcaaagtaaaagtcaaataaggcttagaggatttttgtatatttcctaaaagcctaaaatgtgtaaataaattttagtggaattttcagagaacaaataataattgttaagaaataaacaaagttaaaaaaggtttcataaaaagtctccttccctctcttgggccgaattcggcccatctccctcccccctctctctatcctctcccccgcggcccactcagcctctccccgcgcgcgcgccgctgacgggcgggcccgcctgccaccctcgctaacaggtggggcccacccatcatccccgtcctcccgccgctcttgccgccccgctcgcaccaagcgccgccgccgccgccgaatccgccgcatcccgctgtccccgcgtgcaattaagtggggggaattactccccgtgatcccctccccctttcccccccatttttccctctctttctcgcattcaaacggccggatttgctcccgcaaatctcgccggcgccattgatggcggccggacctcccggccgggttccttcctctcctggccgccctctcccccttccaaccctatttaaaccctctccgcacctccttcgcccgtttccaccctttgccgcgccgtctccccgccggaaacgagctcgcgccgtcgccctctctctcctccgtcgccgacgacctccggccggccctctccgcttgccgggactgtctcccgcctcggcgtcgccttctccggcttcgccgcaccgccgtcgaccccgtccaccccctcaccgagctcgccgaccgctggaacgccgccgaccccatcgacccgagccacgccgccgccttcctccgctccggccgcctttttcgtcgtcgccgtcgacctagggtgagccgtggaccgccgcctcttttcccccttcccttcccctctctcggccgccgcttcgccgtgcctatggccgccgccggcgaccatagggtcgcgggcgccgcctcccgccggctgcaccatcgtggccacctacgggcgcgccgtgtggccgccgcatggggcccagccgtcagccggtcgcgtcctcgtgtgtggctgacgcgtggggcccacggcgccggccggtgcgagccgggtgcgcccggtccaccgtggactgtgaggctgccgcgtgggcgccacccccccgtggacccggtccgcgcgccccctcccctcggctgacgcaataaatcttttttaaattaaaatttaaataaagaaattcgcaaatattcacttaaagagcatatatacttcaaatggccataacttggtcatttgaactcggaattggaccgttcaagtctctaatttttccttaagaagtcaagaaccatttttgtgctttgttcctgcttgttatatggagtttattagagtaaaagcctttttcctttccgttggtcgtgtagacgctgcagcttcggaagatccgctctacgtggaggttgaagccgacatttgggaaagcgagcaaggcaagtcacatcatccttgaacatattgaatcccagtttataaaattattttgatttaagttaatgcattatcgctttatttaaattcccgcgttatcactgttttatttagccatgcctatttacctttgttatgaccttattattattgttattgttattattagcttattcaccctaggataaacaaaaccccaactagtgggtactctattcatggttccactagtatgaacttaggtagatgcttcgctgattaattaggcaacattaggtggttttataaccttagactttgggaattctcatatcacttggacattgtggaatggttggactattgtggaattggattcacacctccccctctattcaaaaccctcaaaatagttttaggctgggctcggggtgcatggttttgatagtagcacctcgggcacattaggaccggtctttcggccttttgttgcaaagcaataccctactttcacaagtctaagtggttaagcttaatttgtgactcagcttgttataaacaaaaggtcccggttggagaatgacaaatccggggtccatggccattttaggccattgaagcttaccaacttgggtttggattccagaatcattggccagggcgtggtccggggtagggctcaaacggctgcctttcccagggtcccgccaaagggggttggccggccctttggtttgggaggaggggtgggaacattgattgtttccccctttcccgggggattggcactggttttttaagaaaaaatgtttgggggtaatccacttgtacaggttaaccttttcaaagccgccctttttggcgcccccaaggcccaaagggttgaatttaacaccggggaaaaaaatataagggggccggttgttttaaaaaagacccccccggtttatgggtataataaag

SEQ ID NO: 78301 - DNA, 1562 bp, Oryza sativa
tgggccggcccatcaagtgcagatttacgtctactttgaaaccccaaacaagctatcagcatccacacgactctgcttttttttttttctgaacaatcactttcttttccattgatcgtttataacctgtttaagaactgacttgtgaaatgttgtaacacacttctgcaggcagtgcgggaaggagttcaagccgcaggagctgcactcgcacatgcagtcgtgcagggtcttcagggagaagatgaggagcagcaccagctcccgggtcagcgtcgacaggggccggacctccgccgccgcgaggcccgaacaccggaggacgagaagcaagggcgccgccgccgccgccgccgcccccggcgacacctcggaccgaccgtccgccgtgctcctcctcagggactcatgatctgatgatcatttcgatcgaccttggagttcgtttgtgaattttgcagcacacgcttatatggcgtgcataatatttaacagcttatctaggatactgtacattgatctcctttgggtcaaaacttatagatcatgccatgatactgctcctaattgaatcctagctacgccaaatggttttttttcaggaatacgcaaaagaaaagaattgtgcacctttattatattaaaaggaataaaatttacatagacggcaaacaaagaagtaaggggggtcgaggagaaaaaggaagaaaaaaatgaaaacaagtacttaagcctattctcgcgtttacagtgtgacaaccaaacgaccaagcacgctaaccaagaagctttggtggtgagggatgggcaagccgccaaagggcggcctcttgtgccatgcctgcgacaacctcaggctaggatcggaaatagttgttaaacacacagttgttcctttctttccaaatggaccaagcgccaagggtcacaatcatgtcgaacccacgacgacgctccctcagaactttgaaccacctagtatggagcgctatccccatgagctctaggttgtggatgcccaacccctcatattccagtgcgcgcgcagatataggaccaagttagccggcaatggccaccttgtgcgcttgcacaaccacaccaaaggaagccgtgccggatctcgttgatggctttcagcacccatttcaaggggtggggggattacaatgagcagataaaaccaggatcgcgctcagcataactttgacaagcgctaggcgcccggctggatggatccaatcagatctccacagcggctatcgttgtgcaatcttgtcggccaaaggctgaaggtcctcgtggtgcggttttctgatggagagagacaaacccaaatacttgcacgataactcctcaactaaatacttgcacgataacgcctcaaccgggcagaggagagagtcaccgaggactgcgacctctttctccgagcagttgatcggaattgcggaacacttgacatagttggtacgaaggttagaggcctctccaaatagagtcaggatccctattactagggtgggcgttcggtctgaccgaaaaattcggtctcggtcttc

SEQ ID NO: 78302 - DNA, 766 bp, Oryza sativa
  unsure (1)..(766): unsure at all n locations
gtgtatgattgctaactggttgcacgcagcncgactntataagatcccccaccccgggagaggtggagaggggagagtaaataggaaagaggcggcctgacaagaatcagcgcgtggggatgaaaagtcgagaaaagcggggtggggattagattgaggaggaaggcgtggggtaccagcactgtggggtgggtgacctagagatgaatttttggccaaaatccttgttggaatgggctggaggcacgccaagcatgtcttgcactgctactggcctaataactgttgtcttggctggcgatgggatggcttcgaggggaaagaagtgggcatggtggcataggggcggcgacagtggcatgagctcggctcacactttccgcgaggacgcgtgactgcgggagctggagcacgaaaacgcgaggcggttcaccgagtgcatcggcgttggtgcggcacggacaatagggaaaaagacagggctagggcgaggtgtcgtgcggctacagtttgggcggcatcggagtggggccagcgtgatgatgccagccacatcagccaacatgagtggtgtactggaaggcgagaaagtcgttttttggggccggcaagtggaggtgtgtccgaattttctcgtggaccggtatcattaatgcaacacatctcgcacaggataataatttgtgtccctttaaaacgccaattggtgcgtttttcccccccctaaatttttctaaaaaaagtgggggatatttaaaatcttctt

SEQ ID NO: 78303 - DNA, 71247 bp, Oryza sativa
  unsure (1)..(71247): unsure at all n locations
catgcagcttgctaaactgacgcgtggtggacgagagtgaccggtctgtgactggtctgacagctgtcatgtcatcggcaaacaaccgtgcttccacgttgcacctgcttccgacggagtggaggttggtatgacccatcccatcggagggtcattcaaacagcaccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagggagaaaaaaaaggagagaggggagctcgtagaaaggacgaggggaaaaatagtagggagagggtctctagagttcaaaggctcttgctcttcagctctttgtaactccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaactggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaatggccgaacgagcaaaagcgcacaacctctctccgagcgctagcggtgacgacagcgagcagaacccgcgtcgtcgagcttgtactccgccgcccccctctcgccgaagtcttaggcgggaggaggcgctcgagggggtcgaaagatccgcgacttcgccgcccatgagtgatggagaaggacggcgagacggggagcgtcgtctcctcgtctacggtgatggcagcacgccccagggcgcgctccaggctgcgggcgcgctcctgcgtcacccgcccgtcgtccctgatcaagagactccaactcgacgttggctagatgacgtggccaacttggtcatgacggcgcagcagcgtttaggcgccggcgggcggtcctccgccaccaaggccactggcgctgctactgccggctccgtgtcgtcgaggcggagggcgcggcgagcggcggccgttgcccgccgttcgtccgccattccctcgtcaatgcctccgacccaagaagatgtgcgtgaggggccggatgcccgcctcaatatcgagcgccggcgcaatgatcgccgtgctgcccacgcatcggagggcgcttcctcgtccggagcgccacttcggtccgggcacggaggccagccccccgtgtccccggttggcggtgccggctgtcgagactttgtggcgagccttcagaacgtccgttggcccccaaggttccggcccaccatcaccgaaaaatacgacggaagcgtcaaccccgccgagtttctccagatctacacgactgggatcgaggccgccgggggtgacgacagggtcatggcgaatttcttccccatggccctgagaggacaggcgcggggttggctaatgaacttgccacccgcgtcggtccactcttgggaggatttgtgccagcagttcaccatgaacttccagggcacatatccgcgcccaggtgaagaagcggacttgcacgcggtacagcgaggggacgatgagtctcttcgctcgtatattcagcggttttgtcaagtccgcaacaccataccatgtatccctgcacacgcggtgatctacgcgttcagggggggcgtgcggcacaaccgcatgctcgagaagatcgcctccaaggagccccagaccactgcggagctttttcagctcgcagaccgtgtggctcgcaaggaggaggcatggacctggaactccaccggttccggtgtggcagcttcagccgcccccggatctgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaaggccccagcggctccctctggcaaccggcgaagtgaggccaagcagaaggtccccgccgaggacattgacgatggcaacgatgacctagggttccaggagcctggggccaccatcgccaccgtcgatggggagcatgcgctcacgtttctcgccggagcctcaaggccatgaagcgagagcttctggccgcggcccctacccatgaggcgatgcggcgtgcgtggtggtcggaggttgccctcaccttcgaccagaccgaccacccgccgtgcgttgcccggggaggacagatcgcgatggtggtttcccccaccgtttgcaacgtgaagttggggcgtgtccttatagacgggagagcagccctcaacatcctttcccccacagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggctcggcacctccgtccccgccgccccgaggcagcggatgatcacgtgcgacgaggtcccggtcaaggaggttgccctgggcgacggcccgtccaagaccacacgaatcggtggtctgctggacggcaaataggaagacgcgctcgtctccttcctgcgggcaaacgctgacgtcttcgcatggagaccggcggacatgcccggggtccccagggaggtgattgagcaccgtctcgccgtacggccgggcgcaaggccggtccgtcagaaagtgcggtggcaggcctcggaacgtcaagccttcatccgcgaggaggtggcgcgacttctggaggccggattcatccgagaggttatccatccggagtggttggcgaacccggtcgtcgttcccaaggcgaatggcaaggttcgaatgtgcatcgactacaccgaccttaacaaggcatgtcctaaggacccttaccccctaccacgcatagatcagattgtcgactccaccgcggggtgcgaccttttgtgttttctagatgcatactctggttatcatcagatttgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaagagaccttactctcggatctagcggaaactttcgaaagtctccgcaccgcccgcataaagctgaaccccgacaagtgcgtgttcggtgtgcctgcgggcaagcttctcgggttcttggtctctgcccgaggcattgaggccaaccccgagaaggtacgagctatagagcggatgcgcccccccagcaagcttagggatgtgcaatgtgtcactggctgtatggccgccctaagtcgattcatatcgaggctgggagagaaagcgctacccctatttaagctcctcaaacgctccgggccgtttatctggacggaggaggctgaacgggccctcactcagttgaaggcgtacctcagttctcccccagtcctggtcgccccggagccagatgagccgttgctactttacctggcggcaaccccgcaggtggtcagcgcggcgttggtcgtggagcgtgacgaggacgaccctcgctccgcgcatccccaccctgtgtcgactcgacccgggagagagcagggaggagaggcccccgagccgaacggtggcccaaggcccccgacgaccggagctggccctccgcccgcttgtccgacggtgccaggcgcccccgacccccaggatggccccggggccactgcgggaaggccgcgcctgtcgccctccgaccccgaggtcgtcggcacagaagccgagtgcgccccgcgaggcctctcggacgaagagcgccctggagatgcggcccctagtgaagaagatcggccccgccgaaaggtgcagcggcccgtctacttcgttagcgaggccctccgggacgctaagacccgatacctcaggcccagaagatgctttacgctattctgatggcttcgaggaagttgcgccattattttcaggcgcatcgggtcacggtggttacgtcttaccccctcggccaaatcttgtataaccgagagggtactggacgggtggtgaaatgggcaatcgaactctctgagttcgatttgcgctttgaaccacgccacgcagtcaagagccaggccctcgccgactttgtggcagagtggaccccggccgctgagcccatctccgtccccgaggccagctcgggcccctcgcagctgcctcacaccgcctattgggtgatgcagttcgacggctccctgtctcttcagggcgccggtgcgggggtcacgttgacctcgccgagcggagatgtcctcaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccgtgtgcggcgtatggagcgccattttgacgggatagagcttcggcacgtgcccagacgggataacacggtcgccgacgaactctcaaggctcgcctcctcgcgagcccagaccccaccgggcgcctttgaagaaaggcttgcccagccgtcggcgcgacccgacctcctaggggagacggacgcgcctgaacggcccccgaggcccgtcggagtccaggcctcgggacccgaggggagcgatcccagctcccttagattgattgcttggatcgctgagatccaggcgtacctcgcagataagactctacccgaggaccgcgaagggagtgaacgcgtccagcgcatctccaagcgctacgtactggtggaagggaccctctatcggcgcgcggctaacggagtcctcctaaagtgcattcctcgggaacaaggcgtcgagcttcttgccgatatccatgaaggcgagtgcggagcccactctgcctcacgcaccttggttggcaaggcctttcgccagggtttctattggccgacggctctcaacgatgcggtcgacctggtccggcggtgcagggcgtgccagttccacgccaagcaaacccatcagccggcccaggccctacagacaatacctctttcatggccgtttgctgtccgggggctcgatatcctgggtccgtttagatgggccccgggcgggttcgagtatctgtatgtcgctatcgacaagttcactaagtggcccgaggcttatccggtcatcaagatcgataagcactccgcacttaaattcatcaagggcatcacagcccggtttggggtgcctaaccgtattattacggataacggcacccaattcactagtgaactcttcggtgactactgcgaagacatgggcatcaagctctgcttcgcctcccctgcccaccccagaagcaatggccaagtggagcgcgccaacgcggaaatcctcaagggcctcaaaaccaagaccttcaacatcctcaagaagcacggcgactcgtggatcgaggagttgccagcggtgctctaggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcatcttcgcagagatgacctcgactacttggaagagcgaaggcggcgtgcggccctccgagccgcgcgctaccagcagagcctgcggcgctaccatcagcgccacgtccgggcccgatcactctgcgttgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcaaacaccttcgtcgtttctacccctagtaggggtcgggtgtcaggtctcgggctcgggccaaccccgcaccccccctgggcgtgcagggttggccgggggctaccacatgcatatacttatcttttttctcttccgtatttcaataaaagcattttcgatttcctaaggactgtgtctgtgccattgtttcctttcaaagagtcttggcttgaattagcatgctcgtgctcgaccctgccctcggtgtcccgggccggcggaaatcgccaaacagggcccagaatcgagccgtgccccggggcgtggtgaactccgggggggaatcggcaaaggcccacaatcgggtcatccataaccctcggtcaccacgttcccggcctggccagtctcgacacgtggatctccccaggcactagccccgacccgcgccatttgaggctgggacctgggcacgagccctcgttcaaaccaagacatagaaggaccacggcacagaccatcctcgtctcatacacacaacaaacagagctgacacaaaaatttcctctttatttgattgcagattaaattagtttgtacaagaagggggcccgaatgcctcggaagaagaaaggaaaaactatttaagattggcgggggcctgggggctcacttcgaggctcccgggtcgccggcctcgtcgtcgctgtcgtccacaccaccgtcgccgccctccacgtcggagtcgagggcgaacgcgagccgaggggccgtaccctcgaagctgtggacgatgtgatcggcggcgtcccggacctgcgcgcgcgcgtcgtcctcggttccgggagggaactcgtccagcgccgcccacggggagaagtccgggtccctggcctggtagcttgccagtacaagctccactgccccccgggcgaggtctctcgaggatgacttgatcgtctcctcgagctcctcgaggagccgctggagagtcccggccatctctgagaggcgctgggcgaggaccccatggttggcggcatatttcgcgatccgcccgccccagaggcccgcctgccgcccagcgcggtctagacgggagacggcgtcccgaagcatgccgggccctacctcgcctgccaagcggagggcctcgacctccccggcggacgagtccagcgcgccctgcagctcggcgatggtgtgttcggcagctgcgagnggncngctagatcgccgtcgcccgtggccgccccgccgctacgcgccctcgcatccagctcccttgcccgtgcctcgagctcagcggcccgctgatccagtgcggccctctcggcgcgggcaccttccagattgcgacacgtttgtttctccagcgctgcctcacgaagggacaggctgtccgccagcctttgcgccgcggcctcggcctcctcgagagctcgctcccgctcggtgagcgcatcctcgcggaggcggagtgcggactcctcttcagcacaggcggcttcgtgcgccgccagtgtagcctcccggatggcaacggcggcctcgcggtccgccaggtccctctccttcacacaggcgcgctcttccagcgccgtggcacgggcctcaagggcttcttcgcgccaccgggacgccgcctcggtctccgccgcccgccgtttccgggcagcagcggcttcaaggaccccccgggcggcgtcgagcttctttcctagctccgccgcccagctcccgtattgaaggcggaggtcgtcctgcgcctcgttcatcactgcggtggcgatgagggcagcctcccgctcctcctccacctccctggcgatctccgccagctccttccgacgggcctcgagctccgaggtgtgccggcggtgtgccttgcggcccgcctccaccatggcctccaccgagcgtcgcccctcttcgacacgtgcccatgcagcgtcgagctccgcccgctctgcctgcaggacctccatctgggcacttaacccgtccaacactgtcgtgttcgcggcggccaaggcctgcagaagggcctctgcgctcagtggggcagcggaaggcatgggggagagccgcctcggtgaggatgccgcacggctcggcccgccgatcgacgtaccggactcagggacgacccccggacctggcttgtcctgagcgtcgcccgaggggtcgggcccgagcggtgcgcccgcggcctcgtcgtgggtggcctcggaagtcgtcgtcgcctcgggcggagtcgggtcgggggcttggcaggccgcctggcgtgcgcgcgccgcctccgcctcccgggcggactcctcggcccggcggagtctggcctcctcccgagcggcttcctcagcccggcgagcccggacggcctcctgggcagcctcctcggcttcccgaaggcgatccgcggcttctcgccggtcagtttcccgtctccgggcctccgcggtcgccgtatcctcggcctcagaccggccggacttggaatggcgggaggggcgcgacgggatctcgctgaagcagaagaaaaaccagaagacaaacaaaacgggtgagtgaaaacttgcattgggagaatgaatacagccacagtgggcgcaggacgaacctgcgaggaggtcggttgaacgaccaccttgggggggagataaggtttccccggtatgattcggtcccccccatcttgcagagccgtttcttcttccgctccccctcgggctgcggcgtcggcgcggccccctccgggcgcctgctgctgacacgcgccgccccgccccctcggggaggagatggggagggggtaccctcttgcttcctcttccctcgggcgtcggcagggcggctgccccccgggcccctgtcacggggcccagaagcacgaccccctcctggggtagattgttctcccctgcggctcccgcccgcgccatcgtggcctcgaggagcccgctcctccgacgccccgaccgccatcatgatggtcaggatgttggcacgatctggatcgctgcagagggggaggactccttgggggatgagggacgcctccacggagctgagattcagcacccgttggaccactatcttgaagtcctcaggggcctagtcccatctgaccccttggtgggtcctcatgtagtcttcggacccggtgtactcccaggcgccccgggcgcgccgctggagcggcgcaatccggcgacgaaggtagtcgccgtacagcatggcccccgtgagcccctgggatcgcagacccgccagacggtcaagaacggcgtcgtagccatctcccagatctagcggcgcccgccaactggaggcctgcgctgggggctggctccgaagttggaggcgcgcttcgtcggcgaggggggtgtagaaccagtcactcttccagtcgtcccacttcttgcggaggacgcagggaatgtagcggctcagcgccggcccccgcggctggaagtagcagccaccaactaccgacggcggcgacactggctgtacggtgaagaaccaccgaaactgccgaagagatgggcgcaccccgataaacatctcgcacaggtgcgcgaagatggccaacgtcattatcgcgttgggggtaaggtgcgccatctggaggtcataaaactccagaacatccatgaagaaagaagagaatggcgggaccagccctgccattgcgaaagggaggaagaagacggaccgccccgggtagtgtggtaccgggcgtccctcgcctagctcgaccacctcccggccggtggcagatgccggcatgaatcggcgcggcagcccggcctgcctctcgctcacgatgcgggaagacggcagcacgctaccgtcgagtggtgcggagccccgtgccatgacgccggcggaggaggagcttgaaaacgagtgagtgcggcgagggtagggcacaggaaacaaggagttagggcgcaagcggcgaaggcaaggggaataatgacgagaggaaggaagcgaatctcttcctcggcgtctttatacccttgccaacgctatgcccggctcctcgcttcccgcgcccactatctcgccccctcgtttctcgcgcccacgtctccactaattccgctcgcccgtttgcggcgcacgaggcggatgtgcggctgtggcagttgagatgggacatatcgtgcgcgcgttaactacgctcgccgaccgaagcgccatcatcatatctccaggcaaaacgaaccggctcgtcccgattcgcgtgctactcgagtaatgtagcggtcttgaagagaccgctcattatagacagtcggttttccgttgctgatgtgcgcgatttgcgaccgctgggtttctgcccgcctgtagagaccggccccacctgtcaccaggcctaaggagtggcgtcacgcccgagcgcttccttcgaggggggcgatcgccctggcataacgccgggggctactgtcggtgacatgggaccgggagtatcatgactagaggcttgggcagccgcgatcacccacgtggcctgacccctcggggggggggggtcgggcccgagggtgatgtggccgcccctccctttgtctccccgaggggtcggactgctcccgtttcgaccccgagggccggggcgccccgaccccctgtgggtttggcgccacgtatatgggttaggtgagcacagcggggctcacctaaccgcatttattgcgggttggacgagcgcgtcacgccgcatgtaatgcagcgcagcgcgctcgcttatccggtccgtgaccgggcgcagcgtgtgaccggtcacagaccggtcagatcgcgggttaggtggtggcaggtggcctgttacacgcctcgccccgtcccgtcggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagagagaaaaaaaagaaggagagaggggagctcgtagaaaggacgaggggaaaaagagtagggagagggtctctagagttcaaaggctcttgctcttcagctctttgtaattccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaaccggcaaaggggggcccgcgcggtctcccggtgaggagccccacgctccgtcatatttaataaaacttttaaattctattaatataatcttttaaagtaacttcgtttagaatacttttacaaaaattaccattcagcagtttaaaaagcgtgcgcgtggaaaatcagaaaatagaagtttggaagagaacaaatcctaagttacatttgtaaatttttggatgagttttctatggaagttgtatatctagtccttattttctaagcccagtaattattgcagcagacatgaaataatgcaattgcccctgaaaaacaaacattctctggaaactcaagctgaaggcacatacttgcgattatgttggagtccaaagtgcttggatgcaaaattccctttgtctctactcgctcacgtagcgcttgctagcattaagaaaggactcgctgtacggtcgtagataagtccaccattccgcgttaaagcgttttcccgcacgggctgagctggtgcacctcccacgagccttctcatcccctccggcccatccacctcgcttcgctagctagctgctctccccacctatataacagcgagcccgcccaacacccgctcgccctcctctacttctgccgcgccaccaaccatccatcgctgacgcttccaacccaactgaattcaaacgaagcgaacaacacgaaccatgcaggcgcaatcccgcctcgctgctgccgcgagcggcggcagcggcagtggaattagcgggagcggtggcattagcaggttgggtggtggagcgggggaggagcacgaggcggtggtgagggagctgacgcgcgggcacgagctgacggcgcggctgcgggcggaggcgctgcgggcgctgcgcgggcaggggcaggccgaggccaccgctacattcatcctcggggaggtctcccgcgccttcaccgtctgcctctccatcatggccagcgcctccccgtccgcctcgccgccacaaccggacgagacgccgccggccgactcagccgtctcgccaccaccaccgcgcgcggcgagagaggacaacgtcccgcgaaagtgagttattctgcacgtgctatacagttatactggaagcataaataaatgcctagctagctagcttccagccgcagaactagtagctagctaatcaattagtacaagatcagctgggttaaatatgctataggaattgagtacgagtttatctgattcatcccgtgcattgatccacaggagattattgacagcctctccttacgacgatgggtaccagtggaggaagtacggtcaaaagaagatcaacaacaccaacttcccaaggtttaaattaatttctcaaccccgtgcctgcaggctagatatatcatataccttaacccatggattaattaatcgacaaccctgctcatgtcaaaatgctcagataattaaccatcgcgactactcgttttgtttttaaatgtaacgagattatggttacgaatttagatacgcatgcatcttctcttgtccagattcatagccataatttttatatttagaaacggaaaaagtatatatttagcaaaaatgggtaatttaccatgtcgttgtaaataaaaaaccaaggtgagtacttttggaccatgacggttctagctagctagagacagcgtataggagaaaaggtattattcgtgatgtattgattggactttgttggatagcgaaggcgtggcaccggggacggaagagacaaacggaaaatgtcgcttgacacgcaccctacaactttatagattcttttgagcagccaggcgaattaattgatcgccacatgtttgaaaccatccataaagttaagccttatcagttggagaaaccaaagttaagctgattttttttctgtcatgtggaaattaagctgttctgttttcttcacatgatcattttgtccctggtgtcacgttgtgtagcgcgagcaaataactgtggtttatctgcgtgtatcactgtgagctctctgctagtttaaagctggagtttgggttatattatatcggaagcatcttgtgacgtcatcacctaataattatttcttgtgatgtgacctcatcaggccagcttgctagctagccgccatgttcttggattaggttacctaattatgtatacagtacacgaatcttaattaaatcttaatcgtttgttatactgatgattcttcctaaacacgcaggagctactacaggtgcagttaccaccgggagcgcagatgccccgcgcagaagcacgtgcagcagcgcgacggcgacgacgtcccggcgctgcacgtcgtcgtctacacccacgagcacacgtgcctgcagggggcgcccgccgagcttcccgacgcggcgacgaacggtggcgccgccgccgccgcgtcgccggactacttccccgccggcggcgagacgccgtcgtcgctgcggcggctccggggcgtcggcggcggcggcctgcagcctcagttcgtggaccaccgcgccgccatggaggagcgcgagcgccaggtgctcgtctcgtccctcgcccgcgtgctgcaggggcggcagtgctacgacgacgacgacgacgacgacaccgacgtcgcctccctcggcgccgtgcacgcgcgcgcgcctgcggcggcggcgccggtcgccgcgtcgtcgtcgtcgtccgggcccgtcgacgctgccggcgaggagctggacgtcatggactacgacatgacggacgcgctgttctgggggcctttcggcacggacagcaactcgtacgacggaaacctgacgtcgacacgctgttttgatctaattaattaatcaggcgcgcatcgatcctacatgtggttcggtcgatacatatgacgagtcgcggtgcgcatgtccacggctatcggtaggccgttggattcggatatactactactactactactactacattttgcatgaatcgtatactacgtacaagcgtactactactaatttgcattacgtatgtaccttgtgtgttgtaaaattaaatcaaccctgtgttgtgcaactattatgattgcactaggttatatgggttgcgtagttgattaagtttggtccggtcggttggagtggtttttgtatgcacacgtaccaatatgctgtacgtctcactgtctcggtgattctcacaccaaataggcaaagtgcaaaattagcaaaggctgtgtttagatttaaagtttagatccaaactttagtccttttccatcacatcaatctatcatacacacacaacttttcagtcacatcatctccaatttcaaccaaaatccaaactttgtactgagctatacacaaccaaaatacacaatagtgttgtatgacgtgtggctttccctatttgtcaagcaaatagcaaatctgatatacagtattgactacttgtaccactactggtataaaagcgttctcttttctctaaagaaaaagtgatttggatccagacctgtttttcatcaaagtagacatgtgtctaatcaaaagtactactctgtatatgaatataaggccccctttgaatcaaaggaaaaaccataggaattctagaggattttatcctatgggaaataatcctacagagtcctttaaaacaaaggattgtttcctatcaattcctttgaaattcctatggaatgaaccttactagagcaattttggaggaaaataagcatgagatctcacctcatgttttcctcttcatgtgtctaaggttcctgcgtttttcctgtatgctaaccaaacgacagtttgaagactttcctgtgtttcaaaatcccataggaatccaataagcgtggtattcaattcctacgtttttcctattaatatgttttctcaatcttgcgattcaaagaggccctaagagattatgagcttttttttttgttaaatgatgatggatgagagaataaaatagtataaattatgatgggtgaggagggtaataaaccaataaacctttcctcctagaaaaaatcaatttcgattatgagcttctttttagaagttaacgaagtagtaaaaaaacaaagcatggtacaaataatgatggttgagagaataaaatacaaaatatgatgggcgagggtaatacacctactcccagaaaaaatgattttctttttttcataaatgcgtaaaagaattgtacgtcaatatattagaagaaagcaagagtttttattacacaacacaatcagccagacatgactatgcctgtggagggaaaaagaaaaagaaaaaaaggctgctgggcaaaagaaaagaactactattcaaacgctactccaataatgcgggaagttggtggtagagccacactacactgacaataaaccctccaaaagcagcagctcctgcagaagaccacagacgactttccagatggattgaccccataaccactaagatcgaggagagcgaaagatcaaacaccctagagttctgcttcttctataactgccaagagatcaagaagactaggagccggagcctgcacgaagatgctcgaataggcatatcctagaagacagccatcagatctaaagctaaaaaaatactctttttgaaaaaaaatgataaatgagaagtagtaaaaaagataataggtgaggagtaaagcacggggtgagtatggagtatggagtagcagtaagccagtaacacaagtacccatcaaaccagaggcgtcgccaagataggtcaacgggtcggattctaactacagattagtgcatcatgacatgatagcctgaagacagaatttcctttctctgatgatcgcgacgattgccacagtgaccctatcggtttgaccaccgcaaggaatttcgctgcgcggcacgcctgcagcaaaagatggtggatggccgaaacggggacgaaaggcgacacggacaggtgagatcaatgtgcgtgtgaacccacgcctcaatcacacgcccggatgcccggaatcccgtggtaattaagctcgattaattaataacaatactaacagtagactactactcgtagtacttggggtaagtactatgggcatccaagcacaaaccccaaaatgccacataggactaaatagtgaggtggaggagagaataaggaagagagagaaatagtcaactctcatgcaagaggcaacctctatacaaacttcaataaacatatgagagtgttagagatattggggattgtgtggtagagataacctattatacgtatcacctcttaatttaattatctatgtcatgcatgaaattggatgtggtagtcatctctactataaaacttgcccttattacgttctccctccgtaaaaaaaagacaaaccctgaattttcgtgtccaacgtttgactgtccgtcttatataaaattttttataattagtattttcattgttgttagatgataaaacataattaatattttatacgtgacttatctttttaatttttttataatttttttaaataagacggacgatcaacgaacgttggatacataaacctaatatttgttttttttttatggagggagtaacggctatcagcctatcagcaaaagaaactactggaaggcaatatatacacggcagatgcacggatctgattagccggccgggtagtacgtgatttgaccgtatttctggcctcttcggccccaccccgctctcgcgctagcagcctgccgcctgccggctgcgtggctggctgggctggctcgacggtgacatcacgacgcgggcgtcacgctgcgccgctgtgggcaacgtcacccgtgtgggcgtcgccccgagttccccacttgccgccgtgcttcgtcaggcagcgctatagctgccgatggcgaagtccgcggatcgtaccgcgcccaagtgagcagaggaggcgaggcttcgcgggccacgtgaagttgacggatgagaaggcgatgtacgttcctccgcttccgattccgcgcgcgcgcgcgcgctcgtgcaaagcattgggcatactgggcggcccggtgcttgactgaaatcgacgtactgtacgtcttttttggtactgtacgtgcggtgcttggctggctgcaaggcgatgtgtgcggtgcggccttggccgggcgtcctttctctttacggtaaagacggggagacgttggctgtgtttagtttctaaaaaaaagttgaaagtttaaaaaaaagttaattttttttaaaaagtttaaagtttatgtgtgtagaaaaattttagatgtgatggaaagttgaaagtttagggtagttgggggtgaactaaacacggccgctattgctacaaccacctccatcagctcgaggatgtgaaaacacacctgaataattgcatatgagcgatgatggtaaatgcgtatgctactacatggtggatgcatggatgtcaaaaaacgggggcgttttttgttctatgtgtttttggaaggccgaaagggtagatatgaatgctctgcggaaaaatgtacgggaagcaatatgatccgtcgccgcggcggccagccggccggcaagtcatccatcggctcatcgtcagacagtgatgagtgatggactgcgaggacggatggcacatcgccgtcgaacaactctacatcctgcgccgtggcgtttcttccatttgtgcttgggctttgatcttgaacggcgcggttcatacttcataccataccatgccgcaatggtcgccacgacaccgagaaaactgggccggcgcggagccgtcatatgtgtgcatgtgtggacgtcattcggactttctgagtttgtcctttggcttatcagtcagccatcaattgctacctccttacttatatatttttatatcaaacgtttgatcgtttgttttatttaaaaaatatttttttaaaaaaaatagtcacacataaatttttatttatgttttatttttatgttttattatcgaataacaataaaaatactaataataatttttttcaaataaaacgaacgatcaaatgctgaatataagtagtacaaaattagtatagttatttagcttacccgagccaagtcaaccaactgacccaaccaagccaattcattgttgtcaatgatagagcgtacacatccttagggtacccacaatggttatctataggctctctataagagatccatgtcagcatattttcctacttggaagagattaaatgaagagagagagagagagagtaaagctatctactaacctggagatagtctatagagaaaaaacgagacaatgtattagagagctatagatacccatatagacatactattgagatggtttactattaatttagtctattgttgagatgtacatgttttatagatagcaccttactttaccattgcgggtgctcttatttctgaaggcaatggaaacaagctagaaaccccaagggaaacaactaaataaattttaggataacttaactagttagatttcttatggtgcaatctaatctacttaaatttaagttttagacttaatacatatgctcatatttagaataattattctttcagcagtagacgacatacctgttgagagtaggacgtatcttgatttcgttagtctcaaaatatgcatgtccagttttcgaaggtactcatcgtgatagggtgaaagtgagagcacgcacatatataaacacctgatgtctgtagtgacttcgctatctcaaaatatatatgctggcctactttattgaggtgcatatagggattaggtgtgagcgtgtatgcattaataacagtggcagagtgcgcgcgtgtaaatgaggacttgtgtttttacggtattgaaaaaaaaacctcttgttagggttgtgtaactaaggaacagaaggtgattttctcaatgccaacctctatatatacagaggtgaactctagaaagggaagagactctctctcttttttttttcccacgttggttggttcaaccattttcccttagcttaagggtacacgtacctacttgttatttatgcaacaacaattggcaccgtctgtgggaaagatgtcaagaaatgttaggtatagatcagcgaagctcaaaggttgttatgttggacgaatgccgaaatgttcgacgaagcttaaaatatgacaaaaaccgatcgatatgatcgacaaagccgaaaatttccgacaaagaccggtataagatcgatgaagaccacatatggcctcgaaaacctattctctaaggcttcctccaatggtgccatgtaagctatctcataacatgtccacgtcatcatgtatcctatgtggaggaaagagaaggcaaaaaatcaatccatctatctcctattcccacgcctatctcgctcagttaccgatgccgtatgagcctgcgcaagagacaacagtcgactcttccacgccaaaatcagatcccgtgctcccttcccccaaattgccccgccgcacctcccgcccacccccgcacgctgcaccccgttcaagcccaatcccgcgcgctgcaattcgctcccccaccccctggcgcgccaatttgctctcctccgcgcaaatcctccagccacccgcgcgccaatctttcccttgcaccctccctcttttcttctccagtgtgtgaaatcttcctcgtcggcgtcgacgtatccgtttccacgagcccaacgacgaatccactcctcttgccaacgacgacgagctgtagagcaggatgagctgccggtccaaacgacaagtagctccgcggccgccgccgtcgtcgtcgccgccgccgccgccgtcgggatctgcgactgcctctaggtgcttcgatgctgcctcgtctgccttctttcaggccagtactgcaatggctcctcctctaggaggccaaccacgtactgtaccgtacactcaaacctgatggggattgtagtggctctgccttgcttgcttcctggatgttggagtagaacaataagctgatgatgctctcaactcctttgaccctgcatcctcagattggtaagaaaccaatttgcttgtgtgttgtttctgcaagaaacaagcaaattcctttttgttgagactatttagattgtagaattaataatgttttagcacagataggaaatgtgttgtttcttcctcgctcatagtcatgatttttggctcctgatatttcagtggtatggatatacatccacctggtggtttcctaagcatgttacaaactggccaacagccattagtcccacctcatgttttgttcccagcaacatggccacctatgccacctatggcaccagcaactaattcaggcactacgcatgctagatcaaggtcaaaagccaaacctgtcatcaacttagatgatggtgacaatgttaggactgctaagcgtcttacatgggcatcagatgaggacttgcggttggtgagtaaaattttagacaacttgcagggatttgtaccatcattctaaaactttactaatacataatgctaaatgtaggtgagtgcatggctgtaccactctaatgatccgatcaatggaaatggcaagaagaatgagagctaccggggagatgtagttgaattatacaacaacactacacctattaaccggaaaagggaagtaaagcatctcaaagatcaatggcaaaggattaagagatgggtgggatttttctgcgcctcctggaagaaggctgcattagtttatactagtggatattcagatgatcagttgagagactttgctaatcagttttatgtgaatgactatcctaacgaaggtccattcacagttttgcactattggaaggttcttcatgatgaacccaagtggcatgctgttttggaggagcttgaaaagccacacaagcggagcttggatgatggaagtgacacactatcacaaaaagatatcggagaaaaggagcgtccaatggggaggaatgaagctaagaaacaacgcaatggcaaaggcaaaggtaaaggcaaggatgatgatgacagtttacatgaagatatgaagaagtacatggatgttcaagctgcagctagcaaacgacatgaagagtttttagggactcagcaccgtatttcagatgcaaaagttgaagtagcaaggcttaggagagaggctgtcttgacggaatcatatcaaaaattgatgagcatggacactagtcaaatgactaatgagatgaaagctgagcacgtgatgggtctcaagatgttgagggagaaacttcttggcgatataatataaggtattttctgtcaatcaccatgcactttatttttagtcaatgttcaacaaatgaccatgtattgtaatatgtattcttagtcaatgtaccacaaataaccatgcattgtaatctgtattattagtcaatgtaccacaaataaccatgcattgtaatatgtattcttaatcaatgtaccacaaataaccatacattgtaatctgtattcttagttaatgcaccacaaataaccataaattataatttgtattcttagtcaatataccacaaattaatctgtaccatgtgactatatattgctctgttatattcagcctagcaaaacaatccagcactgtcctcctctgttccttctatccagtactattcttcctattctattctgcctcatttgttccttccatctagtccaacactgcctcatctgttccttccatccagtaaaacatgtcggatgagtttgacaattccatagacccagccgagatttacactacagatatgttcatggcagagcatagtgtccttaactcttttgccgggcggatcgacaaaaggattaaggccagattggaaggaggtacatctaggcgtacaagtggtccaaggaagtacatcaataggaaccatgaaggagcccatgatcaactatttgctgattattttgctgaagatcctctctactctgctgcaacatttcgtagaaggttccggatgagaaggcatgtgttcctacacattgtggatgaactaggcaagtggtcttcctattttacacatagagtagattgtactggacgccttgggcactcaccattgcagaagtgcactgcagcgatccgtatgcttgcatatgggactgctgctgacgctcttgatgagtacttgaaggttccccagagtactgctctagagtgcttagaaaattttgtggaaggtgtcgtcgaggtatttagtagtaggtacctgcgtcgccccacggctgaggatctcgagcgtttgctccaagttggagagtctcgtggattccctgggatgttgggaagcattgactgcatgcactggcgatggaaaaattgcccaaacgcatggaagggacaatatacccgaggtgaccaaaagtatccaactattatccttgaggctatagcttcatatgaccttcatatttggcatgcattctttggtattcctgggtccaacaatgacattaatgtgctcaatcagtcccctctgtttattgaagcaataaaaggtgaagctccccaaatccaatttgctgtcaatgggacataatacaacacgggatattatcttgctgatggaatttatccggaatgggcaacctttgtaaagtctataagatctcctcaactagagaagcacaagctgtttgcaagggaacaagaagggaaacagaaagatattgagtgtgcttttggggtgttgcaagctcgcttcaacatcgtgcatcgtccagcacgatcatggagccaaaaagttcttcgaaaaatcatgcaagcttgtgtaattctccacaacatgatagtggaagacgagggagaaatggcagaagatcctattgacttgaatgctgccccaggaacatcaattgttcttccaccagaagttcatgcagggagtaatgatcacccaagcttcagcgatgtgcggcgaagaaatgcttatatccgagccaaaccaatccatagtcagcttaaaaatgacttaattgagtatatttggcaacggtttcaaactaggcaaaataattagtcactgttatttcagtataatgtaagctctagtgtacaatttcattgtaattttatcttagactgactgtatttatcactttcacttactgtacatgtttttctctctaccggggcgaacagattcgatgtcttttacttgtttttgtggctgcggtccagcttttggtgatcttgttcaaggaatgggataagcacttatggttgctgtccagcttttggtgtttgtcgaactcttctatcacttctgtgacgtgatgcagtcttttttttcccttcagtttgctcttttccgcattgtactaaagtgccatgatatggctatgatgttatctggttgctgtagtggaccgtgagttggaagaattgcacttcattgttatatactctaagtcgatgttgtgctatttatctatattcacactatgctgagatgttcatttttaatcgacagatcttttgaatagcatcacatgaaggaccatagagatattgtgtagtttatcaccatgtcatttactacccatgctgccataaaagcaagaagagataaccttagagacagttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcgggcttcagctccactccacaggcaaaactcaactgaggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaaggggcgagctatacttcagatcaagcagttacccactcccgcttgtggcaagcgctgtaagtcttccagggtttcccgtgaaccggtccttaattgccatgggtgcgactcacaaaaccacgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacaagctagtcgatttattacccagggttgacaaaggatagataccaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccaaaacgacggattctacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatgaattttagaagttttgagccatttaaatgaatttctagaattaaactcgatttattgcgcaattatcatttatttttacaaaggaaatggacctcgctgacgtcatcaagggggaggggcggcgccggcaagcgggccccaccggtcagcggcacatgggcgccggtccaccgtggaccgggaccaccgaggctgtccaccgccggtccacgggaaccgacggctcggatcggcacaaagccgatcggacggtcacgaggcggcgcggctggggcacgggcacggcatgagaccggctcggccgagccaaggcgcggcggcggcatgcggccaccggcggcagcagccggcgacgaggaacggcggtgggcggccggaggacagcggcgcgcatggggacggcgacgcaccccaagaggcggaggtcggcaagaaaggggaacgggaaaaaaaggaagggaggagaggtcctcaccgaaagcggcggccggcgcggaggaagatgatggcgacgacgattgcccgatggcggcttgcgaggacggagggcggacggggtcgcccttgaccttcagaaagagatgagggagttagggaggggaggaccgatgcggggtgaccggtaacgacggccgaccgcgacgatgtgagaaggatctcaccgatgaccgaggaaggaggagctccggcggattttcggcgaagaggggcggcggccgaggttctcctcgtccttgcgaagctgagggaggcaatggcgcgggtcggcgtcgaccgaagcggcggcgcgacgcggctggagtcggcagcaagcggcggagagaggttacacggtggggaggtggttccgatggcggttgaaggaaaccgagtggcgaccggcgtgcggcgcgggatggcgaagctggcggtggcggcggctcggcgcggcaacggctgtggcggcgggaaacggcgactggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaaccggcgccgattttcgcggggagagtgggggaaatggtggaggacgtggaggggatcgtgcccacgtcgttggatgcgagctcgggtgcgggagggcgccggattttgcggcgacgtgaacggcaatggcggttggggtcggccggcgagaggtaggaggaggagctgacgggtgggaccgccggtcccacctgtcggcgaagggagagaaggagggacgcaaaacagacttttgcgagcgggccaagtgagaggggagccggcccgagagagggagaaggcgcgcgggccgcgggagaggaaggaagacttgggccgaaagaggcccaaagagaggagagaggattttaattgttttctttttattttaattgattaaatgaactttgtgactttaaaactatttctcgagctccgaaaattcgcggaaaattccggagagtattttagggcacaaagaatattgcaaagtattcccggccaatgatttttaagggaaaattttaattctcccattatttcacttgattaaattgatttaacttttatttaatttctagaaaatgtattattaattgatttttaaacccgaacgaaaatcggggcgttacaaatctaccccccttacaggaatctcgtcccgagattctgggatggctagaaagaaagctggtgctggtcggcggtctgactgatctgcacattgaactgccacatcctgcttcgaactgattgattgactggttgatcaaacctgcacgattgaactggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagaggatgaaaattgaatctggcatttgtaaatcatttaccctatgtccgcttcgactggtcccaactcaaatgacaagtaattccaggaaacctgcttgacctgtcttttgtctgaactgcaaccgtccctgatgctgcttctcaaagctgaactattgacctggcctcaccggtgtacctcagaattcaatcagataacttgagatcggtgtaactctgctgacaccttgcaactggcttcttcaagtactacccggattgttgcactgggttgaaccttcaactaaaacagcgatgaggtgagccaaaactcatctccgagacctatccaccttacagggagtagtcttactttcgcctgactgggaacaattagactattgtccttgaaaaataaccaacacttctcttgcttacaaggaccctcactttgaaaactgaaacttcaccgattcatcaaaatagagcaatgacgacgcactttcatcccagcaagatttggaacttaatcctcagttgctgatgggagattccacataaagaaattctcgtttagctcctgattggtacaactttcttgcttctgacttgatttttggtgtcataagcctaaacagattgcatagttaacattccttgaaacaagcactgatcacccaacagatccaactcaagaggtcctttccatggcatgacatttcacttctttgaccatcctttgctaactcttcctgggttaacagactatagatcctgtaatagcttttcgaaaaatactgcaatctgatcaactatcggaaactgactttgatgctgccgagagtttctgcactttgatcataacaacttcgctttcatatgttcggtaaagatggtttgttgaaaagagattctatgccatataccttgttgactacacatttctatttctggaccaaactctcgtatcttcctgactcatgtatggaacaatttctttttcaacttctgggaaacattgagagttttttttttctggaacttatagcggttgccttgaactatggaaaccattcttgtttcataatcacaccactagggtgtaattgccgcttaccattctctaacagtttccaaggatagagattccttgtatgatgttacttccgaatatatatttttttttccgttactccttacacttgaatacccttggtactgcctttggagagatttcatagtgtcgagcaccatggatccaaccattgtcactttcaaatattccatcactcttttcatttgagtaccactgatgctgcctttagaaagacctcatcatgtcgaggtgttgagggtctaaccattttcactccgttggttaaccattcctctattggctcgcaaacaggttttggagctcaacagaattgcgatgagttagaagagaaactcttggtttcttgagacaccgacagatacacattttgatttacttttgcatgctgaagatgaatcttaaaaggagaggaactggctgactcatattttattcaatatttccttttcattacatggctgccataaacatatacgtacaatgagaagtactacaaaatcaaacaattgtagactgctgctgattagaactgcccttttcacgactgaacttgaaaaatagaagtcttgtctagaattgctattgcttccattattcaaacctgactgacttgttcctttagttcctactaccagaagtctcaccgggaacgttgctctgcttgttgatcttcgatggtggaggggcaactgtcttgtcagctgtaacgggtaggatcttcttgcccgtggggttaccgagcggtgatttgtcgatgggcctccagattggagcaataccaggtgcattgctagaactgacaacagttggacgacctggtgctgacaacacttgccgcgggtgctgacgaaggagcgtaccacctctttgtagctgtagcgagctgttgttctcctggcattgcttaccctgctggcgttggtgctgtaggcttgaaacggttgccggtggaacaatgcgacctttgacggtgcccttgacgataatccgttgaggcggaggttgcacattcaggtgtcgattggtgtcatgggcaatgctggtaacttgtgaatcacgacgaactgcctttgctgctcttggaagaggacaatcactgaaacgatgtcctggcttacgacagttacggcagaatcgacttgcttggtcccgaggtgcaggcttctgattatgcactttggcagctgaaacgggaacaagcagagacttatgaacatccttggtgacgttgcttcttccatggttggcttccactggagctggagttggaggaagagcagaaggattgtgaccgctgttgtcgattgtcattggttgacgaatgggttgcacggttgtcccttgttctttcttggtcttagctatgaccgcgttcaactgacagtccttaggcacatgatctgttccttcacacaagaaacatgttaccttccttaaagggcatgcatctgagtaatgggtatattcaccacagcggcaggtggggaggcataaactagcagtgtgtccgactatcccacatctagcacatgctttgaactccaatcctctttccatgaaactgttaagggtcgtatcatcatcgtcatcagtatcatcatcatcgtcatcagcagcaaaccgctctcctgattcatcatcttcgggtctgggcggaccgtactttatgagatgtcgggttagctggcgtgctccacggaaggtatttcttcctctctgacgcttgggtatccttgctgcgtcttcaggagtaaattctgaactggtgatgatcatggtcctgccattatccatcttccatatcaccttcctgttcgctccaaagttgtgctgcagagtaccatctttcttgttagtagactgacttggagcttggttacttcctgggcactgcttctcgtccttttcaggtgacctggcgaacaccttccatggacagttccttatataatgaccttgctcaccacaatcataacaggtagcacttactttcctttggtctgacattgacttggctgtcgttatcttcggggatctggaccgcattttgacaggggtcttcggtgccgatattgggaactcctgactctgactcggattcgggtcccgggctggcatctgatctcgcacctgtggtgggtgacattgacgtgactcctgacattgtcgttgcatctgttgcatctggtatatttggtatcgacgtcgcatctgttgtaacaactcttccactgtctgagtttgattagccatgacttggggttgaggctgatcttcaagaggctgacgtggaatattattagaattgcactgagttgccccatgaaactgacggggtcttgatccggcgaaattgtccctcttgcagaccatctgctgcaggcaccagagagagggggaaacgggaggggttactagagatgaggtactaaaccacttgcctattgatctgttgtgaatggattttatgattcaagttgtttaagcaaacaacctagtatggtcgcatccccaccaatgacgcaaaccatacccctacacacaagcaaacaacacacgatctagaagctaacgaaactactcttctgggacagattgggtttaggtcaacttcgggaaaactcttcatgatcttcgcggaacgacgactctgaactgatcttctcgctccttgcacgaagcttgaggctcgacttggcttgacttccgaacagacatgaagctgacggctggtcatctaggtgtgacaactaaaagaattggagagactgggaggagaattttgaaaaaccgtttcgcaaagaaaagccgaagggcgaggggagacattttgcaaatagggttttcagaaagcttgtccttagggtttgcccatttggctcaacctacagtcgagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcgggcttcagctccactccacaggcaaaactcaactgaggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaaggggcgagctatacttcagatcaagcagttacccactcccgcttgtggcaagcgctgtaagtcttccagggtttcccgtgaaccggtccttaattgccatgggtgcgactcacaaaaccacgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacaagctagtcgatttattacccagggttgacaaaggatagataccaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccaaaacgacggattctacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatgaattttagaagttttgagccatttaaatgaatttctagaattaaactcgatttattgcgcaattatcatttatttttacaaaggaaatggacctcgctgacgtcatcaagggggaggggcggcgccggcaagcgggccccaccagtcagcggcacatgggcgccggtccaccgtggaccgggaccaccgaggctgtccaccgccggtccacgggaaccgacggctcggatcggcacaaagccgatcggacggtcacgaggcggcgcggctggggcacgggcacggcatgagaccggctcggccgagccaaggcgcggcggcggcatgcggccaccggcggcagcagccggcgacgaggaacggcggcgggcggcgggcggccggaggacagcggcgcgcacggggacggcgacgcaccccaagaggcggaggtcggcaagaaaggggaacgggaaaaaaaggaagggaggagaggtcctcaccgaaagcggcggccggcgcggaggaagatgacggcgacgacgattgcccgatggcggcttgcgaggacggagggcggacggggtcgcccttgaccttcagaaagagaagagggagttagggaggggaggaccgatgcggggtgaccggtaacgacggccgaccgcgacgatgtgagaaggatctcaccgatgaccgaggaaggaggagctccggcggattttcggcgaagaggggcggcggccgaggttctcctcgtccttgcgaagctgagggaggcaatggcgcgggtcggcgtcgaccgaagcggcggcgcgacgcggctggagtcggcagcaagcggcggagagaggttacacggtggggaggtggttccgatggcggttgaaggaaaccgagtggcgaccggcgtgcggcgcgggatggcgaagctggcggtggcggcggctcggcgcggcaacggctgtggcggcgggaaacggcgactggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaaccggcgccgattttcgcggggagagtgggggaaatggtggaggacgtggaggggatcgtgcccacgtcgttggatgcgagctcgggtgcgggagggcgccggattttgcggcgacgtgaacggcaatggcggttggggtcggccggcgagaggtaggaggaggagctgacgggtgggaccgccggttccacctgtcggcgaagggagagaaggagggacgcaaaacagacttttgcgagcgggccaagtgagaggggagccggcccgagagagggagaaggcgcgcgggccgcgggagaggaaggaagacttgggccgaaagaggcccaaagagaggagagaggattttaattgttttctttttattttaattgattaaatgaactttgtgactttaaaactatttctcgagctccgaaaattcgcggaaaattccggagagtattttagggcacaaagaatattgcaaaatattcccggccaatgatttttaagggaaaattttaattctcccattatttcacttgattaaattgatttaacttttatttaatttctagaaaatgtattattaattgatttttaaacccgaacgaaaatcggagcgttacaacaattcattagagaaactatctcttgttctatctcttagatgatgtgtacgatttatgagctagcagttgtcttcaaaggacctttgaaggaggcctaacatggggaagactagggagtagtcttgtctagtcagtgacaatccgataatatcaaatgcgtaacaacagcatgccgcatgcgtggctgtctacatccccgggccgccggccgcaccacagcgtttcatctgtgcggtgtttgggcttcgatcttgaatactagcggcataccatgcctcaatggaacgaatcacgctgcctatatgtcccatccaattaaaagttgctatattttaatatggagggagtagaatggaggaagtgtcaagtgtcaaccagcttttcaaactaatcggggtagtcgttttcgttgaggactagcacaaacaactagagtggaaaataacggcgcatgagacaagctattactgggccgttttcgagaaaggctgctgatacttgtgctcaaatcggcccatcaggaatagtgcgtttggccgatgatgattcgacagttcttaaaaataaggaagatgatgtgagactttttttttaaccaataaagatgatgtgagtgagacagttgccagttgccacggatgaagcttgggattgggagtttccgaatttggtatcaataccgagctcacatacgtacgtggcgagggaccacagtgttgatacatacgtgcagtcattgctagtgctaacacaactcgcgatccacgagtcaacacacccatacatgcacgaactcaaccacaatcccatacatgcacgaactcaaccacaatgattaaatttcctagctaattaagccagacagctactgtgacgaccggctgcctgctcgtcctggtacgtacgttcacgtccaaccggtcggcctgatgtcacagtccagtacagatgtcggcctgatggaacgtcctctcgtacaatgcaacacaattgcaaatgtacagtgttgcattgcacgagagttcgttccatgcactggtaattcttaaatttgtaccatatatgcgtacgatcaatcgatcgatcctctcatcgacgacgtcccagcagtctcccatgcactcgtgtcgcgcgtgtaccgcggccacaccgtgtccgcgatccgcgccgcgacgatgcgctgcacgtcgccgtcgtcaccgatcaacacacggtgatccgctgctgctgccgccccgaacgttgactgatcgtactggccgaaacagtagtccatgtcggccatctgcgccgccgccgcctcgtccgccacgctctcgtccgcggcgctcggcgagtgtcccgccgcggacgccacgaacgccgcctctggggccgatgtcggccagatcaacggcggcggagcggctgcggcgcctcctccgctgatgaccgccgcgaggcacgtgacgatggcggcctcctcttcggcggcgctgccgccgccgccgacggcgtggggtaaaagaagacggctaaagaggccggcgccgttcatcgtcaggtccaacatttccgccggcggggaggaggacgactgtcgttgccggctcgtcgtcgtcggcgagctacctgcagtgttgggcgtgccgggaacagcttgcggctgctggcacgtgtgctcgttgaggtaggtgacaaggaacatgggcggctcgccggcgtcccgctgctgcacttgcttcttcgccgcgcaactccgctcgcggctgaacgtgcacttgaagtacaacctgcatgcgttaggtgacacgacgggatgagagtcctctatcataaatgttattatcaggatgtggattttcatctctcgaggaatattacctcgttgtctgcatgtcatctaaatagttatcaaatttttttaaaaaaaatagtaaatatattaatacgaaatatatcactccacaaacatataaaatcaaatttaacctatacatgttgcaacaaaaataacaagttagactaaaaatagttattgcacattcgcaactatattttttttatctttgttacaacttataacagttgaatttaaacttgcatgtttgtgaagtgatatattttatattaatctatgctgctatttttttatattttttatgaccatttaggtgacatgcactaaatgaggggttatcccttcaagggatgaaatcactttttcttattattttacacacatgtgtaatatcattgttacagaggacgtgaaccggcacgacgaagcataggtcaagttaaagaattaattcaagtgatttgttttggcaagtgtatggctaaaacatgccgcctaagtttttgtctagactttgaattatttgatcgaggagtacgtgtgtatgtacgtgtatgacgattgacgacgaaggttaaggttgaccatgttgacggcaaagtcaagtcactggactggacattgatatgctgcatgcatggatgcatttctgtaatattgaacttccagaaagcatgttctgatctgatgctagctatcaactgactcagtctgtagtccaatggactaaaacagctaggttaattactctgaaattgacttggacattgtgtgtgttgcagtgtatattggttaatgcttaccaaatctggaggttgacataacagttcttggtagtactttaggaatcatgtggtttaagttgtggttagttaaaattggtaaagtaccatgcatattctagcgaaacaagtagaaagtagaaactacactctacccaccttagataattgctgtcctgaatgttcttttgcccgtattttctccactggtagccatccttgtacggggaaggtgtaataatctccgtcctcgtaaccacctcttctctgccatttctgacaagaacctcttcactcctacagtagtattccatatatatcaatttgtcatcaacaaaagcaattatcgattcagaacatattgtaaacatcgataagaactcttctgtttacctaacgcgtttaaccctcgccggagtgtgcaagcaaatgctatcgtcagtcctcgtctccggcgccgtcctggtcactccttccggtcgtctgctgctgttgctgcaaggcttcagcatgtagagagacaccatgaacactcgcccgagctctctgctaacatcgacggcctccttctggccgcggctatcgagggggccttcgagcagcgcctggagcttggcgctgaggcggcggccgccggcgagctcccggtacagctgctctatggtatcttgaccaaatgccatcttaatttgagctgaaacttgaggcaccctagctagagcttttgacaaagtgagaaactgagaatcctttcaatttgcaacgcagaggagttgagcttgagtagctgcagtaggcagctttgaagctagctgctactccagtatttatagacaggccgacagtctgcatgcagtggtcatcagccttgcaattgtcagttttcttcagggatgctccaccagtttcagcatatataatttgggtctgactagctcaaaccctgttcattaattaatgttgatcattgatgtcaacggctgggcgattgatttattctggtcttctgaccgatggatcaatcgatagattatcttagatgggttgactggttaggctaagcttgtgctctctctcacggtacatacatattgaactggaaatttcggtctcttcatctggacgtcagttaagtatagttgacatatgaaatggtagtagtaatataaactacaatcctgtttattttattagtctactttgagcttgcaataaagtatgtggcgagcgatgcaatttttttcaaacgctcgtgtcagttgattttccaacttcactcccagaagagacgtcggacagtgactcccctgtgccataaaaactggacagcaacattgcgatgtcgaatgcatagtagaattcatagaaaaacaaggagtaggtccaaaggagaccggccttaattatgtgcctcaaaatctacagaaacatggtacatgtcaagtgatgtccatgtgcctatgaggatgtgtttagttcacgtcaaaattgaaagtttgattgaaattggaacgatgtgatggaaaagttaaaagtttgtatatgtagaaaagttttgatgtgatgtaaaagttgaaagttcaaagaaaaagttggacactaaaccatacctgaattctgaacatacagaaggtcaagtgatgctcagaaggagttaatttttcaccaacttgccgatcgatcgtctgatggtcaaggagagtgatctgtgcccttgaattgtagacctggagtcaactacagtgcctcaatttagaaatagtagagataatttaattcaatctccactcgcaattagaaacttctaacgactcgatctcaactgatctaagctcaaaggttaaatctgactgatctagcttctaaagttatatatgtgagatgctcctaatcgtacctaccagagtcaatgtccagttattttctttagcacaagtcaatgccccaatcataagacagaactgtgtcctagtttgctactatgattacgattccttgttttaagtatgtacgatccgtgtacatactccctccgtcctaaaaaaaaaagataaaccctgattttcatgtccaacatttgactgtcagtcttatttaaaaaaattatgaaaaaaattaaaaagacaagtcacgcataaaatatttatcatgttttatcatctaacaacaataaaaatacgaattataaaaaaaatttatataagacgaacagtcaaaattggacacggaaacccagggtttgccttttttttttggacggagggagtacaatacattattgattttggctgcagtagctcaagattcaagagtcaagatcatatggtgtagtgacctctaataagatagcctttttttttctttacgagacccacaccaatcaaaggactggtcctaccctaacatatttgggtgtattccggagagaacgttaagaacttctcccctcacacataaaactaggtgacttacatgattaactaagtattagcttaaatacttgaaaatggaatgatatgaatttttaaagcaacttttcaatagtttttatttttgcaaaaccatatcgtttagcactccggaaagcgtgagaacatgtagtataacacacccttaaaatatcaaatttgttcatccgctttcggagtgacttgctaagggcatgtacaaggtgagagagcatagcactagtttctttttaactcgtcgccgcataagggggtgctaagtgtctacagtggtggggaccgactgaaagtgaagtgtggcctgtaataagtgccaagtaaatatacaatgataagaaatcagaaaacaattttctctgaatgccaaatatatatttttaaacgaactataccaaacaatgagagttttatattaatataataggaaaaaagaatacaacactactatagcactagaataatcaggaaaacaaaaacaaaaaccaccactatactatacgctgacagcacctacacatcctgaagacctagcacataccgcaccaactgccgctaagtaggatcgagcaccgcggaaccaagacaaggaaccaccacttaactaccgaccaacacacctccaaccagttaaaacaactagaccatctggacaaagcgataaggactacagaaggaaagcgcaatagagaagaaagactcactcgtccctcgtacacacccgtcgccgtccaaaatgttggtagggtcctgccatcgtcaacctccacaagccacggtccctcgtaagggccttcatccctccaccaaacagctgaactcctcctgggggagcgagcaataaccacaaaagctgccacacttggtgactgatgtagccatattccttcatgtccctatagcactagtagaaccctaagatgcgccaccaccctccagccagtgatctccttctaccacgcacacgtcgtggtcatcgctgcattgcactggtatattgcacgatgtgctccccggtcttgtgcacgttgtcttgtgctgctaatgtgcacaagacatttaaatgggtgttgttgctttccaacttcagcagcaacccctgagatgggaccccaagtgcacatcagcggcataagaggggaaacaattttggagcttaggaaatgggcatagccccatttagcttccggtcttaaaatggggactatttattgaagatgctataaaggagacaaaaaaaataaatcatgagcacttcatttcctttttcagcacggggagcgtaagcaccttttgtcattttggatctaaacactagggtggaaaaatggcaactttgtatttggcatttggcagtctggactagcaaatttcgccaaaaagtgcatagggacacggaccacccctcacggacgcgcaatacccccactcgctctctctctcttccgtcgcaccctctctctctctcgcccccaaaaaaatccccatccgcttgctccgcctcctccgccgatctcccccgcggctccgcctctttctcccttgctccgcctcctccttcgccgatctcccccgccgcaggcgctcacgcccgctccgcctcagccgtcgctcacgctcgcttccgactcccttgctccgccgttgatttcgcccgccgcaccaggtcacggcagcctcgacctctgccgatctcccccgccgcaccagtccggggtggagatggacggcgacggatacggcgatggctccggcacaagggacttcatgtcgcagtccgattcacacgccgaccacgacgagctcgacccctacaccgactccctgtactacactggatcccgcagcggcagtgcctccaggataggcatggccgccctcgacctcaactccggcggggatgggtggccggatttggggagctacgagggtcttctttgatccggctcgcaaggaggcgtcatcagcggaggagggggccacctttggggcggcgcacatggacgcggcgtcggcggatctgggagccaccatcgctccgcctcgcaaggaggcggctctgctgatctccctcccgtgcgtgctgtgagtcggacactgggcttacgctcggcccgccctgctccatgtggccgaggcgccacggcagctcgcgccaattcctcaccgtatggaggtggccgttcggcgcccgcggccggagccaggggccgtggtggtggtcgaggcacgcaggcgaccggagccaggggccgtggtggtcgtcgatccacatccacggctgccaccgtctctgaagtcaacttggacgtcgactccgacaacgtcgaagatgccgccgagctccaagaaattttccaaaatcatgggaaggtatgccgaccaaccatttcatcttcgtggctgtgctgctgtgatgtcctgtgattccctttgcttcaattttaccatttccatttcataaacctgtgctgtgctgtggtgtagtacgatgtagttgtgtgctgttgtgtggtgccctttgcttcatctgtgaccatatcataaagatgtgctgtggtgtgattaggtgtgattagtttggagattttaggagttatgttgccttgtgatttatataaccgagcaaaaaatttgtgattcaaaagtttatataggtgtgatatgtttatgtcttgcactctgattcctgtgatccagaagctatgttgcattgtggtttatgtctcctggactgtgatatgtttaggtttaatatacttgtgctttgtgatttgctctattaagttgtcataactgaagatgtatttgtttcccttaaatcgtgttaaatattttttgcttaccgttatgggtgggtttaggttaaacctgacagggccaattggacagaggacaataccagcttgctgtgtgaaatttgggttgaccagatcaataagggaaactgcgtgaatggactcatgcagaagactgggatgagggagattatcgctgcttatcatgcagcaaccaacctgcggcatggtagatcccaaattactaataggattaggcaactgaagggattgtggcaattcattcaaaccctacgcacaaacactggattcaatagaatatgactactgtagtgttgtaatatttgtgttgtatggacttttaaaattgtgcactgggacttttaatatgtatgtggacattttaatgtttctatgctatggacttttaataattatttggacatttttttgttgatatgctacgtacaattttgcgagctattgatacatttgaactatctggaaatggtcatttgggaactgttgatacatctgtgcactgtcaaattgtggcttgtaccagtaagagatgaatctcttgttttcaacttagcagcagcagcatcatcatttgcactaccctcacggccgcagcgcgcatcagcaatagcggcagcaacgacaagcagcagcagcggcaagcaacaagcagtacaagcatgagagagagagagagctacatgttttgtggggggggggggggggggaagcaattaatatgggcaaatatgtctttatggaagaatggtaaaacttttgtatgcctctaaacaccaacttgcaaaaatgcaatgccaaaacttttgctaccaaaactttgccatttgccatttgctattccaaatgcctctaaacatggccttaattattccctgctcaattagtgagcaagtaaccattacgtctcccgcaaagaattaatatgtattccccgtactactcaattcctgatcaaataatggtcacggttaattttaaggtcgtgaccgtacgtgaatttgcactcggtccgttacatcagtaattatcatcaccaccattacagtcatcagggagataaacatggttaccaaggtgcccgtggtcatagtccaaaccatacctgagcgcgtcccacgtcgagaacaggtcgcctccgtcgttcatcgtcgtcgtgagcggcggcgccgccaacgcctcggctgccgtgaacgacgacggcgacgcggccgcggccgtggccggcagctggccgtcgggagggaacgcgtgcggctgctcgtgcagctgatggctgctactagaatcgaagctcagcatcatgaatggccttcttctcgctgtattttgctgctgtcgttctcgctcggtctgctgctgatgagcgccgccgccgccgccgccagcggaggagccgaacctgaggaggtacgcgtcgccggcggcgcccggcggcggctgctcggccacgacgtcgggggtcgggacgggcgtggtgttgcaggtgtgctcgtacgtgtaggtgaccctgtacagtggcgggtcgtcgtcgttctcctgctgcaccagcttggaggcaaggcactgtctgtcctcacggtaagagcatctgtaatataacctgcgattccatttacagtacagatgcataagatttaaatgcatcttaagattaggatctcgccgcgcggttttaccacaaattaggttgattttgaactctgaacttttttaagtactagtacagttactattgttaatagtttgttgtagccaagtagcctactgctgaccatgcataatatttcaatggaaatcccaatatgcaagaaataaattgactaaaagctacttttagatgggattgctacattcacaacacacatatttttttcccaaaaacttttgtatgagaacttttagaaaaacgtctaccaggaaaacattcatccagaaagcttttattttgaaactttcatcaagaaaactttcatatgaaaactatcatctgaaaatgtgtgtgctaaattaaccataactttgctagatagtaatttcgagtttttgttgtttgactcctggtagcttaatattcccatctgtcaattttactcttcacttttttatagtaattcacagcaaatgaaacattctaaaatattataacaatttatttctataatatattctcatagtaaacaataaaagaacaacctagatgattgaaaccaacaagagcacatattatatcatttcttaatatgtcatttctcaatatgaacagaatgcatgacttaaaactttttacagctgatagtcaacagataaataatttaggttctatttagataatgactaatttaattacctagggaaagcagagtccttgatgttcttctggccatacttcctccacaaatgaccatcaaaatgaggtgtgaacgtatgtttcaccaatgatggtctatccttcctgcagcaatactccgtgtatacagttcaaatagaaaaagttagcaagtaattttacaatgttatgaaaataataaaacctgctatattaattaggatacatcaaaagtgacaatatatacttcctcggatcataaatatttatttcatgcaattgatttgcccataaaatttaaccattcatcttattcagaattttagtacaaatatataaaaatatatgttacgtttaaagtaactttaataataaaacaagtcacaagaaaataaaatataatatatattttttaaataagacaaatgattaatgtcaaatgtgtcaaatatttatgatcggaggaggtaatatagaaaaaaatgttccaatatacatgaataatatgcaaagaatcgcacatgactgataatatacaagaaaaagatacctcgagtacagaaatagttctacaggactaaattaataatgaacgatcgatgtttacatgaagttaaaaacaagcaccattacatatataattgctggcctaattaattatgtggccagatattgcaacatgcacgcttatatatatttgaaaaacataaccttgtcagttagttgttgtacaacactaatgactacttgcaaacaaagtcgcattataagtacaacatataacaaattaattatgtgtactatatatgtatatatatgtatgtagtatccagggtgtatttaccacgtactatatctgaacttagcgagattgaagtactgtgttagttgtttcgtgttagcatggcctctatatcaaaatcgactcagtgcaatcttatgacgcaacggtagtactaccaccgtttcacaatgtaagtcattctagcatttcccgcattcatattgatgttaatgaatttagatagatatatatgtctagattcattaacattaatatgaatgcatttcccgtattcatattgatgttaatgaatctagatagatatatatgtctagattcattaacattaatatgaatgttggaaatgctaaaatgacttacgttgtgaaacgaatggagtaagttcgaagcttagtcttttagtttttttttctcttgtttcttagttatgagatttaaaatttaagtattctttatcctttaagtactgtgtatatccccgattttttatccattgttaaaaagaagcatgcatatgggtgagttggatggcctccatcagagtaggacatgtacacgagacatgcatgttgaagggggcctagctagtagtagttgcttgatctccgttatttgcatgcatgcttatgtcaatgtctgggtcattagcttatttaaagggaaatggatctgaatctgttgataagttggtaaattaaatacgtaccccttctaaatgggttaccacctcccccgaacgcatgccatatgagacatgaagaatctagaataattaaagattcttttttcatcagacagattcagaaatgcttctctagcttttcatgtgatccatagtactgtggatctatggaaactagctggaatgtgagtatatatattagtggtgcccactttttattgacatgttgagaatagtggatgagccaggaccacaaaaataatctaataagaaggggcgcaaagcagtgctaattaacactgttcttaacattcctaacagtacacaaatttatatgattttaagatagaataatttcagccaaattcatgacttgtataataatggagcctagacacgaccgaggaacaatgaaatacatgctctcccaacctttttatcaacagttaagttgatattcgaacttgaatttgtttggacaataggttaattagctagatcagctgaaaatacacttatatatgcatggtagttttactgacgctctcgattcttttataaggatgaaaggcaacggtttcaagtgtactgtcaaaacgttcaaataatggggtataacttgtgaaaaatagcgactaatcttttgatgttgtcctttagaaatttttggtcggttttactatgcaatggcatggctatatatatcaccctttctttctttattttaatctcaacaaattcatcacattgatcttgatattgcatgttgcaagcatcattttttttgtgggagttgctacaataagctgggcggtttgttgtttgaatagaaattttgtgatccttaatatggaagcaaattaattaattcattatttcttacttacatatgattttcaaggcaacatatatatactaggcaaaatataggttgcaactgcttagaaattaaaagagaggggccgagagctgaggaactgcttagaaggtaatcatgcttttcccctacatattcatgtgttggcgaaaggtggtcatggtgtagccatgtagtgatcttggaattgcagctatggagttgtttgcaggttcgtcggatggaattttagaaaaaagaattgtagcttggtgttaagtttggtgtttgagaatctgaacttttgttaattatgtttaatgcttcctcgtgtgagggctagagtctagaactcgtttttattttgttgccgatgtacatccttctttgaaggatgtagagaccgggttgatatattcattaattatctgaaaatataagagtatggttcctgtgtgtgtgtgtgtgtatgctctgatcttctgacaaatgtcactgatatcttgctgtactaatatctagatttcaatctatatatcaagatcaaaatttaattgttggtgtgaatatatagtggctaaacactattcatgaatctttgtgaaataatgtgtgtgcaacgtacgcacttcagattgtcacatgcaaaaatattatgatcaatgaagcaatgccgtcagaaatgcccttttctcattcttaaaatgaaaaatggccagaattgaataagctctagtgttcacttacaaataggtgtagttcgagacaggattaatctgagtggatagagaaagagttaaacgtctcccgtaaataataaatggcttagtgttccacataactgatcaatatgtccttatctaatactatgagttaatttgatcaagtctacgcactagttcatacgtatgcgcttggtctctgaccgtgtacactcccccctggaagacttgtagtcaactcacactatgaagggtcctaattcccgattaataatgttcatgtccaaaaaagaaagaagtttaccagcataggaatatatatataaatgaaggatcaaaacattttgtttagaactaaggagtttcaatttgccattgcattaattgaggttgaggcttgaggacaacagaagaaaaactgtatcaaggatacataggtcaatagtaagaataagtcaaaacactaacacacaatactacacaagttgatcaggataacactgtatagttagggggatgggagtgtatgagaatgagaatcacaagtatgaataagttcatggatatatcttaaacttaactaggaaggagaaatggttagtggaactttatggatgctgcatgcatgaagtgatgaagatggactgccgacatgcatgtgcttgttactttcttgtttcctttaatttttacctcttttagaagaaaagtatatgcttgtgagtcataaaatactactaattgtggactattactgctaaggaaagaaacaaaggttggttcgatcagttggtaattcgatatatatatataacaaagaagattcgagacttctctatgtgcattctttgttttcttgttataagctagcatgcttaaaatgtgcaggaagagctccaatctagaactagtagtaaggtagggttctcaagcaattaatggagccctccactatggcaaagatgcatggacatatgttaagaaaatggaacaacatatgatcacttcgggttcctaagtgtcaaaaagaaatggtcttcattcaaaggaggagaatatgcatcttcttggtgaattatgaagaatgctgaaaatggctattagcatatatgtgatgtttgatgattttaatttattaatggcatgtccttttactgtagtgcagaatctcaatccaaacttgagcaaaacattatgccccccccccaaaaaaaaaaagcgtattaattttccgctttcacctcagctcatgaaatatagctagctcactcaaaagtaggacaactcaaaggaagaaattaagatcgatggaggaaagaaaaaccttgatagttggggtagtatgcatccatttaattggtttaatttttcaatctgtttgttttaatagtgcagacgagctagcgttatcaccctcaatcgtacaaggtttcgtcattctttttagtagtaattaaaccattaaattcaagttgcaatatagtacatactatctaccaaccccacatatagatcctaacattgcctgtttatgaccatgttaatgtttcttcctcctccttaatttccccaaaaatttccccatattggcataccacacagaagccagaaactataattcccattctccttaattttggcagactcaagaaacgaagaaaaagaaagggcaaacaggtacacacaactcaaatcagcaaagcgcagttaggatcagcggctccagaaattaatccattcaagacagcaagagaggtaaacaagaagtggttggagagaggcaaaatatatgaacgaatcgacgaaattaaacacgaagcaatcaaggagatacaggtactaattaacaaattaacatctgtgtgtgctagcttagctagctcgtgtagtatagtaccttctcttccggccgtcgcgcggcgaggactccggcggcgagatgccaaagacgccgccgcccccgggagggctgtacgacgccgacgcggatcccacggcttcctgcgcgctcgcctcctcgaagtcgaacgactgctccctcttcagccgcggcgacgccattgattcttcaggccagctctctctctctctctctctctctctctctctctcgtcagctagaacaagagctaatgccttgcaagctagctagaagctgcaggcaaggggagtgggaaatggaggaggcagctgcgtcgctttcgagctgctcgccggagactttaactttgggaggggagcagggctatgcctacgcttaattagccacggcgtgcggtacaagcacggtcaatagtttatggtttggttttgttgtcaagtcaagaggcgttgctgggtcttttgatatgtttaatgtttacagatatacattagattcgagaggatgaatctgctgccccctcaaacaattaatcatgtgccctattatatgggcctcaagcattggccccctcttgatgacttctttttccccttaaattaacttaatttcttggtcagtatgcaattaggttgtgtgtatgtatgtatacatatatgtacatatatatgtatatgtatatgtatatgtatatatatgtatatatacatatatatatgtatgtatatgtatgtacatatatgtatatgtgtatatatatgtatatgtgtatatatatatgtatatgtatatgtatatatatgtatatgtatatgtatatatatgtatatgtatatatatatatgtatatatatatatatatgtatatatatatatatatagcagatgctagctagcttgctctcaatgcatgcacaatttctcatatcgttttttttttagttttgaggatagtttctctagtactactatgagtgtattatatatgttttgcctcttgtttattgcgaccttggtgaggctcttgaactgacgtaagcgtccgggtgcgatgcgggcatgcttttttactggcaaattgcagcaacggacacaaacaatgggtggcagtggattagatgtatttgcaagttgggattacaatactggggaacgccatcgttagccaggatggtggaggctaccaatcccgagccactctcacgtttcggtgcagcctgcatgcagctaagcattttgctgcaaggtgctgaaagaaggctattttatcaggagaatttgtgaggaagacgattgtatatgatacatttatatcttgagggtttgctgatcttgtttaacacggtttagttgcattgccagcggaagtcactaccacagaacacctaataggtgccggttgggaatcccacaaaggtgccggatttcccaaccggcaccacgaaggcggcactgatgtgaagagaaacaggtgccggttcctaaaccggcacctttgtggttccacgagtaaaaaaaagccggctcgatgcatcgagcatgcaccttctccatccatagcaagaaaaaatcatcatccatccattccatatccatccacagcaagaacaaatcgttattcaattcaatccacaacacaaattacacgaactatttgcatgcatcagaggtaaagcaaaagaaaaaaaaaaacaaatcaagcacagcgcctcgcctgatccgaccacccccgagcaccggtgggagtggcggcgccggatccagccaccctcgagcgccggtggccggtgggaagcaccgaatctggaggagggcggcctgccccacgtcgtcatcgccccccagcttggatgtttcggtgaccgccgccgctaggtagcacgcgtcggcctccccttccctcggatctgatggaggggagggtgctgccgccgtgaggaggtgctgccgaggggaggtgagggcgtgcccacaggagaagactccgccgccgccgccaactcaggaaaggaggaggaggaggaggaagggaggagaggaggatggcggagaggggaggaggagggggacgatggaaagtggaggagagggagtcgacggagagggtgcgagagagagagagagaggtatgggagagaagagagacgagtggaggagaggataagggtcacgcactcgcgcacaatcttatccgagaggtcggcttgccagctcggctccgtttgatataggtgttaatttttaaataaaccgacacctataatattttatagtcggtttttaattaaccgatacctatagtgtattaaaggttcttatttttttgaaaaaccgacacctatagtatatataggtggcggttttattgtagaaccaacacatatattttggtaaaggtgttggtttttttattttcagtctatgggtggtggaaaaaacactataggtgccggttttagctgttccggcacctatagtgccgacttgtatgtgactttttgtattagtgatagtcttttctaacgaaatacaagtgtgagatctcatattgatataccaggaaaaaaacaagaccatagtattagctagaaggctatgatcgggaaaggaaacaaaaataacagtcacaccacacacctgcgacaaaattaattctttgagaaacaaacgtgagcacaacgccccaactacaccagactgtctccgtccatgcctttgggtttgagagggagagaacgagagacaagatggatccattctcccccacgcagacccgccaacataggcatcttgtggcagtcagaagcaccactgcaagataaacaaaagtctgaagaagagattggcttgggaatggtccttcgaaaacgagcctctaggaaggtcgcgacatcaagaacgttcccgtcgcccactccggtaaaccaggatgtggttttcacctgaaggaaaacaccatgcgagagcaaggagccacaacaatgcccccaagaggtttacggtgcccaaaagcgtcgccgctgtcgacctcgatttaggccagtatttcgcctataaacatcctttccttgcatgtcgttttatccttgttgattctgtcaactgccaccaaatgaacaccttcagcgcatggttatcgtattggcgccccaccgcgagccaacccttgggaggatctatgacccacccgttgtctaactctggcgagtctttgacaagtcggccaccaggacctcacccgcacatcatcggagcaaaagacccatgagctctactgctgccaacccacaccactgccccgtgccatcccaccgtctccacgtcaccaccatctcacgccagtcgtcgttgtgaggctggatccaccgggtacagtctcctcgtcaaccttcatcgcacgcgcctcgctccaactgtcttcgtcgcctccactgttgccttccctcttccctattgtcaggccgccaccctcccttgctggcatgtgcccgccgtcgtcgcctcgccggatccgagcagtggcggtctggatctaggtggcacagagccaccaccacttgagacgccctggtgtcccactcacgccagccagcgtcttcgggtttctgatcgacggccgctggaggctggacgctagaggccgccggaccgagcgggcgcaccacggtagatctgatcgacggctagttaattactggtgtggcgtgcgtgcacgctccattcggtagtgatcagcggagaaaccgagtgagagagttgcgcgcgcgcggtggaaatcaatcaacgtcgtacgccaccggtgcgccgtgcagatgtagtagtagctagcccagcgtacgtactatataccagccacatacgtcgcacgacacggcaggaagcgcgcccgtgggccaggtgcggtgcctggggaatttagggggttaattggaggagcctacgcgtcgggcgcccgattggagaggggaaaaatcgggcgctaacatcagcatgacatatgcgtgcaaaaccactttaaactattttttctcttaaattatttatccaaatcatgatccgattgcatcattaaattcattgcaattaatctttaaaacaagaccacacatggatatattccgatgaattttttttagcttattcttgaattatttttaaatgttgcacaatgttttaacaagtataccggaattgtttcactaagtagatcgaaaatgtttcaatcgtttaaatcgggtgttatttcgccttatatcaaaacaatgtttcagcaaatagcgaaatgatatttcggttcactgcaacatttgatccatacatagtgaaacattataagtacactaggtgaaacatttttggtggaacaaaaaataaaacgaattcccttaatagagggtttccaaaatatgtggatgatttgttgcaaaaaaatgtttcaattcattgcaacattagatctatacatagtgaaacattgtgagtacactaggtaaaatatttttgatggaacaaataatgaaacggattttctttatagagggtttctaaaatatgtggatgatttgttgcataagaatgtttcaattcactgcaacattagatctatacatagtgaaacattatgagtacactagatgaaacattttttgtagaacaaggggagggatatgtgggtgggcccgggggtgcacgcgtgggagggaggggaagcgaccgattttctccctccccccagttgaccgattctaagcattatcggggttaattagttagggatgatcgatgcgggcatggcgcagccggggttggccgtgtacataccacggccgatgcatcacaggcgtacggacttttttgaggatttaattggtctctctggcagagttgcatggtggtgcgcggctatggtatcgatcgatcaatgatcaatctatatccccgattgacaggacacgatcacacgattggtcggaacgtacgtggctagctgttttagtttagtgtcctaccaaattaccaataatatactacctttgtattttaatatataacgttgtcgacgttcgatgtcgcgattccggtatttgcatagtatggggatcgttggtactagaatatacgcgagactgaggtaaaagagatgagacagtgatttttatacaggttcggacccctgaattgtcaggtaataaccctacatcctgttggctgaagccggtattgctcttattcaccataatcacaccagtacaatatttggggtagcctatctaactgttgtcgatatggcggtctgaagttctgactcgtagtcgacaacagggtagtcttcctcctcgagttcgtgcccggcgagatcaaagataacgctttcgtctctcctgacagtatccggagacaccgtaggggactagccgtgcttatccctaaagtcgatatccagcgtcttgtcttggcgtatgttggcttgtattggcttgtggcgtctatgttgtctgtgtcccctctcctcctagggggccttatatttatacccataggtgtccccttatctaagtagaactaggaaaaccaatatggatacaatccgagtagtacttgtcgtttctatgtagaactctggttgtctttccttatccggaactcctcctatatccgcaggttgttttcgtataggacatggtatgtggtgggtcctgccgagatttagtcaactactattaggtatgtggtatccataaccctgacaaacgtcgttgaatttttaataaatgtgtttgaccattcgtcttatttaattttattttgtaaatgtaaaaaaaattaagtcatgcttaaggaatatttgataataaatcaaatcacactaaaataaatggtaattacatttttttaataagatgaatggtcaaacgtattttaaaaaattaaccgcgtcatatattaaacaacggcgagaatacgtctttgataaattttaacactaccaatactcttaatcgtgtacgagcaaatgttttggttttggtaaatactattgtcaatccaaacatctagggtatatggtattttttaagttgttaaatatttatttagtaggtttattaggacatgttttgacataaaaaacagattaagacttaagttgattttttttaaggaatcgtctcctaagtagtacgagtatcttcctataaccaagcgaggaccgaacgacccggccatatatacattgatcagtttgtaataataaaagtgtatagtcatcgattgatgcacttgacccttatataaaacataggcaaaacgtatctgcagttctgtatacaagcgtacaattatatattcaaggaaattaatccaacttattgtcaaaggtgtgcgcatgcccgcgaaaggacccaggcgtttagttcacaccaaacttcccctaaactcttaactttccatcgtatcacatcacatctaaaatttttctactcacataaactcttaacttttttttcaaactaccaactttccccaaacttcttcccaatttcaaaaactaaacacagccctaattaattaagattaaatctgaagagtggacctagattaaaatagtacggctgctgcagattttaatatattggcacgcggttgcacgatcgatgtacttacttatgtacgttggctgttagccagctgcttagctgtcctgctagaaaatcattttccgaagataattttgcttatacggaacacatcctaggtgagaggcaagaaatactaacataacatgtggattcattgaatatagagtactcttgaatatataatgaatgctcatttttcagttgacaaatgcaaacctgcgacctgccgtattaggagagttgggttaacataagcaccttgtcagggcaatcactcgtcttatgctcacgtcatgctgatgtgtaagacccagctcgcgatcacctggccacttgattaacacactgcctgatggaatcaatcaggtggccataacccatgagctagcagagtatcatttggagaacatgtacagttcctaaggaatgtcaaatctattgcgaccatcgattgttcaattgttttaccgtatatatttcaaaatataaacaaacttttgtacgtgaatctaaacgtagtacatgtctaaatttatgtaaacgaatctatgaatatacaaaagttaagataaagcgaatacttagaccacatcgaatatgctttggattaagattaactacgagtatacaaaatgagaaacctattagtttatgattaattgaactttaattattttaaacttaaaaaaggttttatatgatattttagagcaacttctatataaaaagttttcgcacaaaatatatatatttagaaatttaaaaaatgtgctaacgaaaaccgaggtgaaatatgtatctcagcgaagaaagaacgggaccttatttatttaccattcgcttttgattgtttttttattttattttctaaccgatggccggataggagctccaaaactaattataagtcggcataccggatttacataactcatctgcttacataccggatcatactccaacctctcagccataaaaaatttagaacttttttagataatgaacttaaataaaaccccggcatctacattccaagagattcagaactaataagacatactgttgttaggccctcgcgtcaccctccccctcgggcgacacgggaggtgactaggccgccgtcgccggcctctccctccctcctccgcctcgctgccgcccgagcggccgcaaggacggcggtagcggggcttcgctctcaccacgcaagggcaggggggctactcggcgtttgggacggcggaaccgtccagatccgtgccgtccggccggatctagcggggaggatgtcggcggcatcggcgtggtagtgcggtgtggcggcgacgtttggcaaaggtggcaccggcgcttggaagtgatgacagtggtagaagtgaccaccagatccgcgcctggatctggcaggtaagtggccggtggcggggtcttctgctggcgacggacggtggcgcccggtggcgcggtggcgggtgaggtccgactctgcgacggctggatctggccggacgacgagcatccagccgtcgctattggcgacggaggcagtggctggcggcgacggtgcgacggcgcggaggctggtgaaggcacgtgcgatggtgcggaggccccggaaaccgtgacggtggcggaggggcaagaggccgcgctcgcagaggaggtggcaacatgcgcgggcgacggcgtgcggaggcgcagcaactggtggttgcggttggccggtgaggtcggctcggccggcagcccgcgacggcggaggtggtgtcggctcgctgaaggagttgcggccggcaactgtccaacgcgtgtaggcttggccggcgacgtcgaggacggccggtgcgtgatggctgcgcagcgagaggtgatgtcggtggaggcagagcccggtgaggtggctgcatgcggagactggccggcgggggcgccggtgcagtgtacccacacaccggcagaggttttgatggcggtggagcaatggagctgtggtagattggtaggtggtggacggtgggtgaaaacccaacccgaccccggccggaccgacaaccgatgaccgatgatgctcaagtgtcattcccctcctgagggtgttgtcgtgccgtcttaccccttaagggtggttgctgggcgaaagcttagtctcggctctcttgagaccttggcggacggcgacggtggtgtttccgtcgttctctccttggagacgttgtctagacatccccttatcaaaaccacctgaacttttggcgcaaacgtgctctagatttcttcctcttgtggcggcatcctagtttctacaagttggccatggcagatggcctaggggggagaggtgttccatcttctctctcaccctctctctctctctctaaatcctgaagacgtggatagagttgagctttgtgttgtttgtaagggtaaggttttgagcgatctcggttgtttccgttgttggcttagcggcagtcggtctcacttagcggcggccggtctggtgctagtcttctccaatacttgtggttgaacgctatcgatatgtgagtggtggtatatttatttttcctggtgtgtaatcttgttttttttcctgttctattaatagaatttcgcaccgagtcgttcaaaaaataagacagactggcaacacttgccggggagcaatgctgagagcttggctgctgggatggggccaagaggttggagacacatctagtgacgactgacgagtacaagcatctactagtactttatttgatccaagttgctaagctaatctgattgctaacttagcttatcgactgggggctgcagaaaaagagcaaatatgattaaagctcaagtggcaaggtgtcgatgccgacgaggattagttaatggtcagtgtgacagcgcattggcaggtgctactttaaatctaattaagggaaaaccgcacgtgattttgggagcagggacaggttcccctggagaaaacgccagtggcaagtggcagcacgcataaacaaaatttgttgccctttctccaaatcctgccaaggatagttcaggcgcggatctagcggccattgcatcactggcctttgtgaccaggacaaagtcatggcggctcaaaaaccaagacagctaacaaaaaagaaatatagtaatgctcacttcttccctttaaaaaaatattatacaaaatatataatctaatatgaaatgtgatacattctaacattataaatctgaacagattctaggactatgaatctaggtagacctcttatcaaattcgtaataataggatgtcacatcccgtattatatttattttttatgagacgaagggagttcttgatattcctttgtcttcaaatataacattgttactccctctgttttacggatgaaaatggagcggatacggacggataatgctcgtatcatattcgttttcatattttttgtcggatacggaaaagaatacggatagctcgaatacggaaacaaatatggactatctcgaatacgaataagaatcgaatatgatcggacacgaatacggaaacaaatttttctcggaacacgaaaaccagttcaacttctaatagaaacaaatatcaacatatataattagctcattttatataaaatatagtataatttataaatatttttaaaattttaaataatattaataatgtggactagtgttaagagatgaactactattaaaatctaaaaaggtacattgaaggtcatagagttataaagaaatagggtatgtcttgtggcttctgtgcatatccgaatagcactgttcaccggatatctgaattattatccgtatccgacggaaaccctgataccatattcgtattcatatccgagagaaaatatccgtattcgtatccatactatccgagaattatccgatccgaaaggtatccgtatttgtttttatccgaagcggacggaaactatccgctccgttttcatccctactctatttcaatataaacaaatccatacaagatttgtttattttaaatcggagtgagtagatattatgtttaattatttattttattttaaaacttaatataaatatatgtaaaaatacaagtcaggtttaaaataccttaagtaataaaataacaagaaatgatacttagtttgtttagtaagacgaatactcgaatgccatacatacgatacttagtttgtttagtattcactccatttatatccattttatattataagtcgttttgatttttttttaatcaaactttttttaagtttgatcaagctcatagaaatatttgccaacatttataactctattagttttattaaaactaatagttaatatattttaataatatatatttctatttttttctataaacttagtaaaactaaaaaaaaagttgactagaaaaaatcaaaatcaaggtgatttatagtatgatgaaacggagggagtaagacgaatgctcaaatttcatatctagaagttaaccgcatcatatattactttacaatactgctcataataaatgctgattgtggcaccataattttttttactgaagattaacaagtatggtaatcaggaatcttaaatcaaagagcgattttaggagtataagagaaaactaaatcaaaacgttgctgcatatatgcagctatgcttaaagcttactgcacataccctcctttatcattcatatggtatatatagtatattaaatttagctaaaaaaagagctgtgcatatatacactagatcgacatgtatattttctgcaaaagtggatataatatactttcttttatgaaaagctagaccaaaagcaaagaccctttttagtatgccaatgaattaattccactcaaccagtgtgcgtggattctttgagccaagccaaatccagaggctcgacccagtggggatccagtactgaatccagcatgaagtccagtgtcaggtcgtcggacgccggcaacaattcaggcgaaatcgcatagctgcagctgtaatggtcgcttctggccaccgccggcggcggcctgtttaccggcaaagcagcggcgctattattaccagctgattctgcaatgtgacagcctctgatgacggtgagcagcgaggagacgatcacatccttctcttctttcatcgccatgttgtagccgccgctgcagcgaggaggaggagaatgcatcaggcgaggtgtttccacctctgcctttctcagtctttccgccgcctgtgcctttctcaaggaggcgtcggcaatctgctggatttgcatggaggaagccatgtaatcggaggcagaattgctggtgccgcatgtgtgctcgttggtgtagatcacccggaacaaaggcgggtcctccgagttgtgctgctccacgtgcttgctcgctggacagccatggtcctgatggtacgtgcacctgtagtagcacctgcatttgcaagcaataatatatgatgcttaattagtattacagttgtttagtgctcacttttgcattccttgaaggaagaatgctaagaaaagagggccgtcgacatgcatgtggtagccagaaactttgacacatgacaatatttggcattgtacaacacttatctcgtaattgtttaaccatgccgacatgcattattagccccaaaggagtattcccatgcaagcatgctttgggatagcacaatgtgggggatggtatccccaggtatgggatcgatacatacaccacatgcccccaacaccaaggggtctagtatatatcctcatcaaattgtatatatagtagttccagttaattaatgatggactatttacgtcttagtacatcatattatgaatcaaaacgtttagcctcaattagtgtatacaatataccgtggtctacattacataatcggcagggagcctgagacatgcaaatctagtttagttatcttgtcagacgggaaactgttttaacagttcgagtggacgtccacccgtttactgtatgtcatctaaatggctatgaaaaaattgaaaaaatatgaataagatagatcaatatgtaatatatcaattcacaaacatgcaagttaaaattcaacttctacaaattgtaacaaaaataacaaacaaaactcaaattactatatgtatatttacaattaaatttgttatttttgttacaacttgtagaagttaaatttgaacttgcatgtttgtggagtgatatattacatattgatctatcttgtcaatttttttgaaaatttttcgtaaccatctatttgacatgcaataaacgggtagatgtccactcgacctactagaatccatctcccaaaccgtgcagtttgcccttcattgcacaccgtgtagagcatacaatgctctagaaataaaaaaaactaaaaaagaatgagatttggaaggagagatgtccctccaaatattttttttaagaataaattgtgagcatgttagagattgaacacgaggctttagagttgaatcaacacaccccttgccactacactatcaagtgtatctctaaaataaaaaaaaactaataaaggaacaattattgtctgatggtaagtgcatagcgcgcctgtgaattgatatttgcgttgggagcattccttcatttctctcagttcaagaggtttcagttaaaattatattgaataatatccccaaatcaaaatgtgatttgaaatatcatgcaaaaagctgaattaatcccatgataaaacccaagtcttccccaaaaaaagatgaattaatcccatgcaaaaagtgacccctatcagaaattgcggcagggtgtaaacaaattaagctgcttcccataaatgagtaataggcatctattataaaggaaaagaaatttaaactaatattcagacaacatggtctacggggtaggcaccgttatccagtaacaacttgaggattattcggagcaagaaattatatataaatttgattgtgtcgggtttaaattaaaatcataatatgattttcgccaagattgaattacttaggttctgatcgtttgtgctaactacggaagcacagccgtagttcatttttttttagtgtggatatatactgttgctgcagctgtaacgcagccacaagtagaacaaacatgttccttatacaacattgcaggtacaatgaaaccttcaactatccctgaaaattcccatggcatatattgctagtacatggatgttgcaccaattccttgttcgattcataagtatggtacgttagaaaatctatcatagcaaacaaaacaaatcaaaagcttggtgtaatcaaaggcaagttgagttggatcatttaaatatctaatcctcagttcgtgcatgttaattattaggaaactaataggcatcttttggactactaaacaacccccagtggagcacaggagagcatgtaccatgacaattctgtcgacgtattatagttcttggttctatttttccctatttggattattgtgcttcttagaagttgctcccattcaagcatgtgatttttggatacacgacagcctaaaggcaaacaatacaatgtgatgcgagggtagctactgggaagatggacggcacaatttaataaactgcacatgaacaagatatctttttgcttgaaacacacttcccattaaactatatatatgaatgcaaccagaaagccagctttccggatagacacaattattaagttccttaagccttcaaacgggattaatcacatgcacttaactaatatggaaaccttgcaatgagatcaatccaatgaacttaactgataagggaagcaccctatttacatacagtgtgtgtttcaatattattttgtattggtatacatgtgggtatgagttcgatcagttaagagttaaacaacaacctttataataattaaacaccctcatcatgcttataattaaggagcttatattatgtgaaatcctgaaccagagtgtaaattaaggagcttatatattatgtgaaatcctgaaccagagtgtagcccagctgggtcatctacatggattagttctactgagcctacaaatatctttttactacatttcacctttcattcttgcaatatagagagttcagtacaagctggttttccaacccatttgaattccttgcaagtgcataagcttacaattcgtctttgccatcaagtctgacactgtataaattacactagtggcatctactaccccattatccaacattttgattgttcaaaatttggccaattattccccataacagacaaatgttgattaaagaactacaggtaattgagtagtgcatgtaccttgggaaggagttgccccggatcatcttttgcccgtattttctccactggtacccatcatgatatggtgcatatgtgtactcagttcttgttccgatgcaaacctttctatttgaggaaattaacgctaattacttaaacatttaaataaatgcaccaaaagatcgaagaggaatattacatgcaataggaactaactacaaacatcgtttgcagcaagcaccaacgaccagacgaattcattagctccatcaatcgcaactcaattacaatttcatcgaaatacgcaacaattaagaattaactcagtttaagcgcgtgcaaaaccagtgaaatgaatggctagctattgttatacatatatatatgcatggattaacttacttcatagcgttctcctggtcatagctcctactgtcctgcagaagccttttatgggctcctctagaacattcactggagctgtccatgttgtcgctcctcttaaccatggtggtctcttgcaaccttctgaaacaggtcgacgtgatatgcaagttggtgcttgcaagataccttgaagttgctgaacgtcgatcagtcggattcccacagtaagtgctgaactcctcgccggcctgaaattaatggggatgatgagtttattctccttgtctagtgctgcggagaagtgtgcgactgtgcgctcatataaatcctctgcacaacctggagtaggtgcgtgctttgcttccagaattttaaattttaactcacacaacgcggtatctgcacttgcaaacttcactgacctatgcaacgtgatacgcatggacaatgttcaagtctcctgaggtgacaaatccagtcaaagaaacgatagccctacctgtcagtgataccagtatcaaggtttagccatgttccggagattctgatatatatcggtttatatgtgcacacatatagggggaaagaacactatatgtgtttatatattggattgatggatttgatatccaaacagtaacctgtcagtctgctgcaaacttatatatgaaaatgcctccagattggtttgattcaaaatttcaatttcaggtttgagaacaaacaggacctgaaaggttgagatgcaattagattagagacatgaacaggatctaattctaactttatatccaaaatttatatgtaggagtactacaaaatctaagtttaaccttctcggtttcttggttctcatcattgtttcgggaatatggttctcatcattgtggggacaacttattcttcctttttgcttttgaatagttaggtgtttgtttgtttaaaaaaaatagttaggtgtttgctttccttgtaggtacacaaataattaacacctatgtatatgtgtgcatatgaccacgtgaacacagggccccaaatactgggaatgtttagttacaaaagtagttcattaatacggagggagcaaagcttcaggcttaaggaaaacaattggtgatctacacaacttcagtggactagtagtattatgtctcctacaaatcaaggccgaatggttattattataagttaatagtccaatttattctaaaatataacaacttcaccaccaacattctcttcccaactaatcataatcctctaccattcaatttccccgcacacctccatttctcatcggatcataactctccctcatttaattctacctactttcttaataattgtgtacacccctaaaaatccttatattgggacagaggtagtatatatatattatctaggcaaaagtaatttactaatgcaaatggagctagcttcaggtgaaaaagaatggtactgtgtacatacaactacgatgaagtagtagtcctgtcctgtctcctaccaataaatcaaggctgaatggctattattatcagttatcagtttattgcataaaaacccgttttagctagcatgattcaatctaaataagtagaaggataatacaatattgttgtcgatagcattgatcatatagttaatactccaataaataaaacgaatcatattttagacacgacagctatcacaatactagatttcaattttataatggaactacactgtctgaactcttagatcttccttctcatacgttaggtttcatcacccaaaatgacattacaatatttagtattaacggtagtaagtacttcctccgtttcatattataagactttctagcattgttcacattcatatagatgctaatgaatctagacatatatgtgtatagattcattaacatctatatgaatgtgggcaatgctagaaagtcttataatatgaaatcgagggagtatttaacatcacatgggaaaaatgttaccaacacccaaaggtgaaatttgcaacagtgaaaagtaaagtggcaaattatttattttgatatttatctacataagtgcactgatgagcatgagctgattatcaattaaaaacagtgagcccacccatattgttcgttaactaaaaatgtatatattaagtgaaatgtgattcatattgtatggctggtgtgtggaaatttcttgatgtgggatctatgaccttttgaaaacagtatgcaaaggtaccactaatgaaacatatcctgggtagctgtcttcttcaatgtaccagtcatagtcaactatactctatttgaccatcttttgatcaatcaacagttagtgtgaagctcaagtaaaggattactcatttgtattgtcagcctttcgcttaaatcaatcataataacacggttcacactatttcaattatgtttgaatcccgagtcaaaaatgcaaagtagttaaaaattgtcctttcagggatcaggtgttcattgtatacaataaataggtccattcggatctcaattgatattacaatcagaatttttaatttttaaaaatgcaaaagcagaacagagggtgacagcatccttacatgtttcaggtgatgtgagcacggtgatgaagctaatacgagagtccatttcgaataagtcaaaagttgtacatcctgatcatgctttcagatagcttttctgaaaagagagccccaggaagtgggattgctgaattttgccgtacaactttcattgatgaccaacacggtatctccaaagtccagattgctactccacaatcaaaatacgagaaacttcccagcaagcagtacggagtaatcctctagcacaagtgacaaaccgacagttagaaactttcatggcacagggcaatcacacgatttgaaatacagtcaagtgacacatcattccacgagctcattggtaaatcgtcattgtttataccatgacagtatttgagatgatagcgattccatatatgattttcttaatttgagaagaaagtgattctatgattttctaaagaaaagaggtacagaagacgcaccattcctaaaataagctccacagtgcaacgcagaccatgactaactagatcagctccagggtgcagcatcttgcgggctaatctacatctgtttggacattgaaggcatacttcatcaagaagtttttgacaaagcgacaatattctgagttctgagcatcgtaaagtagtacaactgtaaactgtttgcagtacaactgtttggacatcatgaatttgtatgactagtaaagatttccattaaaaatgcagaaatttcacaagaaatttcagagaaacagttgaattcccacggagagatgaacattttcgcacctccaaaaacccctcaccacggacgaagcagtaataaaacacatagttcgttatcctcgatctcctgtttcctggtggcataagcatgacatggaaattccatctaggttttcagcatcaaccatcgatgctggctaacaacaatctctgggctaaaattttgggaatcgaagttgctaaagcggggcaagctttgggccagaaccggcaaggtcagtgctgggctaggctaaacagaactggaaccgagacggaggagtaagaacctgcaacaaggaaccccccccccccctcctgcggcggctgcattggccggtgcgccgcgcctgaacgatccccctcgtcgccggcgccgcatggattcccctcctccagccgcgtcctcgccatcgccttcctcccgacgaccccgtcggcgccccgccgcctcgccgtcttgcccgcgtagcgtatgtgggaaggattcgatggttggagatctcgtgggctctccttgcgctttattttggcccaccccgacgtgtgccacgccacgtcgcttatgatccagatgggctgaatctacttaaccggttggaccgtgagcccatatttagttggcatgggctatatgtttcttcttggtcatcgggcagtaacgtgtgccacgtcataaaaacgccatgtttttttttaaaaaaaaggagtagatttgtaaaggacgtaactatacagctagtgttagctaaaccagctaccactccatctaagaggcaccatccacctatacttcaaatacaattttctcttaaactactcatccgatctacgatcgattacaccgttgtgttcgtaacaattaaatctttacaacaagatctcacatgattatattttgatgaaaaatcacaaattacttttatgatatgtctaaattacttttagatttcactaagttactttttagatatataaaagtaaattcagtaaaacctaaaagtaatttacatatattatagaagtaacttagaacaaaacgaaggtaactttaacatgtcatttgaagtaaatccgttgtagagataaaaacatgactctatctataaattaaaataatcaacacaaattatggaattaactaaaataataataaaagtaatcacctcagagcattatgaatgtataggaagtatttgaaaaagtaactcatatatatatatgataatttgttcaatgaaaaaagaca

SEQ ID NO: 78304 - DNA, 1869 bp, Oryza sativa
ttatagcatcttttattatggtgagaagtgtgaaactaatcacgaaagacattgttagacccgcccataaccgcgggcacggctattcgaatagttttactctggccagaggtgtaccactgtacccacaagacacagccccacgacatgtcaccatgtgcctcaataccaccacggtaccttggaaaggagctgtgacagtacccctcgcacaacacaattcaaagcagtgcaccgttcctggatcataatcacccctttataaacaaggcatagactccccaacgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggttcttaattgtcatgagcacgactctcaaaaccatgtgctcacaacccaccattatcaagttttagttggcaagtaattaattaaccaatcacgattgaccatcgtgaactatcattaagccatcattaagtaatagtgagtcataagttatcccaatagtgtgctaatgtttctaagcatggctaagcaatcatatctaatatctagctgaaccactatatatagcccaactagtcaaattataataacccaaggtatcaaggaataaagtaatcaagaacaaaagggctataacaaacaataggttaattccacccaatgacatttgaaaataaatgcaatagttgaatagaaacaatagctttaaacgtgatcaacatgctcaaagggttgtttgggatctgtgtgacttgccttactggccttggaactcttcaaaatcctctcctgcaaactcagactctccgaaaacgtcggaacctaaacagaaaagagcaaaatcaccaaaacagaacacaaaccagcatgaacagtacatgtggatattttcaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttaaaaaggaaaagggaattattgcgtcagcgagtagggttcgcggtggaccgagtgcacggcggcagctcacggaaacgaacggccgagatcgatcctatccacaacgaacggccaagatctaacggtctacgaccggtctacgacggacggcaacgatgacgtcggcaatgacgtcatcaccggcggcggctcgggcggcaagctcgccggcgaacaacggcgcgacgacgcgaacggaggacaccaactcgtagagggcaacgtggcgaacttaccggtgaccaaaacaacggcggaagatcaacggacggcgacggcgtcgaggaagaagcggcggcaaccttcggcttgacaacgacggcggtgctccggcgacctacggcgacggcgaaggggtggacgagatcggcgacggcttggtgaccacgacggcgacctcctcgagcagcgacgacgaccggagcgacggcggcgcacggctggagctgcggcggcgacggcggcgctaggctacacgatgctagggctctaccggcgacgagaggcgaaggcgagggtggcggcgggtagcgacgggcttgggggtccttttataggggctaggaggcagcgttgcaggcccacggtgaccggcgacggcgaaggaaggtctagggttcggggagagagacgaatccgattcgagatcgaatccacggatttacaaacgattttagcggacgatacaagggtccacatctg

SEQ ID NO: 78305 - DNA, 1443 bp, Oryza sativa
  unsure (1)..(1443): unsure at all n locations
cagagtgantncagattatttatagccaacttctcttgaaatttagaatcttaaaaatgaatatagtacaaacaatctcacatcgtctattggaacacaacaatggcatatttgtcacgcgcactgtctgagcgcctcgcgccaaacttgtgccatgcatcggcatgaaccatgacgcgtgcaagggccgctactagcgtcgcacactagatgtcgtactatgcactaactcgcaaacccgctataccgagcactggacgaatcatgctgcgctagcaacgcgccatgctactccgaccatgcgccataattgcatcggttgtataccttgtggtcgctccgaccatgcgccataattgcatcggttgtataccatgtagttgctttggtcacgcataccaccgaaccttcgatgtgcatcaaactgagcattacattaattcccacatatcttgaaaggtatgctcgaaaaagaaacggtaatactcacatacatatttagtcctttgaaaggatcatccgatacataatgcgcttatgaaatagctgcaattgtgtctatttgacactacgctcttcccaaaccaatctagcaagatcacacatattggcacctgcacaatgagaaaaagcactaggtaccggaaattggtaatgaaacctattatgggcaatattctcttcatacaacagaaactcattggcattgacctatggttgaaaatcaacctgcaagttgacctatagttgataatgaatggctaaagatatttttggattgagcactcgcatacaagtattaaaagccccaaaccaagatgatgatccgaatatcatcatataaaaaataaaagctcactcttttggaacgagtttaagataaaattgggagaaacctatgttgcttaggcctgtaagcctacaacatgtgaagagtgaaccatactatgttagaatatgaaaatacataagttccatggacatagttcgccatttctagcaagtaacatggttctaactttgtccaaaccccaaaatcattattaagaagataatgatatgtgtgtcgcatcagcactgatagactatacaaactctacaagtcatagacatgcaagatttgaccattggaacatcactcgcactatgtctgaaaaaaatgatacacgcaacgagttttgatggttcacacttaaaagagatgcaaaatttagggggatattttgcatgtctattaacaaaagcttgatctgaataatcaagtacccaaaaccaattacaaaaatcaaagcaataatttggatagaatttggtgcaaaagaagaaccctcacgcatcccacaacaacaacaacaagaaagtcaagcctgatgtcaaaccaaaggctactaccaattttaaggataaaggcaagggaaaggccaaggacagtgactatcttcg

SEQ ID NO: 78306 - DNA, 1635 bp, Oryza sativa
  unsure (1)..(1635): unsure at all n locations
gcccacccgaccggtatcaaacggaggtggcgaattaaatgcccnctcataaacaatggcgcggtctattcacctgtaaaatggccctaactanncccnnnnnnaaggagtgtggcactgtggaaagcaccccncanacgattgggagaaataacccgcctaggcaannnannncagccagggtcacatcatgatacgcacgacagtgcatcactacaagttttactaaacggtagaatgaagcgccggacaaagggggggagcaaaacgaggcacattaggggcacgcaccgaaacaaaagcagcagctgcggaaaaaggctatcctagcggggctaaaggtccactccacaggcaaaactcaactaggggctgagcctgggtcctcgaagtccgtcttcagctcagaagtactacacttctgaaaagggggaataaaagcaagactgagtacaaccaccgtactcagcaagccacaccaacgatacagatgtgcaaggggatacaaggatggtttgtggctatttgcataaaggcggttgtaaaacattttattgagcaaaacagtaaaactgttgagtaattaaagtaacattaaacctccactgatcaacgctacaccacgttgaacaggcccaaccaacccacctgaactacagtgtattgggtcgatttattaagatgggactaatcacggtgaatctggtcgaccgcccataaccgccggcacggctattcgaatagctttactctgatcagaggtgtacaactgtacccacaagacacagccccacgacacgtttccgtgtgccgacatgccaccacgacatactggaaagaggccgtgacaggacccttcgcataaccccctctagccaagcacaccacacctcaggtttcacccccgtccccagcgggcaacgggcagtcccctctcgtacctaggtgaatccggaagcgacagaagccgtcgcagggcccgccccgctccatcacgcccacccttgcctggatgcgtcagctagaggtaagctacactacaagcccagcccgtgcccacgctggcttgtgggaagtacgattagttctttcaaggcattccgcgaacccgtccctaactacccatggtgcgaccagcaaaaccatgcacccacaggccaacattcagtcgcaatttagtggataattacgaccatgaagcatggcncagagtctcgagcacgcagctctatctgatactaaaaagtctcatactgtatntnccatcaactggagctatggtattaagcatggctatncatatantctagtagtcacataagtacatgagcggcgagcacaatagtatacctggtncctgtatnggccaccctgctatttattggaacgccaaacatcataaaaatggtcaccactccaggggggaggtggatggctctttttncactgactttgaaatttttcttgggaaaccaattccaaaagagttttaactctgccccaacggggaaacttttttaccccgggatgtctaagaggaacacaccgcggctcttttaaaattttagtggggggtcatcggtcgagaaaaaaataaattaaattgcccctaagtttttaattataacaaatggt

SEQ ID NO: 78307 - DNA, 542 bp, Oryza sativa
tctttaactagtacaaaattggaaggaactcagcatatattaattgttgaagattactattgaacaaaaccaaaaggaattgttgaaccaataataacagtgatacaaatataacactttggtttttaaggatagaaaaaacaagtgatctaaacatcgtatgcctacagttatccattcagtgtctcaacaaaaatagaatagaaacaacagtgtcacatcttaccctgagcacctctgtggcattgcctgcactgtagccattgcaaatctggtattccccttgcaagccataaatattatttactacaaagactgatgggtcatcatttccccaatttgtgctagcaccatgatctgcagtgactgaacccatggccttcacctaacatctcaaaaggagaaatatatttacaattgacgatgcagttaatctaatagaagtacgtgcgactgaaagaaaccttaaaaaaaatgatttgcataactactacacaacttgcccgctttatcaaaccaaatgcagttctcgaatagccaca

SEQ ID NO: 78308 - DNA, 2139 bp, Oryza sativa
  unsure (1)..(2139): unsure at all n locations
atcccagtttataaaattattttgatttaagttaatgcattatcgctttatttaaattcccgcgttatcactgttttatttagccatgcctatttacctttgttatgaccttattattattgttattgttattattagcttattcaccctaggataaacaaaaccccaactagtgggtactctattcatggttccactagtatgaacttaggtagatgcttcgctgattaattaggcaacattaggtggttttataaccttagactttgggaattctcatatcacttggacattgtggaatggttggactattgtggaattggattcacacctccccctctattcaaaaccctcaaaatagttttaggctgggctcggggtgcatggttttgatagtagcacctcggccacataaggaccggtcttcgggcctctgttgcaaagcaataccgtacttccacatgtctagtgggtaaggcttagtttgtgactcagtctggttataaacaaaagtacacggatggagatggacgaagtcgggggtcgatggacatctctaggacaaatgaaggctacacgagctgcggctcggtagtcgagatgtcatggcacagggcgggtgtcctgctgctaggggctcaatcctgcctgcctgtcccggaggttccggccgtaggtggggttgggtcggtactcttgtctatggctaggatgggttggaaactatgtcatgtcttccgtccgtatgccgtggtggtatgtggcacgtggttatatgtgaggaagacatgtcttgtgggtaaagatgtacacctctgatcagagtatcacctattcgaatagccgcgtccttggttatgggcaagcctagcaatgtacctaagttagtgttttaaattcttaacacctgttgaacaactaaaatatggaatggatggcctgggttgacttgggacgagttgggaccctgggtcgggttgctagttcggtttgaatcatcgcaggccttgggttaaggcaggttcgtgtgggtccacggccttgattaataatattgtatagctctaggatcgtattaacaaaatagctttgagcaactaagtgtcttttaatgctgtttactgcaaaccctaacccccctatattataactccattgtactcctttgcatttattctgcactcgtgggtgtgtcttgttgagtacggtggttgtactcagtcttgctcaatttttcccaaacccagaagaggagttcctataagatgtaggctttggtatctagctcgtgcctgccgtcaagcgcctgtggtcgtcgccctagtcttccgctgttttttgtttgtcttcatgtgtgctggtccttcgccgcccatgtaataaattaactatttacgcttccacttgttaaactctgtattgtatcaacttttggtgtaccttgcctcctgggacaaggaataatacacgcacgtaaggaacgcccgttgggttatttctggtcatgacactagtgtaacgccccgattttagttcggaattaaaaatcaattaataatgcatttcaagaaattatataaaatttaaatcaatttaatcaagtgaaattatagaggaaattaaattttcctttaaaaatcattggccgagaatattttgtaatattctttgtgccctaatgtactctgcggattttttccgcaaattttcggagctcaagaaatagttttaatagcacaaagatcattgcatcaattaaaataaaaagaaaacaaataaaaatctccttttcctcttctttggncgnnggngcagtncanncnggcgngcgcacccttnctcttgtggtncagnncaagncgnnccttcctttttcccnggacgncacaggtgggccccactgtnnggccngnntcttnnctcannncgggcgcgngccngnaaccggncgcgngtcacgtttncgctttttcaagcacgtaacacagccccgcgtgtgcgctatttccgaaccaatttttanttttttttcggnccgcaccggccccgggcagaagagcggaataaaatttgaattcgncccctttctctccctatcagatgtgcgggaattcgccntaacggcaaaatcgggttcct

SEQ ID NO: 78309 - DNA, 630 bp, Oryza sativa
ctctcttatggaatgctggttggcatcaataacctttttcccacttgaaacccctccaaaacggcctggaaaccctgaaatcgcatgagatctcgccctatttggcatggggttaaaattccccaggcgaaaacgggtgccatgaactgtccctaatgccccgtgtaaataaaaacggcggaaattacccagggttggtgttaccaaaacaatatttcatcaaccccttggggatacggcgagttttcccggtcaaccccctttctgtgatttatgtggataaacccgcggaacactgcggggtatcactctcagacgggaaaaacgctcactctgtccttgacaatcgggtgactccggtgataactctctctattatccaccttcctcgtttctagcgccttttattctcgcaacaatcatccgcgtcgcaaaacttaataacggccgcaaacaatggcgtctctttttcggcggcacaaaaggccatatataccctcacgcgtctgatttagcaacgccccatcgcgtaaatccacaaactctttcaagcactcggatataaacactgagcggcgctgctagtattcaaggatcgctcttctttacatgcggatcttatcactcgcc

SEQ ID NO: 78310 - DNA, 2083 bp, Oryza sativa
  unsure (1)..(2083): unsure at all n locations
cttcttatccttcccccttttcgttctttcttcccctcttctcgagaaaagtgcacagtaagtagatgggtagcgattggcgcgcgcggtggctgacagagccgacgacggaatcttcgtgcgcttcaacatgtcaccaaggttgggttgtgggcacggtaagccggaaacccccggcttatcgaacggacggcatggtcaccgcaccggcgacacggccccgtggtggatgtccgagcacagctcccgccacaccagctcgagcgtttggagcgcgaccacgacggtgaatgtccgcagcggaccccgacctcgattgcttgatccctacagcacatcgtcggcgacgatacctcccccatcctcaccgccaagcccatcaccacggtctccaaagggttggttggttaattggtggtagtagcaaagcctatggcctccggtgatcagcttgctcaagctcatgctcgtggtgtgcctccgtgtagcactggcacgacgcaggggaagggcaagtacctgctgttaaagggaaaattggaatcatgtcattataattttataaaatttaagatatgctattctgacccacatgtcattgactcatgtgggtcctacatgttattgagataccgatgacatatctcaaacttagctaaattataatggcatggttctaatttacccgctgttaaatgacgagctcgtctgatcgttgatatggttttaccgaacatccaccatctcgttcatgaacaggtgggtaccacacattgtcgctacagtgttttttcttttttttaagttattttattacctgtcgaactgccctatcgaactgccccagtttgacaggtacccttttgaactgccccagttcgacagggtgctaaacttacgattttgtctaaccgacctataattttgtgattttctattaaaataatattatttccacaaaaaattcactatacataacggaagcaggcgaagctaatccagctgccatgtgtaagtgcacaagtgcataggatcctagctaatagtaatacctgaaataagaggcggtagacggcagcggcagcggcagcagcagcggcgctaggcgatcgcagagtcatgctgcacctcgtgccctactgccatcgaccgttgtgcggagtagtggaaggaaaatgggaagccggccgccggcgctccgatgcgtggccttgcgctgttgcgccgcgcgaattcggcgccgtgaggagaagatcagaagacgtgggcggtggcaatcgcggcatcgtgttctattcgccttctgcttgtggctttcgcgcacaatgcgtttgttcgccttcgtgctgggccaggcctcaggcctgaagatgcctggggtttgggacgggaggccccaccaccccagggggggggggcggcgtgctctggggtggccatgctgtggtacgcataggatgtttgtcttgacgtgcaaacataggttcaaagacgacgcctttcctgtttctctgatctcataaaacctgagtagtcaataagaagaagctaagncattactaaaatttcgaattcacttctatattatgtaaaaggcctgatataggcatgtaattttacccaaaaacttctacaatatacaaaccggtactttgatattgaacatctttctaaaaaaacgtaattttcgagtacattaaaggtacgtgctcatgttttcaaaacaggagaagtttgcatccatttcttagagaacctaatattaccctccctcccctaacacaaaggaataagtttggtttccagttgacccttattaatcaattttttgaaattaaaaaaagaaatgggctaagaccgtnnataatagtggcccaataaatatattatttaaaaattggaataaacatttgaactcagaaaaaatcaaacctctttgggggggggggttttctcaaaaatcaccttttataagaataaagggggggtgggaactttgggggggtttttcgggccaacaaagagggtttttttaaaacaaatatttttttgcttcttcgccgggaaaattaaaaacggatta

SEQ ID NO: 78311 - DNA, 763 bp, Oryza sativa
tttttatcggccggctttccccggtactagttgttgtctatgggaagaagctagtcaaagaacatctcagttctcagaataggaggccccccccagtgaagccggggaatcattggacctggggggtttgactaaaaaacatctgggtctgcaagggtatatcgaccatgctggtgtttcatcctaccatgtcccatggtggtgtttcatgcattgtttcatcctcctactccttggagttatggtagaagtcgacgcaggtctggcacccgcagtcggtgaagcggcagatctcgcacccgaagcacacgcacttcacgcagccggtgcacgacgtggagcgggagcagcctctcagcaccttgcggctcgcgcgctcctcctcatcgccgcaggtgaccctggtgggatcaatcaaggttatatatatatgcaaatgtacacaagaacaaagcaaatatatgaaatatggaaaaccaagaaatgtcaaactgaggatggaaggaacacagaacaggtaacggtgcataaaagtacactactggtcactaggcaaagcaatgcttcttttttaaaggaaaatttaatgtaaacattgcagccaaatttagaatgcatgtactcatgttactgaaggaacagcacccttcagcgatcctagaaaattttccctacatgctactgaatgctacagggatacagtactgaatgtgtcctgtggctacaggccgcatgagtacatgaccctgcagagatctggaag

SEQ ID NO: 78312 - DNA, 1410 bp, Oryza sativa
cctatatcctttttcctgctcaactgagaaccgacagcttttgctgccaacggtgatgtccaagccttctggagatcttcttggcaatctctagcttctcgcgcagccaaggatcactggtttcagctccagaaaaggcatggcttttgaagattgtcaagaaatcagtatctttcaagctttccagaggaaaaattttcttgcagtcaagaacagctggaagtgcattccggcgggacgttactagaattttgcttcccctctgcagagaagctataggagctaacagttgctcccagtcccactctgtctcacttttggattcgtcaaaccaaacatcatccaacactagcaggaacttctctgattcttgcaatatgtcccttaatttgcactgaagggtatcgagattgccaatacgtgggcactcgccctttccagcggactcaatgatctcttgcgtgtgacgatgcacatcaagtttgcgcgagatgcagacccaaatcctggcatcaaaatactgagccaccctttcatcattgtagacatgctgagctagtgtagtttttcccataccaccaactccaacaattgccagagatgagtaccacctagccatgctacctccggcattcacaggcttacagagaatatcaattatacgatcacgatcctcgtcgcgaccaacaacatttgatgaggaaaaggaagtggtggtgttaggcctgatgggtgctgtgaccataagttctgtcgaattgccagcttgtatgccaagctgatcgtgaaaagccttagcttccaccaagatttccttcagttcttcgagcttgctgattagcttcctgttcttagggcgcaaattggacatcttgttggatgcagcatgcagaggctttggaacggaattagaggaggcaaccatcaacgatgcttgtgcgcctttctctgctacacgcttgaggatgtcatactcgagctcatccagcacatcttcagtgtcatagaaagctgctttcagtttgcgcagccacctttcgatcttgcccttatggggactcttctcggctgcttcgatcaccagctgaaactgtggcaggatggtggcctccagttcttggagctcacacaccatgtccttgccaaggtaggttgaggcgcggttgatgaacttggtgatgatcggtgataccacccatcctaaggcagccagcgctgctgcctccgccaaggaaccgtaacagatgttcccttggtttaatagtctcgtggctgctgcttctcagagtggaaagagcagcacatgaccaaaggactttctggacttcaggcctataatcaaagaagcaaaagtgagagatgagaacctgggagttatcagagccaaggatgaagattagtgctctcaaa

SEQ ID NO: 78313 - DNA, 51923 bp, Oryza sativa
ttcatacatggagtgaggagatatatgggttcgggatctcagaatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacatggtgaaggaacaacaagcaggcgcgcaaggccaaggcgtcgtcgcgcagcaggcgattccatggtgtaacaatgctatcgatttaggaaataaaacgctgttgtgatgtgatgtgtgttcggactaaatacttatatcgtgtaatttcaattgaatgttgttgtaatgagtacctccgactattgttgtactagtagtattgcgaactattcggtgttgtatcataatgttatcgtgatgagtgttcggactagtaactgcagctattgttgtaatcagaaatattccgtatggtgacacttttgtttgtttgtactcttgtttaatatgtgttagtaattcgcttatgaacatttattacttatgttgactaattatttatatgtttctgaccaatctatttgatgcaggtatggcgtacgacacaccggcgctgttgaaccgtgggattgacaggaaccaccgctcgttcctgtcagcagtcgagggtgcacagctcgacaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcaggtagaccgctggagacctgagacgcacacgttccaccttccctgtggggagatggctccgacactgcaggacgtgtcgtacctgctcgggctaccgctggcgggagcaccagttggtcccgtggacggtgttgttgggtggaaggaggatatcactgcgcgcttcgagccacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctacgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgatacttacttcatcgagccatataatttacctcggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctgtttcgcacggtactgctcagcccagaggtttcttaagttttgtttatgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacaaggtactttactttttattaatactattaaatacatgtatgaaactgatggtccttgtccagtaggatttgcagccgggatcttcggtactggggcctcttcgtctcacgccggtaggactggtcctactagccagttctacgacgacgacttgcacggtgcacatcaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcctctacatagttcttttcattcatatggtgctagaacaacttatgctcacgacaacacactttcgtacaatggattgacacagtcagagttacttcaagtggcgggccgataacgcaacctgaaccgaccatacagttcattcatacttggatggagtacgaacgtcgggtggaaattgcaagcttagactggaggaacaatccattagggttacataaatggtccgagcgtccaaagtgtgggtgcagggatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttaagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaatagaccctaaaaaataataaaattgtattttaccagtcttggagattttaatcttgtataattttcaatataaaaaaaattgataactattgatatttataaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaattcccgcgttgcggcgttggcacgaaagatttgtactccagacctccagttccttcgcaaatgtagcacccgtaacgacagttgatcaaacattccgtcgatcaattttgacgtgtttggagctgaggtatactagctaacccaagctggtgattggtatgtttcgcagcagcagtgaacgcgaccacgtttggcgccctcaattggtagtcccctaaccttttcatttcccggtctttcaagtctctttcgtatggaaaatatgctgctctgaactccaaccatgagttgtaaaaaaaaaaaaaaaagtccaattgagaactacaccggccggctaccagtctccatcctcgcttcgtgacattccacattaacctcagtgcacgtgcaccgtgcccacgactactgtatgcgactgcaacccactgcacaaaattagtacttttagtctggcgatagatctcaacaaatgcatttacgaaagatttactacgaagagatcgattggtcgaaacagcggatattttaatttgcagatgggcagatggtctgttgtattgtcctttttttttttctggagtccgtacatatcgcaacgtgcagccggactcttttccatttcattggattattgcagcggccgattaatggctccgagcttttacggtgtttataaggtacttcgaaatactaagagataggataatgtataccgttgattaagagagatgcaagatataaaataaaattatcgtaaacgatagcagtggggaaataactagtcaaatatggtattttctgtgagtcgagaatagttagctccatgtgattagtatcgttcattaggaagcaaactaaatcttcaaagatttagtggattgtattgtttgatagaaataaagtaaattttccgcaaatttagtggattgaattgatctgcatggggaaaaaaaacaagattgatgtatcatttgttctcctccaccgcttcgttcttgtccatggtcatgcttccatcctgccatcaagctccaatgcttccaaccactcccgcaccactttcgtcaataagttcaggaaaacggaatccctatcagttgggacgcgtggtgatgcgcttaggtgcccgcaaataccaactgaagcttgctacatgccattctttctttccctgactcatgcccttaggttgtcctttgtgcctgccttcacttcccgggggtgcgttgtgccacgggacatgtcttaccgccatcaccatcatcatacaaccaccaccagaacctcaacgcccttagcctcctcctcccatttgcccaagcttggacgagaagaagaagatgaacagtgttagggcactgtttcttctcggttgggtccaaccaactcccaaggactcccatgttattagataccaaatatatatcacaaaaaacacgtaaatgacacaataaaggatcatagaagataaaataccaatgcggtacctatgtaactagagctaatatttagacaattatacccttctccatttcaaaaaaaaaatatttttacccttcctacctaaataactataagttataacaatactcaaatactttttaagtggtatctttcattgtggagcgttggatgtttatcctttttaatacaaacacagtatgttttctcaagattttatttatcgtctattgtactgcttggatcaattggattttatttatcgtctattgtactgtttggatcaattgttctatgtagattatttttaaaaaatatttaatttcccccctacgatgaacaacaaaatctgcccgtcatcgtgtaaataatttaactcaccatgaaatcgtgagactggatcacatgcggcgtactttacttgtgttaaccgatggagaatccttgtttactccgtgttactactactccacccgtccagcgtcgtggacctcgtggtacgtaggagtacacgcagttaccgttcagtacttaaccccgtacgctgatctgcactgctccgcgctgcgctgtgcaactgttgcgacacatggcatggggcagagctactcgaaacgcgacgagtcttcccatttggcgacgggtatagccccgatgtgacgcgaccagaagggctcgatccgtcacttccacgagtagttccattcacggcgaagctgatgttcccgcggtgggttggtcttggccgacgaccggccggtggccagcctcacgtttcgatcacctgggcgcgacagatcggttcttgccgcatgctgatgtaacggtactgggtggtacgcgtacgggcggagtttctgtcaccgtccgtcggtccgtgccagagatctcgcgacgcgcgacgcgcgcgtgcacgggccgaccaggcgtcgccgcgctctgttgcttgacacgatcgggactgcgtccgcatgcgcgccgagcgtgacgccacggcgaccggcacgggacgagtggacgacaggtacgcagcattgcagcgttcgaacgaaacccagccgggataacaaagagatcgcctgacttacctggagagcacgcgctatccgaacgattgagaccaattttaggtagtgtttggttgctgggatgaggtgggatgggttggtccctagagaggaatatttctctcagatccgggaccaactcatccggccaaaactggcggactgggacgagcgaacggcgtgacgacgctgctcgcgcacttgccctgctcgccctcaggagacggcggcgggctcatcgacggcggcggcaacaggctcggcagcagcggtggcgacaggctcaggtgacagcggcaggctccacggcggcggtaagccacaggctcggcaacaccggatcttgtggtggggaaatcggcggcgctggatctaacgatggggagggctcgggcggcggaagatggctcgggcgacggcggaaggctccacggcggcggatccaacgatggggagggctgcgccgacggaagacggctcgggcgacggcggcaggctcggcggcgacggtggagacaagctcggcagcggcggcgttgaggggctcggcggcaccggatcctgtggtggggaaggcggcggcggcggatccgacgatagggagggctgcgccgacggatccggcggcggcccgaccgtccgtcatcgtccccgaagctcttggcgtcatcgtcccatagcttcacgtcccttcgtcggcccgaaggtcgacgccatcacccgccgcatcgcgtcccttcgcgaccgcagctcggtggcggagatggaggtgagggcagaggcggcggcggccatagttgttgccaacggcgtcttcagtggtggcaaacggcgtccatcaaatccctccctcatcccttcaaccaaataaaaaactgcgatcgtcctattctataaaccaaacacgtaagtagaatcatcccaacctcaaaataatggatggtttcatcccatcctatctagttttagaaccaaacactaccttattttcggaacaactgaatatggatatggaccgtgtacgcgcccgccgcacacttgcactccccgccgttgaacagtcggagtgtaaactttaaagagcgttgagcgagctgtaaaaattagcaagtgacggggaagtaaagtacccacggtacggtagctgaggagacacaaaatgtcttcggatgcctgaaccttacagcagtgcgcagttgtgcttgtgcaccaactcgtgtgagtccttttggtgcctgaccacgagtaaggtgttttagtttttcttaatttaagggagtagctatatttgtgacgtcatatttttcatcaaaaaataattagcatgtatttacattgtaagtccctaaattacatatgtaaatttagtgtatttataatgtaagtttcaaaattacatatgtaagtctaaaaattacacagtaattatatgtgtaagtggtgtgtaagtgggatttaagtggggtgtaaatttgtataaagtatagtatgcatgcgtgtaaaaccttgaactaatgaagacgttaagctttaattaatcaattaatcatgttgacagcctcaacgttagcctgccatagcaatatgcacggacaggatcgcattgacacgggataaaggaaatcggacgcttcaaaacgccgactgtgatggaggagaaaatgtgtcgatacaattctagcaatttcgtaatttaatcagtataagatccggtaccaacaggcattagctgatggcctggtgtcgatatggtgccaacataggatagaaatatgacaccttatagtactatttaacaaatatagtaaggccctgtttatccagggatgaaaagtttcgacgtgtcacataggatatagaccgcctgtattaaacgtagactaataatataacagattaataatatccagggatatacagatacacatttaaagtattaaacgtagactaataatataacaaattacagattccacctgtaaactacgagatgaatttattaagtccaattaatctgtcattaacaattgtttattgtagcaccacattgtcaaatcatgtagcaattaggcttaaatgattcgtctcgtaatttacacgtaatttgtgtaattagttattttttatttatatttaatactccatgcatgtgtctacacattcgatgtggcaggatgaaacttttgccaggagatctaaacaggccctaaatatttctggtttgtatacatgcttttatattgtattaacagtacctaagtagtcgagatactctgtattcctgttgaattgtcttaaaacaatgagaaaatctatcctgtatcactgactttgccctggaaccacaatctgccactgactttgttcagttccatactatgccatcgctttttgtttaacttctataatttaccatcgccgtcaagttagcctccgttagtaccatacaattttgttctaatgacaaaaatacccctaagatgaaaactttcagaatttggttgaaaattcacaaatatcatactgtaacatgttacagaggttgcccggctcattttcttctatgatgatacatgattatctaagcatacatatgattgttttagcaacttgtttgacggaatgttgcacttacaaaaagtatatctctgtgtatgtgtgtaggttcaaagcaggttaattaggtacatgattcccatgcatacatgtacgagtgcgagcacctgccggacttttggtcgtcgcatccctgtgtacacttaattagaattctatcaatacgtacgtatgtatgcggtcgccacgggcttgtgtaccacggacacagcctgcagtgcacgtgtacttctggccgtaattgaggcgggcatgaaaatgaaaatagattgggttaattttaggatttttgttcaggggtattttggtcattagtataaaattgtacagtgctaatggagacttaactaacggcgatggtaaatcatagaagttaaacaaaaagtgatgatatattatggaattaaacaaagtcagtggcagattgttgaactagactaaagtcagtggtgtatagtagattctctctacaatcccgttgaatttctgagaaaaaaaatgtttcgctccaaataaagccgggctccttatggtttgtggagatgatccgctctctgtttaagcatcttcgtacaatgaagagggattagaacccaattgaaaacatgatcaaacatcaattgacgggtgattgatcaattcaattccaagagtccaaacagataattcgagtgctgagctataattgcaaacatacttttccgatgtgcagacgataattaagtcacactgtgcactcaaactgtactccctccatttaaaaaaacgaatctattattatatgacaccacataatacaacagatttaaacaaatatatattacatatattattaggttgattttttttagagttaattgtatattggaccactaatatttaccttggttgcacattggactagaggtaaatctatcttttcacattgggcctgctaaatctacaatagttatatattgaaccggtattcttctccaactctcttctccgttgagttgaattgtacccaatttgtaaagtctccatacctgtcatctagctcaaggtcgctaccacaaatgagcaaggctctgggagaccaggaccttgagtgagctgctgccggctggcgatcaagcccctgccctacgctgcatcaagctcgaccttgcactggagctacattgagcgttgcctcgtactcgagctcactattggcggtgagcagaccatccagatcgcgccaccaatctagcttgacctcctccgatccctgcctgcgcactggagctcaagtttgagctcgaccttcgtcagctctggccactcggtcgatctcgctcgcacccatccctgcatcaagctcaaccctcctggtcctgcaatctctcaagctaaacctccatccaacaagctgttgcaagggagaagttgatggtgagtagctacgattaggttgagtaagcgttgcctgagctccttcgtagatatccgtcccaaaaagactcaattcttgggtttccgtgttcaatgtttgaccgtccgtcttatatgaactttttttatgattagtattttcattattgttagatgataaaatatgaataataatttatgcatgacctacctatttaaatttcttcaaataagacgaacggtcaaatgttaaatactagaacccagaaattgagttttttttttgggacgaagggagtatccgttaattgttggccaccagtgttcgagagagataagggatactgacactgactgacatgtgggccactagtgttaagtgaatttttggtaataatacctagcccaaaatgaaaagttgtgctaccacccagttcatcatgcaacaaaggtaataaaaactagtccattataaaatttactcttttttataggacagagtgagtggagtacctagagggagtacctagtactcccttcatctacttttaattgtcatatttccaaatctgaaaattttatttttgataggtatatttcaattcaagaacttatcatcttaataactttctcggatttaatacgtgactctccattcttccatacaagattagctacatgggcatcgagacatgtaaatattaatgaatcgtttgtttacgaggagtagaattacttatccttcatctgtgtgtcaggataaaatataacaatcaaaaatagatggagggagtagcatcttgcaagaaaacagatcagtgctacctatggacgcattgcagcactcctagacaggctaaacctcccgtacgtcatgcttcacacaaatcttcggtcgaatctactcctatatgactgcacatgtgctcgttagtctcacacttgacccgagaaagaccagctagatacagtactactagtcactgcccaaggcatgtctgcgtctccctcttggaccatgtactagctccccttggttggacccctcggtgctgtgtactcactccgtcaaaaaaaaaaaaaaaaagacaaatcctactttccgtatccaatgtttgaccgtccgtcttatttaaaaaaattatgaaaaaaattaaaaaaataagtcacgcataaagtattaatcatgttttatcatataacaacaataaaaatactaattataaaaaattttcatataagacggacaatcaaacattggcacgaaaacccacggtttgtctttttttaggacggagggagtaacttctggcaagtatcacagccttttcggggttgcacatgcgagcctttacgactatccctacttctccatgggcaggaataactttagggcttattaggatcacggtactgcaaaaacgtaggagtagaaaaatcgtaagaatatgatagaaatatatgtgtaaaacagaggattgaaaaacacaaaaattctgtagataggattggtaaatatgtgttcggataggcagaggaaaaacataggaaatggaaaaaataagatacgagtggatggaaattttcctttgtttctctattgattccacatgaaaggaatttttcctcttattttcctttgggttgattcctatggactgaatgtcaggaaaggaaatatttcctatatatagtattcccttgaaaatccttaaaaaatccttccatccgaagaggccctcaggaggttttggcgctggaccaactgacgtactagtactagtcacgtagtagttccccgcttcccactgagcaatcacaattcacacacgagtgaagtgaagtgacgaagggaggactcaggcgaggatgcaaagatatggtaaatagagggagtacgttgctagtgccactgttctttctcgctgatgtattaaacccgatcgatcgatgcatgcagtggtggcctttgcctggattcggagagagatctgacgccgctacagtggccagtgggagggctacaagacagctgtgaagccgaaccgtcccttcgcgtcgcggcaccggccggcttcgactgaccctgccttccagcttcctaaatctggccggctgatcagcctccgctctacagctgctgccgcggcgtgcggcttgaaaaggagctggtttttgggggaggcgccaatggcgagctcgggggggaggtggaggcggagcggcagttccatgctaaagctggtggtggccttgtgcttcttcgctgtggccatctccctgtgttgcgtctgcctcagctcgggttgcggtggcagtggctgtggtggattcaggcggcgcgctgtgctgctccgtttaggtaatgaaattcagcgagctgcatccttctgcgcacttgtttactccattttggtattctccagttcactggctaattctggccacaacctgcttgttgggtgtttcatttcgtttggttctgtatgtttgtcgtcgtggttcatatgttcactgctcatgctgatgcgagttcttcgtttctgaaattcaatctggataagttcattgcaggctttaagttgaaaatactgctataatgtttttgtttcactgtattactcctatatcggtaccatatagtatatcggttgaaatgttcaaatcactctgtaataatccgtgttatcgtgttttctgcagatttccggacacgagcaacagcatattttggcgctaatcaggtgagttttgcatctcctcccccttgctatccactctacatgcccgctaccataagttcgcatcgatcaatgcagttcaacttcaaactgcaaaatgatgaaacgacgcgatttattgttgtttatctggccctcaatcatctttcatcagttgttgattcgcgatcgatgacaagtcgaaatcaacacagaacactaggcaacctcacagggtccgcaatggcagtccccattagcgcgcacagtcacggccatgaaagctggcgtccttctccgacagccgttcaacgccggcggtcccatcgccttttgaccatacgtctctgccgatcgatgcgtagtagtacatccaaacgtagcacgccggcacgccgcgcgtcacagcgatacgtgaaaacggtgaaaggttgaaggacggtgatacgtaaatccattgtgttttgtgttgtagcaggatcacagctcgagcgggcgtcgatggcggcggctgctggcggagggcccggggtcgtacccgccgcggtgcacggccaagtgcggcgcctgcgtcccgtgctacccggtgcacgtcgccgtgccgcccggcgtcccggtcaccaccgagtactacccggaggcgtggcggtgcaagtgcggcaaccggctctacatgccatgacgggcagagcgtgcacggcggggtgacgctccggtggcgaagcgatttgcgcgagggtggcgcgcggtggccggtgggcgtgccgggccgaggtactagcacagtacagcagtgcactgctgcccgatcgaagcggccgtcgcgcatggggccgtttcattattgcgatgcgggccgggagcacagtggcagtgtggactgttgccgcgcccgcgcgcgaatcgggtggaggcgcgcgtgatgatggcctactgggctgctgggctctggaatttgcgcggccctaccacgaggagcggtggcatggggttgtacggcgcgtgctgcaaagggaagcgagaaggggagcacgaggcagttgctcgctgcacgtgtccaggcaatctgttgatatgttttggttcttcctccttgtccatttggatttggatcttcgaaatcccatttgtatctttgtgagaaatgatagtcgttataggccatttatgttaaatttcagcattattcttaccgggcttcaacagcatacatgagtacatgacatgtgttggtttcttctagcagcatggaacagttggaagtgtttgtttagggtatgattgtgaagtgctcgacgttcaatcatgttagtgttttacgtttggagaacgaagaaatgagtgttgctgtttggtgtgtacttgtacgagaccctcacatttgaaggcccatcaatgttgctggtaccacccagcccaactattgatgataggaataagttcactggaaatcactacatctaaactatcacaaaccgtgccaaaaaaataaaaaaggtcccgagcagtattgacctaatttttctcctgttttgctgacgtggtatacatggaccccacatgtaagtgagaaggaaaaaatatggggtccgcatatccttttttctcttctctttctcttctctttctcagcgagctggaaggctgggaggccgccgctggctgagggcagagcggcggcgggtggcactttgttgcgattcgcatcattccatgcaacggcacggccttagcctccatcatcccaacaccatgcatcagcgtagccttggccttggcggtagcgggagccgcgctggtcatcgtcgttggtggtggttgcggggacgtcagggtgcgcgaagacgctgaggtagacaacggatgcgagttagctcacgacggtggagaactcatggtcgccgaggggccgctccctatcgctgcagaggagcaggccgcaacatcggcacgccctcggcctcggcggcgggttcttcgtcgacctcctccgtcccatcccaacgcaagccgaggcggcgctgctgtggctgcggacgatgtcaacgtagacctcgacatctttgtgagagagctcgcgaaggtcggtagagctgttgtcacagaggatggcggtggcagcgatagctcccccgacgccatcccacggtggcagctcgctcgccgcccctgaccgctatgcaccagtctccagcctcgcccaagaagagaagaaaggagaagaaagaaaaaagaagagaaaagagatgcggaccccacatatttccttctcacttacatatggggcccatatattccacgttagcgaaaccgaagaagaattggatcgatactgctcgggacttttttttttttgcacggtttgtgatagttgagggctatagataacccgacgcgaagttgagggacggctgttgaacttattcctgcggataaggattactttgatgggctaaatcctatcgcgtgcgatacacggatctgatgtccttgcattttcagcccatttactatctagaagaggttgatgccttgatggcctttctctccccatggccacgatccgacgaaccctgttttcctaccacaaataggtcggatggccacagacgaattgtgacgatggttcgtggtagcatactatacgagtacacacgacgcatcaaggtagtggctatagagaggcacacgacaaaacgtcacagctatacaacaagagatggcaacaagcaacgccaatagatggcagagccgttgcctgctttttttttttctggccttggtgggagatgatacattagatacgacgagggaaaaaaaaaacaacaaacaagccaaccaacgaaagcgtaggaggctaggagccgttccgccactgaaagagcacggatgacgcactaaccggcggcggggcagacgtgacgctcgtattagcgacccggcacgcggcgccctcttgtccgcccagcgcgacaccgccctctgccctctcgcgagttacgtgaaagcgcccgcgggcctctcgcggtcgtccgttgaggtggcgtggaagccacgaacggtggaacgcgcgacagctcgcgctcttctccccccatcgtcgtccgttcctcgtcagcgtcgagggtcgcgctttcgtttactcacgcattccgacgaaccagccgttaacgacctcggcctcgacccttgtattccggatgatttaccttgctgccatcgctctttttgcgacctgattggagtaatacccggaccccaacggcaagaattgatagtttgaacagcatacagcaacagtcattggccaaaacctctcatcttttttgcttcctcgtactccgtttccgttctgggagaagcccagcgaaaatctcacaattgggccatgggccaggcagccagcgatatttacctgtccaaagcctacgcatccgcagcacaaccacccccagaatcccgtggaatcagtcgagattaggggcaaaaacgtgagaaaagccacccgtttcctcaccgcgacagctagacggccgcgcactacctgcctgcctcctagtagtgggggagcgcgcggcgcgccgtcgtataacctcgcgctgagagcggagcggaatcggaagatcccgaggggtcaagccacaaaagttcggcgccaaccgtgaggaagaaatctgagagcgccgggcaggcggagcagcataaactagaacggaggaagctcccgcggcggagaggaagcggcgtccatttgctgtccgcgaggtcgtgcctgatcggttcagatgggttcgtctgcggttcgctgcccgtcttcgtccagttcctgatcaggtatggtccttctcccccccgaagagatctgcttgtcgtcagatttcgattccactgcgactgggtggaatttgtgcgatttagtgtttcctattgagtgtaggcaactgatgatctgtcagaacgtagtctctgttaacatcaagtaggaattcgccactacttttatttttcagaatccaaatggggacatttcgtcgcaatccaatcgttcaacgtgtactttgatcgccgatatgtgcttcccgcatttttaggttgattgacagcattagggcatccgtccgatagtctgtctgggttggtgctgaagtcatataatgaaattgggggtgacatacctgtgatgtttgccggtggctcttataacagtactaaattaccgtgtagcatttgagattttaacatccatttggatttggattacatttcctgtgtaggtgtactaaaattcagtttgttctttctaatgacagctcttaacaggcagaggacttgggaatgcagaaagatgtgcttgcacgacaggaagttaatatttcgtgcaaacaagatcccagcttggatcaagccgatgttgctggaccttcatgtgaatgtgctgcatagtgataccgtgctgcttttccgtgttttgaagcatagtagattgaaggactccaagtttgttgatcatcacattgacgacgacggataacatctgctgcattcattacctatactttgtagatacttctatagaagtggtgtggtggtgtttgctcattttgttgtgttccaataacttgatatgatggatgggaggtcaatcttgatgggccgttatgaggttgggaagcaattaggacaaggaacatttgcaaaggtgtattatgcacgaaatcttactaccggccaagctgttgccataaagatgatcaacaaggataaggtcatgaaagttgggctaatggagcaaataaagagggagatttcaattatgagattggtgaaacatccaaatgttcttcagttatttgaggttatggctagcaagagcaagatttattttgttctggagtatgctaaaggtggtgagcttttcaacaaaattgctaaggagggaaagctcagtgaggattctgcgaggagatatttccaccaattgatcaatgcagttgactattgccatagtcgaggtgtttatcatcgtgacttaaagcctgaaaatctgctcctggatgagaatgaaaaccttaaagtctcagattttggtttaagtgccctggctgagtccaagaggcaagatggtctcctgcatactacatgtggaactccagcttatgttgctcctgaagttcttagcaggaaaggctatgatggtgcaaaggcagatgtatggtcttgtggagtaattttgtttgtgcttgtggctggttaccttcctttccatgatccaaatttgatagagatgtacagaaagatttgcagagcagacttcagatgccctcgttacttttctgctgagctgaaggatcttatacataaaatccttgattcagatccaagtactaggatttctatcccaaggataaagagaagtacttggtacagaaaaccagttgaaataaatgctaaaaacagtgaggcagccacaacaaacagcatctcttcaggtgtagctacaacctcaggttctgcagagtgcagcacttctgaggaaaatcaagggtccttaagcctcccaaacctgaatgcatttgacataatttctctctcaacagggtttaatctatctgggttttttgaggatacgcatggtcaccaggaagaacggtttaccactaggcagcctgtgacaacagtacttggaaagctgaaggaattggccaaacgcctgaaactaaaagttaagaagaaggataatggagttttgagattggcagcaccaaaggaaggaaagaagggctttcttgaacttgatgcagagatttttgaggtcaccccttcattcctcttagttgagttgaaaaagaccaacggggatactatggagtatcgaaagctggtcaaagaagatataaggccagcactcaaggatattgtttgggtgtggcaaggtgatgagcacctgaactcacaatctatcctgcaaggagagcagcagcagtccccattgccaccagagctaccacaggatcagttgcaaccatcattgccacaacaggagaagcaggacatgcctgaaccaccgttgttgccacaagtaccacaagaagaagtgcaaacatctatccccgcagaacaaacaaagaattagttttaacagccaactggtaattcaaatgttcttgtcatccatgtttgtatccttcttttatgtctttgctgcttgtttctaattcctctggaattgcaaagctgtacctgtttgtacagaagtgcaatgcacttcaattttggaaactacaaaggaacacctccgagtgttactcctgaattttcgaaagagaaacaatcattgatgagaagtattgaaccgtagaagtttttggtgatggggacgtctttggatttttccctcttcactgtgaacagttttggagttttggtctttggttttaatgagcgtattttaggtttgttgaaaattttgttgactggtccctttatttcttccttggatagccgtctactcgcttatgtctgtcatggactgttttcaataagaaatcaattcaacatttttgcaagtgaatccacataactagctttctttcttattctaggtggctgttctttgcaaaggagaatcgacattatattatttctatacgtagaagtgattataaatccgaggaagaaaacatactagtaggttttactgaaaatatccatgctttttgattgtttgagaaaatctcatgtggttttttaagaggttctgaacatcatacattcgcagtttttttatgtagcagaaacctttattacctcatgaagaaatctctacaatggtcagaatttcaaatacattttctatttagcatctagatttccatcatctatgtgaagcaggtcaacgcctcaacggggaatcacaatgaccattggttggtccattggttgatgatgaaacctttcaggtttcctgtgagctttcggagaagaccctgctcaagtctccccacaacagactagcattgtagtcaacggggatcccaactcttagaaaagctccggtaagccattacacaagatcattttagtgcacccatagacccactctctccttgctggcatcgacgggcgcagaagaactgattcgatctatatttgcaacatgagcggggaagtcgaattaggacagccgttgcgggtaattaccttgacctctcttttaagttccattcttgttgctccagtaaggaatgcctaggctacggacaatttagagactagatttcctataacaatggatattgctaatcagtatgttgtgaggtacaatttccattacagcatatcaatttcaccatgtaaatgccatgttttttctttgacttcccctgttgtgcttaatttggtggggaataagactgagccgttgtatgtaaggattatgaatccctaattgttggcatctcctgtcgatttcttgcactgtccgcagttgcgcatcgtctcaactcgctagtctaatgccttgctgaagttggttgaagacttgaatggattgccctttgttgatgtgctgactttccatgcattcccgtactgtttgcagcccccagattctgtaccaagtacaggaagagacgaggaagaagggtcgtcgcaccatggaaatggctcaggcgcagccagagagaacccagagaacccattgccggacctggcgctggcgaaatccgagtcagaccggataaaagccttttaccagacggtcctctcggccattgtcgtgttcatcgtggcggcgctgtcaggatacaaggacatgaagccgctctactcgaccacaaatcacaagaaagttcacctcagcaacctccttgtcatcgaggggttctgcatgattgctaccttcatatgcgcggctgttttgatgatgtacgagttctacacgtaccaccatgagatcgcccgcgaggtcgtcgcaggtgcagggacctcaccgtcctcatcgcggtcgccggagcgatgctggttgcgacggacacgatcctcgtcgtcatcgccaacagggacaacgcggtgttcgccgttcttttcgtgccggtgctgctgttagtcggcatggctgtgtacaccggagcatcgatggaggagcagccgccgaactcgccgcacgacggcgggtacgatgaggcaaccaaaagcacctttgatctggccaccgttagtacaatggctgcattgggtttgcaggggaccatcgtcttcggctacctgaaaacgcccgagaagaagagcgaacatgatgaccctccactggacctcgccgtctgctacatcgcctcgacggtctgcctgaccgtcatggcggtttgcgccatccgctggctcttctccccgaagaaaagcggaaggctctggtcggaatcatcggcagcctcaggcacgtcctgctcgcctctctggcgctgatggcggtggttgtctccgtcgagttcttggacggcttcgtcgtgctctccgtctggccggaggccgtcgcgctggtgctgtactacgcggcacagctctgctcggggcggcagcccgggggaggagtcgggagccggccatggatcgaatttgtcttccggattgtcgccaccgccgggttcacgctcatggccgggctgtacgcggcgttcctcgggaccaaccactacagcgtgtacctcaaggccgccatgctcgtgctcctgatggcagttctctcgagcctcagccgtctggcgaacccggtttacatgcccgagatcgacggagctctccttgagttctgcgtcgccggcgtggcgctcgccttccccgccgtgtcgcttctggttgcttgtcccttggtgcttaaggtcttcgttgacctatatattcatcatagttctctttgaaccaaggaggtgggtggaaccatggtactccctccagcccataatataaaggattttgagtttttgtttgaactgtttgaccgctcgtcttattcaaaaaattttagatttattatttattttttgtgacttactttattatccagagtattttaagcacaatttttcgggttttatatttacataaattttttaaataagatgagtggtcaaagagtgcaataaaaaactcaaaatcattatattatgggacggagggattaggttactaggtttggtgaggccgtgaggtttcccatctgcttgctgttcggacatagagcaaggataacattagcaagacatactccctccgtctcaaaatataataacttttagctctccggatttgtcccaaaatataacaacttttctagcaatattctcttcccactcaatcacaacccttcaccattcacttttcccacctatcttcactactcattcaatcacaaccctccaccattcacttctatctacttttttaataaccgtgtctaactctaaaatttcttatattctgggatggaggaagcaactaaaaatgtagagcgttgttctcatgtaataacaatctacatttgctccgtgatacatacattttaaatctattaacttattaaaggaacagaaaaaggagcatccatgttcgctctcacggcctagaaattatcatattaattgaagaaatagaaaaacagagtccatgtagaaatacaatttttaaatagttgaaattcggaattaaaaaataaggaatattgaaagaggagactagactccatatagaaatacaatttataaataactgaaattcggaattaaaaaataaagaatattagaagaagggtatagagtccatatagaaatacaattaagaaataatagaaatttggaattaaaaataagaaatacttatagaaatacaattaaaaaataatataaattcggaattaaaaataaggaatattagaaatagagtatagagtccatataggaatttaaaactaactaaaattcgaaataaacataataaaattaaaagtagagaatccatataagaataccatttagatgtaactgtaattcgaaattaaaaattaaagaatattgaaagatgagtttagagtccacatagaaatacaattagaaataataaaaattcagaattaaaaataaataatataggaagaagagcctagagtctatatagtaatacaatttacaaacaatgaaatttccgaattaaaaataagaaatattggaagacgagtctagaatccatataggaatacaatttagaaataactaaaatttgatattaaaaataattaataactatcacgtatatacaatacggtatgaatattacacaatggtagtttggtaaagttagtaaaaaatttaaaattatgtcatcattttaatatattttaataataaattgagaaaacatatatgctattatataatagaaaatataatcatgccagccgcgtaatctatgtgggccaccatgctagttcatgcatagtaagaaaaagagggttggctgacctcagggtgtccgtgtcgctcccaccctagggcgacactgacagggggcgacatggacggcgaccaaagatccgccgccacccatccttcctcctccttcggccttgcagccgcccgaaaggccaccggcaaagccgactggctccaaggactacgacgacggggcttcgtatttcccccgagggtgccattctggcaggtggttctgaggcgacccaagtggaagaggtggtgccgtcgcccagatccatgctctcctcggccggatccggtgaggagcagtgacacgatttggagcagcggcagaggtggccgctcatgctgctggatccggcgacaatagtttgcgtgggtcgacgcgatggtggagggtgctggcggcggggaagagggagcgaagtggaggcggctcctttggccgggtcaggagaggagccatggcagggaagagggtgtggaggcgacaagcccggatatcggcatgaaggggcacgactggcggtgggaggctggcgaggtgcatggagaacgtgacacaaaggctcatggctggcaagcgcgacgtggaagcgacgaggtcggcgtggaggaggcgatgaggtcggcatggaggctggagtggtgtggagcgtgctaaggtgggagcaccgcaaggctgggacagtgtggcggcgaggcttccacggtgggaggacgaaggcgacggcggtgcgaccaggcggcccgttgaagagacacgggtagcttggttgaggcggtgacgatggtagcaccatgaggtaggcgttgaatgctgttacgagctcctttccaggcgtcagtcttgttgtggcgatggctagccacattggacgggctagtgggaggagagaggatccatttttctctctcaccctctccctctataacccacccacaaggatggatctggagcacgccggaggttgagatgctactttgatggccaaccggcggcgaggcatcggcgcggtggcaagttgaaagggattagctggtggtgactgttgaatttgacagatacttaatcaatcgttagatttgttttggacgaccgatatgtacaaccccccccccccccccccgcggggggtcccgcgcggcacagcgcccgcttctctggtctccgagtcttttacccctatgccgttaaaaagttgctgcttatctgtgtgccacaaaaaagtttagagtcacatgtatgccatgagcccaactttcgttgacccgtgtgccattttggatggatggagacataacgaggtgttaggggctgtgtaaagacagttttgtccttgtgtacaataacccatcggagccaccacttttcctcacccgggaaatcgccggcggcgagcccctcgtcctcctcctccggtgacccgcagcctcccgcgatgcgatccgtggcgaggctgctcgccgcgctccgtcgtgccccgccgcacccgatcctcctcctcctccccggccgtctcttctgcggcggcggcggcggagatccggcaatcccggtgctgccttccacgccgcgacgccccagcaacacatcgctaccatgccatcgccgtacaaaccgggggcgcatcgtggcacccccggagcaaacaccgccgccgccattttagccgccgccgttgcatagccgtcgtcgcccgccgctttgccgccgtctcccattgcttccaccgccgccgcacgacgccgtgccaccgcccgccgtcgtctctctctctctctctctctcttcctcccggccgcctccctcttttgcctccccggccgccgccgttccattcccggcgtcgacctccggccgctgtcaccgacaagcaccagccgccggggctcctccctctcctctgctcacgccctctctccttctccctgtgtgcaagaagaaagaagagatgaagaggaggattaaaggaggaatagagctgaaaatccttcaggggcaaattagtcattttccccacatgtcagagctatggaactgttaagttctaacagaaggtggacggaatggcacacgggtcaacgaaagtttttctcatgacatacaggtgactctaaacttttttgtggcacacatgtaagtagtaacttttttttaagttgcataggggtcttggttctccttctcctcgcgccgcctctactcactctggctcaccgcccccctggatctggttctcagaaggcagacgagagagcagacgagaggggggagagttgcggagcagcggaaaggggtcgccaatcacgaccctatcttcgatccgtacggcgacggtcatcgcgacccccgcgaattgctccgtcgcggcgtcatcccgtgaaccaggtgacactgaggtgaacttcccttctctctcttcctcccccgttgtccctctccctcccctcctgtctgccaacaacagaatcattggggttctgatccagggcattatcccgatatcaaggtgcatacctaggaaggatcatgatctaagtgggtttgttttacgcgtacttgatcagttcatatgatcgattgttattactagtagttcatgacttcacgagatcagatattctcgacatatcaactaattttataaacggcacacatattactgtattgttagggggactgctttatacatacagattattcattactttactggtctggtctagtctggtctggtctggtatatcatggtgctactgtttctgagcggggtctggtctggaaatgtgctagtacccgggactgataaattatgtcctagaacattaccagttgctgcaactgcatgaataactgccaatttgtagtgctcgtatattggcaaacaatgaacagaacgccgttaaactcgccagacaagagcgcaatacaatttgaatccatccaaaagtcagtctcacccaaactcctgggcatctcttgttagttgtttcttccattctgtttagccaagcttacttagtttctttcaattgtgcagatacatgctggtggggttgtgttgattgggtggattgcagtaaacatatcaccttagtatgtcagaaaagcaggagtccatggcaaagcttctgcctgacgatgtgcttacaatcatcctccgttgtcttgcgccacatgaccttgccatgtctcgctgtgtctgcaaactctggtgcaccatcatcgacactcatcgcatgctgcgtgtggacctcctcccacactcagtaggcggcatattcatcaactttcatgatctaggcttgtcagaattcttcgcccgcccctcgacaggccccacaatatctggcaacatcaactatttgcctctcacatccatagttaggggccactgcaatgggctcctcttgctttacagccatatcagtcgtcccggcatgaagcagttttatgtggttaacccggctacaagacagtgggtgcaattgcctccacctccaaggcctgatattgggatcatgcacttagacaatttgtaccttgcctttgaccccaccttgtcgtcacactttgaggtatttcaaatcccctatgttgatgtcttccgccatcgctctgagttgaatcctgcaatagagggaatagaatggccaccgtcaacatgcgttctgcatgttttctcaacaaggacaaggcaatgggaggagagatcatttgttcgagaaggggaggctgcaggatctttggctatcatacgacgagattttccaaattttctgcacaatgctgtctactgtcggggagtactttatgtacgctgtcaaaccaactttgtaatgaggtagtctcactgataagtattataatttatttctttattaacaaatagtatcactcaattttatcatgttttaatatttctaagttttccaatatttgcagaatatctttgtcagatggcaagtatcgaataattaaaccaccagtagagattgaacggtacgaggagtcaaatatttatatgggactatcacagaagagggtgtactgtacattctttgatgatccagacataatttatattcttgatgaatcgtacggaaaaatggagtgggtgcagaagaacgctattagctgtctggtcatacatgcatttcagcaaactgatgggccctggaccttacaagatataactatcatgaatatcctgatgcgtacggacatgacaacagtgaggcaatagaggaacaaaactttgattgggactctgacaatgataattttatcaacactacagacgaaagaaatttgcgctacggtagaattacttttctaggatttcacccttacaaggaagttgttttctcaagtcactcattgagccgaggactggcataccacttaaataccatgaagtttagaggctttggcaagattcaagacttgggcaatcttggcccaaaatattatggaggatgtatgggtatccaaccattcattgaagagtcttttctgtgcacaccttggatgggagagttcccaaaggacattaattaagatctcatcttgaagattactacacaatgaatatggcatattgccttactgtcattcaggacaagtatctcaagccatgaagtatcttttgatagcttgtatcgctgagcttctcgagttcttgtaatttatctgctgtcggaatattatgcaagttaagagtccattaattgacactgaacaaacatcaacactcagtaaggagtcattagatggtactaattacagagcacggtgcatggtgttacgatttgcaagagcttttgctgtgtgcaatgctatatgctttctgtaatgcaatgccagatgttccaaaccagttatgtttattttatgtgtgttactcccctgtcctaaaggagattaccctctacattaatgttaagtactgcaaatctagatggactggtaatatttgtctctctctctctctatgtgtgtgtgtgtgtgtgtgataggccatatactgtggagcggcatgcttgtggcagatgaatagctaatagagtaatctgtgtgaaaagttccaacctttgacattatatgaagaaggttttgtataactgtaagttgtccgcacgttataaaccatacttaatcccctccaatcaaaggcgattgaggggaatactagttcaatttctcccccgattcgaggtgattattttgccaaacaaccccttgaaaatggcttgagagcgaagggccttgtgacaattgaggattttgtataactaaagtcgtccacattttacgaacagacaatgtttgactttttgagagcaaaatgatccttttatcccttcgtcagtttaactggaaatggttcgccgcgtgtccatgttctcggctctccccaaggaaaggctgtcactgcagaacagagtgtataatagccggccccatacggggcatttttggacgattgcttcacattgactctagtaagggtgtgaggtgagtcattagcacatgattaattaagtattaattattttaaacttcaaaaatggattaatatgattttttaaagcaacttttctatagaaattttttttgcaaaaaacacaccatttagtagttcgggaagcgtacgcgtgaaaaacaaaactatctttctctctttctgctgcgctcaaacgcagcctaaatatagtttgttaatatagaaacgaagattacttacttatctaagcagcgtaggctgattataaactgtatggcttattaggaaaaataataatttgtgagtaactttcatatatatatgttcttaatgattaatggtaatgctgaaaacacttagattaaaaatacatcaacgtcaagttctaaatttaaattcgatgaaaatatatcaaaattaagttttaaaaatttaaatttagtgctgattgcggaccttgtcgattgtttggagtttcaactttcacggaaacacaacgaagaggctagcaggaaggggaagccatcaggcaatagaaattttgtactccatttcaggttataaaatattttaacttggatcaaagtcaaactgttttaaatttaactaagtttacagacaaatataataatatttataatactaaattagtttcatcaaatcaataattaaatatattttcataataaatttgtctttggttaaaaatattacttttttttacaaacttggttaaacttaaaacagtttaactttaaccaaagtcaaaacgtcttataacctgaaacggaggtagacggaggtagtagtacttaagaggtacgaataggtaccaattttttttattgcaaatttggtatatcctattattgaggtaataaattttatataaaaaatactctaaaaatactccctcagtcccgtaatataagggattttaagctttttacttgcattgtttaaccactcatcttattcaaaaaattttagaattattatttattttttacttactttattattcaaagtattttaagtacaacttttcgtttttttatatttgcacaatttttttaataagacgagtggtcaaacagtgcaagcaaaaactcaaaattccttatattaatattatgggacggaggggacgggaggagtatgatacaatacactgtagaatcactcataaggtaaagggcctttgtcatttgctaattgcttgcagatgttccaaaaactactactactaacatagaagcaaacttaaattgcggctgcttgttttatcctgtggtgaaaattagctccgtttgaataactgaaggcgtatgctactctaaaaagactaaaaatgaatctgcaccatcctcccattgcagggcagagctagaacgagatgaggggtgccacctatttaattgagtaaattacacgagcgatccttaaacttgtaacgaacttttacttaggtccacgaacttgcaaaacatgcatcaagatccttaaacttagtttaatgtatcatcacggtccaaactctgatttgaccatggtcttacctatatggtatgccacgtggacgatgacatggctaaattttctttttccctttctttcttcccatcttttctctccttcctcacctcgcgtggagaaaaatgcagcagaagagagaggaaggaggcaaagtggagaaaaaaaagagataagaagggagaaaaaaagaaggaagaagggagaaaaaaataaaaaaatttcatatcatcgtctacggagcatgccacataggcaaaaccacggtcaaacaaggctttggaccgggatgatacattaaaccaagtttaaggatcttgatacgcgttttgcaagttcgtggacctaagtgaaacttcgttacaagtttaaggaccactggtgtaatttactctgctttatatcaagtttaagctaatacaggtgtttaaatttgtattgagggggtgcacatcagtggtggatttaggccatttctgcggggtcggctaaccccacaactttttaaaaatgtcctataaatctcaatttttatgtataaatccaaaagaatttagagaaatgaccccacttaaatacaaaccactagtaattgaccccacaggtttaaattcctggctccgccactgatgcacatatgataaaattaggttaggtatagctacaaacttttcttgaacggattcctggccacccccctcagtactcctgcctctgtccccatggcatgttacacctaaagacactattaatatcatatctaccttcgacatttttcactctcgcactctccatgatgcatttttttatccgtatttttcaattttataacggtgtaatgataatattgattcctagtagtttatattactgatcaagctttaacgtatagactatgaaaaaggaaaagttaacacacgacaacgacccattgagaacttttaaaacgaaattgccaagaagattagtggcaattgtttttctatgttgactagagtccagagagagtttagtcgtcccctgcatttccccatctcctcctctgagcaactatatcgagtttcgactaccatctcagcttcggtctcgtattctcgtggatcatcggaaagatgatctctacggaagaggactctgattcttttcaggtaaagagaagagatctcttttatcttgcttcgtgcttgttttgtttgtagctttgtaccaatcttttcgtccaatttcatggatctagaccaaaattttcgtgttcctaattagtttcttttcatgattgttttatgatgcaaatctaactgccatgtcaattgttttatcgttagtaaatttcttattgttcgcgtccgtgcttttgaagctaacagcatgatttttttttcgaacgcagctaacagcatgatttggctagtcctttaaaacatgtgtataaaaatcatatgtacatatattttgaacaaagtcacctcttgttaagagagattctaatgatataaattattttaagttatttgcttattagactctgccgagatgctgaagtaacttgcataaagccgataagtagagaaaggagtacagaaaaaaaaatcaagatctaaactctgttagcatggatcatggacctgtttgaaatactgtacagacaactctgacaaaattagttaaccagtagtacagctttcttttcttaggaaaacaactttcttttcagagagtttcatgtcttgttaccaatttctgtttgattccatctctgacatatattcagtgtgttgggacttcgagaccacagcaaaatactacttgggcagctttctaatagtactagatttagctaataagagaccatttgtggatctaatcgccttctgaaggcgattagctagttttactcgggagataaaacatggaaataactgagaaacataaagcctccgccggccattcccgttaaccatttccgctctttcttcttaatctgcctgtgggcaggcacgatgtggtgttcagacatcttcaacgacttcttcgtcggtgtatcgatgatgctttcttatgggtttagcatttaaagtgctaagatagaattgtcctcatagcctggaaaaatattctattgttctctcccggccccaaaactctgctaatctgttatggcaaagctgttggtttatgcctgaactctgatagcctgtaacccgttactcacttttcaatggaaaattcaggtggagaaactcttaccctcgagtgatttactcccaaaaaaaaatggaaataactagtgataattttttttaacccttcccaggatgacagcgaggaactgcaaatgcaggtgacaaagaagacgttgaagcgtgtcatatcactagccgaaaccttcatcgccatagcaaccggcatcctcgcggcagctttctcggcaggcaaagatgtccacctgcaccgccacgtcctggccgccggcggctgcttcctcgtcgtgacatacctgtccgctctcctgctcatctacatgaagctgttcttgtcagatcacaggcggctgcgccgatggcacgtccggtccctgcagctcctgtgcgtgaccagcggcgcgtcgctcgtcgccacgaactccctgctcctcgtcctcatcggcgaaggcaatggcttgctgtcgctcaacctgctgcccgtgcagggcatcgtcggcgtgctcgcgtaccacgcgacgccgacggaggggagcgcgcgcgacgaggcgttcgaggcgcaggtcaagagcgcccgcaaggtcgcgctgttcgcggcggccacggccttcgccgtgcagaccacgctcgtgtttggcgcgttcagcaacgccgccctgcaggcgatgggcggacgccggctggacctctcggtgtcgttcctggcgtcggcgctcagcgtgttcttggtcgtggcgacgtgcatgccgctcgggttcaggaaccagggcgccagggacaaggtgctgtccatcgtgaggtacctcaagaaaggcgtcatggccgtgctcgcggtcaccgcggtgactctcggccaggagttcctcggtggcgccgcggcgctcgcgctcttcccggagatcaccgtcgccgccatgtactacgccgtgagcatgcccgccgacgaggcggccgcggccgctgaccgcaagatggaggtgcttccgaccgtcgtcgtggcgacgttcggcttcgggatgctcggggcggcgtacgcggcgctgttcggcacgccggagtacgacctgtacaccaaggccctggcgttcaccctgctcaccgccgtcgtgtccagcctgggccgcgtggcggggccgctctgcaacgcccagcgtgacaagagctcggcggcgtgggtgacattcctcagcagcatcctccccatcgtggagatgctggtcgccgtcccgctcgccgccaaggtaatggttgattttctcgccgttcctggtaatggctgattttctcgccgtgcactcactagcacttgatgtcttgatcacttgtacaaattcttcgaacacgatacgtgcatactctgacacgcaccatgttgttgttgtactttactgactttgtacaatgtcatgtacttatagtagtggacctctcttggacaccctgaagagcacatattttttgtgtgattttgtctgaaatagtactgctaggagtagtatttgccgcagcagcattgcggagttgccaacgcctcgaaggtattcatgggcttattagattgatgggctgttttgtacagacaatcacggccccggttggctgtcagcctataactccatcagattgtgtggttttggtttaaaagaagagcaattttacaattcgaggtaccatgaggtaccatttttttattgtaaatttgatatctcttgatacctaggtactgtgaggtatcatgagtgaccaatttttacactaaatttttagtacctcatggtacctcctcaagtaccgtagaattactctcagaaggactcattttgatcggttgcaaacacgtagtctcgcagttaaaaaaaaaaccacgtagtctcgtgaaataagcctagaattgatcgagtcgagtacagttcattcagaggggaaaaataaaaggaagattacgatcgtcgattgggaccgaaattccgaacggaattgcaattgctgaggtttgttgacaggcgactgaactcaattcttgtccggtgtttccggctttccccacttccttgaggcacaactcagcccgccgtcaattccgagaacttatcaaatccatgatgaacaattgcgacgttcgctttcgagcgggcaggtccatggagtgtaacaatgagagaataaaaatcgacagtgtaaggcaggaaggcgacgcgttactgtgcacgatgcggacctcgaaacgctctagtacacagcacacgcaacgggccggagttgtagtgaagctcttttttttttccttaacgaacatagcgaagcttgagtatcagaacaaggcattttatacgcatggggatcacatgatgatattaaactacttgaccgacacagcgttcatccgtgaaattatcgcccaaaacgcaatgcctcgtccagccagtagtacatcggctctgggtttcttcattatagttcagttggatcgtcggtttcatctagacaagtatccgaagtaataatctgtcgcatcggtcaatgactatctgctactggctgatgcagggagcagagcatactctgctctcgcaacgtaccgattgacgtacatggcactcacagcaatgcagcatcgtgcagtggtcgatcgacatggtgaattggcgatcgggttggctcggctcggccgtgaagcaagcaagcgtacgtgagcacgacaagtgacagccaaccaccgaacacgatccgctatataagacgctgcatagtgcgcacaccttcaagctcgtacatgtacgcaccgcgacactgcgagtcctgcaagaagccaagccaagcacacgagcgcagcagcagcagcagcagcagctaagctagctagcttggagagatcatcggagatgcctcccaacgcggcggaggtggcgcggccgaagagcccgctccggggcatcctgccgcagagcccactccggatcaagcaggacggcaagttctacgagcggctcctcgccaaggagaggtcggcggcgagccgctccttccgccactactgggccgccgagcccggctcggtgccgttcgtctgggagtcgcagcctggcacgcccaaggtcgacgtgtcccggatggtcgccggcgcagtcccggccatcaccccgccgccgtcgtacctgctccggcacggcggcaaggctggcgcggcggcgccggcggcgccacgccgtcgtccgcaggggaagggcaaggcgaagacaggcggcaagacgcggtacaggttcaagcggatcaagatcggcttcctcgccggcatcttccggaggatcgccctcggccacgtgtggcggcggtcggcggcgtcggtccaggtctcgtcgttgtcaagccggtggctcttctcctcggcggccacggcgccggagaaggccgaacacctcgaccacgacacgcccgcgccaccgccaccgccaaggccgaacaccgagctgtccacccgggcgcgcgcgcgtccgagcctttggatgctgcgatttcgcggattccgaagctggagccgcgacgacggttgggcgtaggtcgctctcgacttctcgagtgtatacgtgcgtcatcatgggggattagaacgtgacaaatgaaatgtttatggttgcgagagatgttaacggttgtttgtatgcatgctgttgttgcctagcgtttcatggaaatcatcattaattacgcgttgattatgtttacggatgaaacccgacgtgttcggaacagttgatcatcttttgtcactagtttaacagggtgattaaaaggatcatacacaataatctgattagtacgcttggtattttctgtgataaattaattttattttcccatatggtctcagatatgtttggagatgtagcaaaggaaatgtttgatgtgttcgcttcggtttatcggagatgtgatcagtacggtacggttaaagattcttaattagctacaggccctagattgaaagaccaagaacggctatagagggggtgaatatagcaattcaaaattcacccttgaaaatactcatcaaaacgattttctcaaaattcttactagaatcgcagctattagaaaagccggacctagaaaagaagagagaaggaattcccgaaactagaagagagatgagaggaagatagcaaatctcatcattgcaaagttcaaatcgcaagcagaatttaaattgtagaatttaaatggacaaggcaaaaataaaatctttcaaatcatctcattcataggtgttgcaaaataaccgctcaattaggagcaaacatacaccttcatagaaacattaattcaaacttaaaaacctctcgggcaaacacactccaaactcacaccgaaactctctcaccgagcatcttaaaaggattacaaaaggagcaacctccacccttacatccatctctctatttatagcctaataccccctaagacattgtctcaaatacctcatacctctagggcgaaacccaccctggactcaatctcagccacttgcttttccttctcctcaaaggaatagctccagatcgctgccacgtagtcaatccgaactcctccacgctgcactcccttgcacgatccgcgtgctcctgctccaggccagtaacacgccgccacgtcgcgcctcagcacgcgagagcgcgcgctccaccgcgtgaatcccgcgctcatctgcacgcatccagtccgaagcctccacgcgtcccaccgagccgctcccacgcgcgctcgctaaatcgcacgtgggtcccacgcgtacggctcctgcctccgagccgtgcaaaacagcgtggaccccgtgcctgcgcgcgccgaattgcttgtcgccgcgtgtccgcgcatggtgccgatgccgtgggccgtcgtcttctcttgggcctgctcggcctggcctccctgccagccaagcactcgggcctagagctagggatgaaaacggagcggatacggatggataatgctcataccatattcgttttcatatttttttaccggatacgaaaacgaatacggatagctcgaatacggaaacaaatacggattatctcgaatacgaataagaatcgaatatgatcggacatgaatacggaaacaattttttctcagaacacgaaaaccaactcaacttctaatagaaacaaatatcaacatatataattagctcattttatataaaatgaggtataatttataaatattttttaaaatttaaataatattaatagtatggactagtgttaagagataaactactattaaaatctataaagatatattgaaggttatagagttagaaagatatggggtatgtctcatgggtcctgcggatatccgaatagcactgttcaccggatatccgaattattatccgtatccgatggaaaccctggtaccatattcgtattcatatccgggagaaaatatccgtattcgtatccatatccgaactatccgagaattatctgatccgaaaggtatccgtatccgtttttgtccagaacggacggaaactatccgcttagttttcatccctacctggagccaatcaggcgttggcttggcttccgtcccaacagagcccatgtgcaagctagctagccaatcagctagctgcacttgccatctcatgcacacgccagcgcatgcctgcatgctacagtacttagtactgtagctcctcttctattctccattttcttcgtgaacccggcacttgcacacttgaccttgtgaagcccgttgtgaagtcttcccgacacggtgttcgtccaccgtgcgtcaccttgatctcaaccttgtcacacggattcgtcgatcgttctggacctcaactccccctgagtctagtcccaatccgccgtctacccaggctgaccatcagggatcatgacgtcagtcccaccttgtcacatggcctcttgaccgtgctagacctctgctcctccctgagtatagtcccggtcctcgccattgaccgcggttgacttcgatcacctgcacacacgtaaatcaaatatccgattctgggcacagatatcgtaacctgacctacgttagtcataagcattgtcgcctaaaatcgccaacaatccaaaccaaatttcttactcaaaccaactcatggttaaatatttcgttgccaattttccatcacgaataaaccaaaatcacacttggttttacatagatcatgcatacgtcattagtccatgatacgtggttttgtcaggcttaaacgggcattatcaggttcgtgcgaacagaactaattccatcatgtaccataatccatttcgttatcttctgatggtaggtgattgctactagtagtactattttctagtactcctgctcgagatatcaatcaatagaaattaggtgcaagcctttagtgcaagactagtacatctctgaattctaatgcaccgataatagccatgcataggtgcagaccataccgtcctcttctcccaacccaaccgattgatctgacagtgctcttgcaacaaactcaaaatgttcagggtagttaacaacatgatctcctggctgtcagtatgcaggggatggtcctttttgctgacatgctctccatatgaccaaatcaacaagtataattcaagtctgcatattactagccagtaacttttgctgatggagtagtttatatgtagttatgtatagtactgatcagtattcagtactagtacagtagtaaagtttctatgatccgcctgtaagacacatcaaagagatcagaaaagagtacagattgaacaacctgctactctgctagtagtgctgcactctgctctgcaccgtcgccgacgtcgttctccagtccgctgttcactggatccaaaatgacgagtttcgctattgcattggtgcgagctgcgaactgcaacaccagacttatataaatggaaggccaacggcaaaatcactcgtgctgcgtgtaactgtgccgcctccaactgatcgtctggtagctgcccgtgggccgtggccaagtcgtgggaggccgtcgcgacgtcgccgtggggcattttcaaggtgagccgctacgcgttgaattatctagatcgatcggcacgacgcccgtacgggccaccgacggataatcggataggcaacggaagcaggatgatataatatggtatcttgaggtcagaaatatgattcctggtcagattaagttctccaagtaaggaattgaatatgtttgctcatgtatcgcaaatcagctagctggaatattatactggcatttgcttctcaactaaaggtttcaatattgaactaaatctctagattccacattttgtaaagctgtatcgatcaagaaccagatcaggtgctgatcacactagtttggtttatgggctgatcaggtgctgagttgccatcctgaaactagcctaacagtgaagtatagcatagggttataagtgtggccgcctctgtttcggcatttggttgttgagcttaattcgtgtaggtaccttgagactgtgtagaagttcaggcgaacagtacagggagggggccgtttggactgagtagggagttgcaagtctgcatgagcaatggcagcatggacacatgcatcgtccatgcgtggcggcgccgacgcccacgtacattttgtttggtggattggaacagcgacagcttcagaattacgtttcgctcaattgtacacagttcgtttcgatatatcttacactgtcaattagccggcttaaatacataattaaggaacgtgtccttcgcgtcaatgtactgagcagtgagcacgtacgcatcttgcaccttaaagtagaaccactagttagcaccttgcaccttacccccagtaaagaattacattttaatcacataaaagaaaaacaatgcttcctccgtttcacaatgtaaatcattctagcatttcccacatacatatctatctatattcattaacatcaatatatatatgggaaatattaaaatgacttacattgtgaaacggaggaagtacctactttgagaataatgtgggagaattactcggactcgaacaagactcaaccaaagactgttaagaacagaatacaggagaacctagggtataaaggcctagcaccagaaggaagatggaggaggaactgaacagaacaacaatctactcaaaccttgatgctcacaaatcccaccgcgatatccagccttcgatccatcaagagccaccggagccgagttttcatatgtccgaccaacatctcgttaaaattcctagcaagactagcacataggcttaggataggcacatatatcaataaaagtaataggcctacccaaaccaataggacgtagggttattatttcgagtaggccctaaacttgtataaaaatgccacgcgtcggactaccatacctcacacaagaaataagacacacaaacaagattcaggtcttataagtttctattgtcaggatttttatcaacaacagcttgagccacggtcaagctaggtttgcacaacataatctagcttagttagcatttgtttctccaaccaagcctagcaacttagtttgcaaaagtttaactaggtgtgctttttaaccatcgattcatctgttggcctacatcatgatgctatagctagtcataaaaaaatgtataaatcatctcctctttcctcctcatcgctccctcccgagctcagctgatgtggcagcgacggcagagttggcgctagagaagagaggagaggaggcagcggcaccaaatctagtgcagtgttggcgctcatgacttggcaggagacaagggctaccaggtgcagcctttggggaggaaatgagagacgacggagttgcattggggttcaagttcgacatggggagacccaacaagaagttggcaacccatggtgctcttcttctagaggatgaatacgtgattgtatggtggcttcttccgaaccgcgttggttggcaagaaggatgaagtagcaagcgacttttggcccgatacctatatatggccagcgtggttgggcgagacacaagtgctacaatgacgaggagctggataccagttgcattagagatagttatgtggctttgcctcttcaaattttacattttggagtgagatgcaagtccattgaagattgcctatgaatgcaattgacataatcaacctactgcagtaaaaagacactgctctattaatttgagaggcaaaataagcatcaacctatcgtcgtcctggctactatctagatctatatataaattgcacagtgaaagtttgttcgaagtataaaggtctacgaagctacttcctccatccaaaataaaaacatttctgaagttagacataggcatgaagaaagtatgtgtaaatgattaaaataaggttataattagttgagaaataaaaataagtgaggaaaataaatggagaatagttatggttggttgagatgaggggtgtagatggagaaatagttttattttgaaacaaattaaacttgagtggtagaaatatgttcattttgagactttgggcacctttgtatacatttatacgcctcaccataaaccattcatggctgggaatggtttatgaaccgatctcctgtagacgctaatgttatcagatctccgcatggatcatgaactactcgcacttataattaattttttttgcggggaattaattaattcgttcttgcccccgtcttctgtgtcaagaaatcaagatggtgaccatgacgggccctttaatttgccatgtgagcccgcgactgtgaccatctgattctgaatcaatttttgttggtctaatgccagtcgtatcccgtatccgtttgtaaatcactttcgacggaaatacaaatactactcaaaattcttcgacatttatattgcatttctagctggtatctaataggaaattagagaaaaaatcttacaaattttgaaccatcgatttaacttatgattcatacactaggccggctcctttaattaactcagacaactcgaccaactcacgtgaccctccgatagtaaagacaaagcgacgactctggttagggatttagatcaggctagggagggaggtagtgggtttagaaaagccaagtgatggaggctataggagagccgagagtggtgacatgttgatggcaccaccaaagccataaaatgaaagagggtggtggatagtaaaggtagtggggtagtcaagaaggcaatagtaggccacgagtacaaacggtacagccagtgacatccttgaggtcacatgctcgtgtgctgctagccgctactgcaagcaccaccacgacgtccctccagcatcgagctcaccagatccaggatgagcaacgatagagctaaggaggtggctacgagctcaaggaaggaggagcagtgagtgtcgccgatagtgtgggctctgaagaggacgacagtctcctcggtgaagaagccattggcgacgaagtggcggagcatgtcatcgagggaggagaagcgtgcgaaaaggtcaacctcccatgcgttggactagagtcgcggcagccaagcacaacatcataagcggcgcaacaagggacaacaacagagtcctacaccatgagcgacagcatgtcggtgcaggagatgacggcggggtaggcagtcttgacggcaccatgaatccctaataggcgccagggccaggatgaatcgactcggcatgagggccgtgacatcaccatcaaccccggccaccaaaactatggacacacctctacctccccaacctcgacagctgcggctgcaagaggaagttgatccccatcatcctgtacctccataacggtaggctcgtcattggctcggttgaggatgcgctcgagcacgagctcgccaaccgcctctacaccctggcacgcgtcctcgtgttgtccttcaattactgcctcgcgctagagcaccccatccctgcctgctacgatgacgcgtggtctacaccgcagtcgccgtttgccatcagagccacgagcgccgacccgaggtggtgggccttcgtcctcggtacaatgctgttgagaaagatggaaaagaggagtgaggagggggaagagaaagagtctctgattatgtgggtcccaccagtcatgtcagcaaataatgcttcccacaccatcaaaaaagttgattttttgcacccattttcgaagatgggagagacattatacccggttttgcggttgagggatgcgattcaatcaggaggaagaacgagggaggtaaatagacttattccttcaacccccagctcaaaattaagcggcctagcattggcacgacccagaaggccttcaacctgcactgagaaacaaaagagaagtactcatatagacaaaattaggcccagttcctatcgcaagaaacataccgaaaacatagcccaatacacatatcaagtctcaatgtgtactacctccatcccataataaattcatttttagtccctctaagttctcgcaaataagtttatttttaaataattattgtatcggagtttgtaaaagtatgaaataattacatcagaaatagataaagttgtattagaaataaataaagtgtagaataattacattgtgatttgataaggtagggtattttagtttttaaacttattttgggacagatggagtaaatgaatttgtatatatggttttgaaaacctctagaaataagaacgtgcatgtacgctcacctgaaaattttgtgcgctcacaccatgtgctacatttgtcttttctttcaagttatttattccacccatatatactggcaatactctctccgtacaaaaatataaacttattattaaataagatattttctagtacagtaaatctgaatagatactgggaaatattccatttaatattatgttgggttatttcggaagggagggagtacttgtcatcccgaaattggcagccaaactggtgagaaaatagcctggaattggacaaacattgctgtatgtctttcatccatccaaaaattacgtacgtgtgtaaagaaccattaagcactagctggcatcctgggtggcactgaaaaccgaagacgctagctgtaattttgtactccaggttgcgtagcagtaaggtagtcacacacaagagttaaaaatgcattggtccagtggttgcggcaggcttcgttttcaacagcatttcattcccttgacatgagcagaaacacccgcaggaacacgaggggagggctacagggcgccgagggccaggccaaccgatcgagtcaacctttcaacactcgccaacatttcttcccctcctgcccatttactcgctaccaattgtacaagctgcccatccccctcattactcccttgccttttaagcactctttccttccttacaattccaaactttacacttctataccctcttctctcctccggccctatctacaactctacatctcctcctcctttctttttgttcttgttgtccatctccatctcgtcatacacctcccaagcacgggagtatgcctcaatgtccacagagaggtaagtggccacctagaaatgatttcagttgaattctttaccttttgtcccctttttgtctcttggttctttttgaaattatgcttctctctttctgtttcttgatttttttctctaaagaatcggagaggttttctgttccttttgcttggaaggatagcatgtaccttttgtagttcgtggttaaaacttgaaatcttgcattgtggtttgcatctggtccctctcctgaatccatgcaagaaaccctaaaaaccttcttcggccctttccaatttccgccagggaaagactcgatgagatcggcaagaagatcaagcgagagccggacaccgccggcgtcgtagtcgccgccgtcgcaggcaccggcaccggtacagccacgccgatcgagcaccgcgtcccccatcgcctcggcctcggcggcgccgtgaacaccgtgaccccgtgcgccgcgtgcaagctcctccgccggcgctgcgcgcaggagtgccccttcgccccctacttctcgccgcacgagccccacaagttcgccgccgtccacaaggtcttcggcgccagcaacgtctccaagatgctcctggtacgataccattacaggtcaaagcattccttaaattgtacctttcgctagcttgtgcattaatggcttcgtcggtgcaatgcggtttcaggaggtcggcgaggcggagagagccgacgcggcgagcagcctggtgtacgaggcgaatctgcggctgcgcgaccccgtgtacggctgcatgggcgccatctcgatgctgcagcagcaggtgaacgcgctggaggccgagctggaagcggtcagggccgagatcttcaagcgcaggtaccggcaggccggcgccgccaccggcctcatggacgacgtccaagtccatatcaccgccggcttcgccgctcctcctcctcctccatcgatgcacgcgagggacgtggtgtcagtggcggacgccggcgggcaagggcaagagttggccggagcgccggtgatctcgtcggcgtctccgccggtgtatcctgccgggcagccatcaacaagtactactgactacagctccctcaacacaagtgagcatgctgcatactttggttgacttgcatggatttatctaacattttggtgtgatcacaattaagccggggaaaataagatctgtgtgcgagattagttatatatatgtttctctagaaatagatatagttgtggataccttgggtgaagaaaagaatttgtccaatggatgtatcaatccttaattttattgtattgtccattgtgattgggcggttgatttaattaattgagtgcgtgctaaatgatcgaattagctcaaggaagttttcttcggttccggaatgaagtagtggttgtagtaagtgaaattgaactaaaaaacacatctgcgtgtatatatgtacatatatagtccaagtgcaggttaatttcagagttagttatgcgtgtactgaataagatagatcgttttcgtcctacgtattttttcacgaattttacaatgattgatatgaatttgcgtgcaggctagaatgatctggtaccagagtacctgcagagcatgcgtgatccttgaactgattattactactagattggtgacgagacctaaaagaataggtcattcgctgatgtacacgtatatatagtgacatctccttggatattatttgcttgaatgcatcaactaattgattggttcttactattcgaaaaataagtcagcttgatacttacatagtcacgtcattgtcatttctcaacgttctagccttgttcacataatttggcaattgatcattgttctgaaataggttacactgtacaaatacatgcacagaacttatatgaaggaaacaggacaatgaaactactgtaggtcgatcatatatgcatgtccacattatataactgttactctcgcttgtgcaatgtagtatatcattcgatgtgctctgcacaatatccttttgtgtaagttcgtgtattttttttaaccagcagatcgtcgaaagatttctttttacatatccgtctcgtttaaacgaagcatttctttggtgcaaaccccctctctctctctctctctctctctctctctctctctctaagatgatgttgattggtgcattttttttaaatctggaaaagtgttttttgtcctcggatgccatctcatttctttcatgtcatctaaataattacaaaaagttttgaattttgttacaacatatattaaaacctactagatcggtccacaaatatacaagtttaaatcaacttttacaagttattaacaataataacatatataactacgaatatgtgtatatatactagttagagtttataattttgttgtttttttaacttgttgaaattgaatttgacattgcatgtttatggaatgatatatatcgtattaatatttcttgtcaatttgttttaaaacaatttgatagttatttatgtgacatgcaagggtattctcccgagggataaaaatccatctccttttagtagttttagtagttgtacgtgccatgttacactaccttttaactatttcatctaaaatttatcatttgcatataggacgcatgaatcatttgaagaaatctagtgggcgtgttttaaaatcttatgcacagtacaaagtgatagtacaaaacaaggctctgtatgggccgacatatcatttcttcacgtgctcttattttagtatttccctcaataatactatgaccctgttccgaagtctgaataccagggtattggtcatgtagaaatgataggacatttcctatgtaggccagattacttgttcttaatttgtagctcaatacttcttcagatgcatatgagttattctagttttgtattaaattaaactcatccaactcggcagagtttataaaaaaaataaaccaacatcaaatcagttttattaaatatactattaaagatatcttgatagtgcatttttttaagatattagcagaattttttactacataaactcggttaaagttaaaagaaagtttgtatagtacgtacaaaactaaaacaaacaaaaatgaggaatgcaaccttgttgcatgaaaattagtgattctttagtttttctgccctttaattgtatgccagaaagttgttgttgttttcatattttcttttgttattcctgcatatattagttgtgggttgatcggtagtctggtataacatggttcagacttccgatggacgaggaagctaccagtccatacacattacttcatgcacatactttcgagaccatttaatatcgttaatttgcctacatatattgtcctggtacgtagaaagcaatgtgggtgtgtgcaggcatatgctgaagtgatgtgagtcggctgttctatgcatagctatgccagcttctactagctaattgcattatattactaaaacccctgtaggactaggggcctttccttgacgtgcagtgtttgcagctagctcagctcgatcgtacttggttgagttccaagcaggcaaagtagacacacacccggcctcgtattaaaaactggagcaaccagcacggcctctccttccagcgtccatgtgtgcgagcgagagagagagagagacagagagagagagtcgttaatttgtttatttccaagctaaaatgggttgggttgggggagcttggcgtgtgggatgtgattgtgatggggatttggtccagcgtcgtgcttgcttgaggtggcgggcatccttgcttgcttgcttgtccgcactcaacaccaacgccgatgcttaaaagtcttcgctaacctcgaaaacccagcacgggatgcctactactcatgcatctccactgttcctgctcgtactactaccacatttgttgcactacatgttttttcatgtatacagtagagtatatggcctgttgcaacccaacacagtagttaggttgatcagtgttcaggctttcagattctggacctggaatttcagctgtgagctgaaaccggacagattacgcactgcgtgttaggtttaggtgtatgttcgcggctcactgcacatgcttcgacgactggcggtcggtcggcgccgcgacggtgcgtacaccgcaccgtttttttgtttgtataagagtgacgacggaataatgtaggagtactagcatagccgctccattgactagaggagttttgcatgccgactgcacaaatcttgaggtttagcacgtggtggtggcagcaatacgcgaccttgtcgatcgtaccactgtctggtgactgtgccggtgggagaaaaatgaccgagattgaaaaaccggactgctttttccagaccgatacataagtgatggagaccgattttttaaactaattcggtcaagcttttcgtgctacctgagttcaggtggtgtttggatcagggatttaactttagtctctgtatttagacattaatttagagtattaaatatagactacttacaaaactaattacataaataaaagctaatttgcgagacaaattttttaagcctaattaatcaataattagagaatatttattgtagcatcgcatatgctaattatggattaattaggctcaatagattcgtctcgtaaattagtccaaaattatagatgagttttattaatagtttacgtttaatattaataattagtgtctaaatattcgatgtgataaagacttaaaagttttagtcccatctaaacagggtcttattcggccataccttggttaaccaagatgactgaattgctattttatttgtcctaatatataacaacttagtattaaagtattaagtattagataacctagcattacttcattcatagtgctagatggtgtacaatctagtgtagctggttgcttctcccctgtcacaaaatataagaatttaggaccaaatgacgtattcttagtgctacaaatctagataaatacaagagtctagaataggatgatgcattcttaatactatgaatctggatgaaataagttcttgtattttgagacggagggaattctgaataagattcgtagtattaggttgtgactaatttagtatatatgttgccatattttatgatggatgaagtatattaatattggttactattatcttgtgctatttaatgggtggctaatgggcgggtgatcgctgtgggcgatcacccgcccattagccacccattaaatagcacaagataatagtaaccaatattaatatacttcatccatcataaaatatggcaacatatatactaaattagtcacaacctaatactacgaatcttattcagaattccctccgtctcaaaatacaagaacttatttcatccagattcatagtattaagaatgcatcatcctattctagactcttgtatttatctagatttgtagcactaagaata

SEQ ID NO: 78314 - DNA, 3874 bp, Oryza sativa
  unsure (1)..(3874): unsure at all n locations
ctaaagttagtggagtaggaatagaataagagtcttagtcctagaagtcttcggaaggattcaggtatggttctagtagctctactctcttttgtaagacttgtacttttaatagaatattcttctttataatactttggtattgtatatgaataccaactttattatatatccaaattatattgattatgatgctagcttatctgggaaatgcaatggtgtgggtataatgatcgtgtatacgattattctatgtcatgacgatgatattatagtagtatttggtaagttaagcgtggtgtttagattgctggatattattatttggggttatataatgcgaatttgtcgaggtgggctgctaatggtgacagctcagtatgagtattcctccacgtgtatatataatcctaagttactttcctgcggagggtactcctccgtgtttagccccggttggatgattatgacgggttatcgtaagaaactcggcaatcagtgctagcttctcgaagcactaggagggcgttggaaagagggtattagctaagtaatcgtataactaggatgtgtatataatgtgtatgtatattagaagtgtaggaatagattctttctactcttgttgtgtgtcactctaccctatccattatcttaaccactgcttagactttgattattacaagtaaaatataagatattagtatagttctctctattataatctttccacgggattaaacaaatacgatactcttggaatactcttgggtgaaatgctacaatgatatatccatgcgcttgcggatgaattatgtaaccataatataccatgagtatttctacgttattgctaggaattacacttctagtaatgtcgttaacaaataccaacagtcgccttgagtggttggagacagaacagatcatagagtatcattctctcattctttgcttaactcttattccaaaatttttcaaatgattttgcaaataaaatccaagttcctcaaatgattctctcaatcactcgaagtgtatatttattcctcgccaagatattgccttgagcttgcttaggagtgagttttacttcatttcttattcatttatgtgctaatctctgcaaacaaataatactccaagtacaagtggaaatatattattctaaaataaatatgcattgcaagcatattgacggtcgaaactagtctataatgaccgtcaacaacggcatcgcaccgattagaccgacaggaacgtgtcggtcagaccggcggcagcgacaggaggcagaggcgatcgcagggcggttcggctgggagatcaacaccggttagaccagcggcataggcgcggtcagaccggcggatcaaccccggccagaccgatctacatcggattctagggtaacttttaattccattaaaagtttagattttcggctagtttagttcttgctattcgatcctacaaatgctttaagaatgtaggtttaagatgaacctcgtaacaaaaaaaaccgtattatattatatttatttatttataaataaatgcatgtgcgagatggtgatgagctaaggcaacatttttttcctattgattaggggttaggcagggcaaaaagtgtgggtggggcgtgggatttggcaagcgaaggggagaaatgcggtgggggaaggggaggcaatctgtcacgcccagaagtttccccctttttccttgctgtaaatatttgttaaataaatcgtctgaagaaattatcttaattaacctagagctaattccataattaataaatgcaattaataatcggaaatagcgtggtggaattgttccccatgctccaatgcattaacaagatttttagtggaattttcagagccttggaaataattttaaccaattaaaaatcaccaaagtgcaattttaaatcccaggaaaaatcctttcttctttttctttttcttttccttcttttttctctattgggccgtcggcccactccctcccgtgctcggcctccttcctttgggccggcccgttcccctttcccctctctccgggacgctgacaggtggggcccacctgtcaggtcgtccccttcctccagccgcccgccccacgacggcaaccgccgccgaaaccgtccacgccgccgccttctccgctccatgccgcgcccccactccacgtccccacgtcgccgccctccccgccattcctgcccgcacgcgcgcccgcaaatgggcgggattcgatttgaattccccccccccactctctctctctctctccccccacgtcgccggccaaatcggggggtttcccggccgtttccgcccctccctcgcccataaaaaccctcactcgagctctctctctcatttcccccattcaccgtactatcccacgccctctacagccgtcgcgccgcgctcgccgagctccgccgtcgccgcccatcaccggccgcgtgccgtcgacactagggccgccgtcgcgccaagccgncgncgncgctagctccgccgccgtgtgggccatcttgggcaccgcctcgcgtcaccggaaccccaccggaaccccatctccctcgcgagccggtgagctatccattctccttcgtctccggccaacaatggtggccgccgtggtcactctctctactcctaatccttctcaactccctccgtaggtgccgccgccgcccgtccacccctcctcgtcaccaggtcgtcgccgccaccttcatcctccgctccggccgccatactcaccggtgaggatccccccctcctccctcttcccctctctctcatttgcgccgcctctctccacgcgcttgccgtcgccttcggtcgacgccgccgtcctgtaccccgtctgccgtcgcttcccgcgccgccgattgccgtcgccggcgaccgtgcgcgtcgccgccggttgccatggccggccggccggatatgaagccgagctgagccgtgcctagccgccgccgtgccgtccgatcggcctcccggccgatccggaccgtcggtcccgtggaccggcggtggaccacccgcgtggtcccggtccacggtagaccggccaccttgagccactgcccgtggggcccatatgccggcgcccccttcctcttccctttgagcccgtgacccgtgggccccgcctgtcggcgccccctggatgacgtcagcccctgatattattgcgccataataattaaggactttttctttattagtaaaaacacaatttatcctcttaaatacataagtaattcattccagcttcgttaaggtcattcaaggctcagtaaatcaggaaaatgcaaagaatctatttaaaaatggggttgttttctggttctataggcttatagcatggtttgcctgtgtgccttggtttggccataagtttttggcccgttcgtcgattcgcgggttttttgaagaccttgcttgaggcttattagttcgagagccaagcaaggcatggcaaaacgtttgatcatattgtgccccaattcaaaattcccgcattttttttaaagtggctttttttacaaaggatgggggaggggccctttctcaaacccatattggtcacctatgcactggtaacttggtttcaaaatgacttaaggtggcttaggaaaggctatccatgctttgttcaacaagtccacacaaggggcgccactttncataaacatcggctttgtgctacaactaaaaagaggcccccccggggggcggcgagtaaaaatatataatatatgactttgaggccgtggtttttttgttcccctgcgggnataaaacgattacggaaaacattcggtggatatggtgtgtctctc

SEQ ID NO: 78315 - DNA, 1671 bp, Oryza sativa
taatctttataggcattcgaagaggaaaacctgcaccgtctaggacgccctgcaacaaggaagatggattaacgacgtccgccacagcctcaccattcctcttcttgatgaattcttccatgtttgggaaattttagcccgtgacaccccacaactaacagagggggtacaagactcgattgtttggcaatggacaactaatggggaatacggtgcaaaatccgcgtaccaattccaattcaatggaatggtactctcgccatcaacaaagttgtcttgggaggcatgggctccggcaaagtgcaaaatctttagttggttggttcttcaaaaccgggtgtggacaactgaccggttacagatcaggggatggccaaataattatttctgccagctatgctttcgaaatctcgaaacaatcgaccatcttctgtttgaatgcccggtctcaaagcaaatctggtttgggattctcacatggctgcaccaagggcacatcatcccgaaatggaacacaagtagaaacctcttagattggtggacacaaggaacaagcgacccggaagcaacaaaacagaaaggactcagagctctcttcttgctcattgcttgggaaatctggaaggaacgaaatgcaagaatcttcagagcaaaggaggcgacagtacaccagatgattaggtgcttatgatatgagtccgaatataattctattctaacatttatgaaaactacaagtcctgctcatcgactacattcacatattcatctcaaactcaacatgttttcttcctacatctcatggaataggttctccgaggcaatgcattcaggaagtaaaagcctctcagcttgatgttgtcattggatccaaccacgaaagctatcttgttacaatgacatcattgaccacatgtaataggcaggggcaaagctaggtaggaagggggagggtgcccaggaaccagttaagaaaaattttttagctacaattcatctatgttcacaatatgtccaccggtaccccctcaattcaaactcgagactcgctccggtgctttctacttggagtagaaaataatcccggccattgatcgtatttaatcgtaggggtgagaactagttctacttccaccccaatttattggagaaaaaatgtgggacggctatatttgttccaccgataataaatcacctaagggtattaatcccaaaaccggcattatctaactgttcaccctgtccctattctattctaatcgaggccatttccctccatttgcccgccaaaaacaaagcccacagccttatctgctcgaacccccccccactgtttgtttgggaacatccccaaatagttcatgaaaaaaaggtttctcaaagcgaaaaataacctgccttccttaaaaaaccaagtccccgacccccttttggaggagcgtaaaacagcggctctctgtgtaaaaaaccgcgcccaaacctatccctggcaaagaagacccaacccaccccccggacaaatggaatttccccccccgcgcggggtacccgccctcttatggaactcttattcaaaacccccgacacaaggccttggtgtttctcccactcaccaagtttttaacccctcccctttatccgaagcgagccctcatctttgtgggacttccg

SEQ ID NO: 78316 - DNA, 2063 bp, Oryza sativa
ggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgtttcatactcccaaactgcaactcttctatcgctcgctgacggagcgaggggctcctcaccaggagaccgcgcaggcccccctttgccagttcggccggggaccctgggtgaggttctaagctcccaatctgtggaaggttcgccagactggaaacacacaagacacgggcgatgtatacaggttcgggccgctgagaagcgtaataccctactcctgtgttttggcggattcgcgtatgaagaagctacaaagtgcaagtcagcccccgattctcctgggatcgttttttcctcctcctcttttctaagtgggcaaggtcctccttttatatctcaaggggatcccacatgcaccatctctccctccctttctttcaacttgacttctcttcattaatggacggagatttgcatcgctgccatccgaatcaccttctgacgggacagcccatacctacctccacttccgccggaagcaggcgcgacgtgggagatggctgtctgctgacgacatgaccattgtcagaccggtcaccaatcggtcattcttgtccatcacgtgtcagtttaacaatctgcatgttcgcccttcttcatacaacatcttgcctgtaatggttaggatgaagcctggtatatatctgaccggaaccaacgtgtcatctccaggagctaacacgccggctccggctagggacgagtgcttggagactctcgtcctgactggacggggcgaggcgtgcgtcagaccgcctgtcgccacctgacccacgatctgaccggtctgtgactggtcacagaccggataaacgagcgcgctgcactgcgttacacgcggcgtgacgcgttcgtccaaaccgcaataaatgcagttaggtgagcgccactgtgctcaccaaacccatacacgcggcgcaaaatccacaaggggtcggggcgccccagccctcggggccaaggcgggagcggtccgaccccctcggggagacaaagaggagggcgaacacaccaccctcgggcccgacgccccccccccccgagggtgccaggccacgtgggcgattgtgtctacctcaagcctctagtcacgatactcccggtcccatgtcatcgacagtagcccccggcgttatgccgaggcgattaccctcctcgagggaagcggtcgggcgtgacgccacttcctaaggcctggtgacaggtgggaccggtttccacagttgggcagaaacccaacagtcgcaaatcacgcacatcggcaatggttactcggctgtcaataatgaacggtctcttcaagactgccacattacgcgcgaatcgggacgtgccggttcgttttgcctggagatatggtgatggcgcttcggtcggcgagcgtaattaacgcgcgcacgagatgttccatctcgactgccacagccgcatatccacctcatgcaccgtaaacgggcgaatgggataagtggaagagtgggcgcgagaatcgagggggcaagatagtgggcgcgagaaacgaggagccgggcacagcgttggcaagggtataaagtcgccgaggaagagatttgcttcctttctctcgccattattccccttgtcttcgccgcttgcgccctaactccttgtttcatgtgccctaccttcgccacacgcgctcgctctcaaacatctcttcttccggcgtcatggcacggggctccgctccgcttgacggtagcgtgctgccgccttcccgcatcgtgagcgagagacaggccgggctgctgcgccgcttcatgccggaatctgcgaccggccaggagatagtctcgctgggcgaaagatgcccggcgccacgctacccggggcgg

SEQ ID NO: 78317 - DNA, 3049 bp, Oryza sativa
  unsure (1)..(3049): unsure at all n locations
agaaacggtctctggtgcccacggaacaccttctcacaccctgtgttgttaagaggtaacacggttgagacggccccatccattttaaaattacaggtctcaaaacgaaactccaaggggtccgggaattggtctggttggccgccctcatttctaataggatggaaccgtggctttaaccggcgcaaaccccgaagagagaaaggcggccgtgcgacaatgattgtggatgccacacgttggggaacgaattgggatccaccgttgtggcggcgcgaaattgaagaagggccgcggctatcatgatgggcncggtacgggaatatggggcggcaaatgttcggcggcgcaaaagaaggcgcgcccccctggggtggcgtcgttgcgccccacgcgggggaagaaaggcaagcgccccctgggcgtcccctggggggcgtcggttgcgcccaccggcggcatcggtagcaccaaaaggccggcggtgtccgccaaaaagggtgacggtttaaccggcgaaaacggcggcagcagcgaattcgtgggggcggttagggttaaaccctacccccccgacggcttcccctgcttttttgctgagggccggatgggcgggcccaccgccccccttgcctgccagcctagtgccacacggtggtaggccgaatcctttagatttcggcccacacccaatttaccatttaattttagtttttaattttattttcagcagcaattacattttagtccctaatgttttatgtaatttagtcgaagcagttcatcagttgtacaaacaattatgtaatggtcctatagaccactgatgttatgtgtttattaacataggtgtttatttaaataccctgtttcactaaatttatttgttgtcttaataacatgccttttgcatattatttcaagacacgctctactttctcgctttattaatttacaaaattctataaattctgtattttgatttagcaaattctcttaattatgtacaacataattaatggaggatttaatacatgttccacttcacactttgacttggaaattaatcacatgtcgatggagtcctatactttggtcatatcgaccataacttaggcaacgagtatctcgcccatcatcaagtggtctacattttgagatgattacccgatggagtcctacaaattgaccgcactggtcataacctaggcagcgagcatttcgcccatctcacagaggtctacatctcacgatgattacccacatgtgttattttccgagaatatgttttgaaaaatgagattatttgaaatttggttgaacacaaggtagtggagtcctaaacattggctgcggtatattcaccagaatatatttgcctggagaccgtgttttaggcagcaagtataacttgcccaccattaagagatctactccactgtttaattacttggatattatccacattgtgccacctaacattacagaatatgaagtcttacatttcgcattgagattacaaccacaatatcatgtttttattaatttacctctgtaaattaataatgttaaccatgattgtagggacatggcaacaaaagagttcgacgaactcgccctcgatgggactaactatcccatctgggcttctgatatcaaaatcaattttgcctctcgggggattttaaatacaattgaggaacccaatgatggggacccagcaattgagcccaggaagctcaatacagccctttttcttttaagactctacattcacaaggatctcaaacatgaatacatgttagagacgagccctctcaacctttggaaagctctaaaagagcgttatgatcagcaaaaggaactcatttggcctgaggctaattatgagtgggttcatttacgcctacaggactttaaaactatggcagaatacaaccatgctgttcataacatttgttccaggttgaagttttgtgaacaagagccaacggaggtagaaaagatagagaaaactctatcaactatgcttccggaggacagaatactgactcaacagtatcgcgcttacaatttccagaaacattctctgcttatacatacattgactcaggcaaaaagacaccatgagctttctttaaagaatgcccaatagcgcccaccgggctctgctccactgcctgcacttcaatgtacagaataatgctgagaataagaaaggattcaaaggaaattcttcgaataatcctaagaatctgactggaaagcacaaacgcaacaacaacaggcgcaaattcaagggtcggaagaaaggaaaagggaagggtaaggcaccacaacctcgtagcaatggcaacaagcattgcaacaggtgtggatctgacactcatgtcgctaaaggctgccgcatcccgaaacatcttgttctcttgtaccaaaaatccctcaaggacaaaaaaatcttctgagaacccaagatttgaagcccacttcaatcttacacatgaagagtgccctgaggttgcaagttctcaccaggctcctgctgacccagagagcaacctcaatgttctcccagaagatgtcgctccactctctgcgatggatgatatgttcatcgaatactgctcaacggacccacttgttgatgcattccacacttggcatgatcgacttgggcaccccggtatcgagatgatgagaaaaattattggcaactctattggtcatcatttgatcactgataaattttccaaaccctctgatttcgtatgcactgcatgtgctacttggaaacttgatttgagaccatctttatctcaaattagagcagaaccacttaaatcncttgacgcatttcaggagatatctgtggccctattgtgcaaantcttgacccgtcaagtacttnatggntnttgattgacgcatctactagatggnctcatgtgtgcttctatcgcacaaaaccatgcttnngcaantatgtctcaatatanggtgaggcaanntaccctgactangatcaatcatctgttgcatgctgcga

SEQ ID NO: 78318 - DNA, 8091 bp, Oryza sativa
  unsure (1)..(8091): unsure at all n locations
tcagaaactaaaagtgtctagtagagttctgcactgtcacaccctaaaaatcccaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattggaaaaggttttaaaagttctcttttggctttgggccgaaagtcggcccaaaacctctctctctctccctcggcccagtcggcccagtccggcagcagccgcccgtgcgcgcgtccgcccgctgacaggtggggcccacctgtcagtcttcgtcttcctcgcgccgctgccgcgcccaaaccctagctgagcagcgccgccgtctccttccaaattcggccgcgcctttcctttcccggtgaaatcaatagaggggaaatgatccccgggatcccctctatcttttctcttatggaatcgtcgccaattcggtttggaaatccgtggattcgagttcaattcagatcgatctctctcctccgaaccctaaaccttccatcgcgtcaccggtcgccgtgggccttcgccgtcgcctccttgcccctataaaaggacccccaagcccgccgctacccgccggcaccctcgccttcgcctctcgtcgccggtagagccctagcaccctgtagcctagcgccaccgtcgctgccgttcgtccagccgtgcgccgccgccgctccggtcatcgtcgtcgtcgctcgggaaggccgccatcgtgatcaccaagtcgtcgccgacctcgtccgcccctccgccgtcgctgtcgaccgccggaacaccgccgtcgtcatcaagccgaaggtcgccgccgcttcttcctcgacgccatcgccgtccattgatcttccgccgttgttttggtcactggtgagttcgccgcgtcgccctctacgtgttggttccctccgttcgcgttgtcgtgccgtcattcgccggcgagcatgcacgcccgagccgccgccggtggtgacgtcaccgctgacgtcatcgttgccatccgtcgtaggcctgtcgtggaccgatagatctcggccgttcgtttttggatggatcggtctcggtcgttcgtttccgtgagccgtcgccgtgcacccagtccatcgcgaaccctagccgatgacgcagtaattcccttttccttttcaaaaataattcattattgcgtcataattcaattaaaatccatacaagtgttttaatccgatttaatcttttaaaattcataactaattcatcttagctcggatttagttggttcaagtctctaaatttttctaaaattgagatctacatgttagaaatatccacatgtactgttcatgcttgtttatgtgctgttttggtgattttactcttttctgtttagattccgacgtttccggagagtccgttttcgcaggagaagaatttgaagagtttcaaggccagcaaggcaagtcacacagatcccaaataaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagatatgattgtttagccatgcttagaaacattagcacactattgggataacttataactcactattattcaatgttggcttaatgatagctcatgatggttaatcatgattggttaattaattaatttgccaactaaaacctgataatggtgggttgtgagcacatggttttgatggtcgtgctcatgacaattaaggaccggttcacgagttttggttgtgaaacattaaccgtgccaaccacaagccagcgtgggcaacggctttaccttttgtatagcatggttcattgcggggcaccagactgagaagtggcggagataagcccacgggggtcgctggggagtccatgccttgtttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattcgctcttggtttggaatggtatattcctggttttgagatagaactgtgcagccgggatggttgttcagaatggttgggcctatgcaacaggatatgttgtatagcgttggattaatattttttaattactacttaactattttattaaattctgaaatgtttattaaatgctatttatgcaaatgaaaccctactatgccatcctttgttatcctgtgcacttgcatatttgctgcgtggcttgttgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgagcgtgacaagttctcatctagacagcatcaccacatcactccatgcctcattcttaccattccctgttctagccatggactgtaatcgtcatgcaccaagctctaatcatcttataaaccacaaacacaaaggatacggatgaagccgagtgtccccattgtacatagtattcgagtaatccaattgttttggcattaatagttacaaattctgaaattgaagcagtgacaaataagatggatattcctcatccaaatatgaagacacgaatgagatagcattttcttgggaagaaatgtttgaatcaaaacaagagcggaagctggcgaacaatgagcatgattatgaatgcattaaaacaacagcgaaatttcttcgtcttcatctactagtttacaagaagacatgcatcacattcaccagaaaatatataccccccacaatttccgtaatgagcaactatagggttggcgcacagtatagtagtatagtagtaaactacggtcaagtccgcaatgagcaaaatgtggatgccaaaacttaatttttgcacttgcgaaagggttccgtagagaagtgctctgtaggcaccagcagcgcccaccccatcttgccattcgcacgggagtgccactattgcgaaattcttattggtgttggttgggaacaactataggtgttggtttaacagtaagaatcaacttggaaataccaatgcctaatagtatagatgtcgatttaataactggtacctatataattgataataggtactggttttgtctagtatccagtacttataattgataataggtgatgattttctctaaaccgacacctttaacctattatttagggttttgtagtagtgtgccgacggcattcaggtgccgttgcgtctgccagtttggttttgtattatactagcaagactttaaattgaattatttgagcactattttacgtattatgtattttgttcttttttgccgtgtacggtggcagaacaacatacatacgacaaatgttgggttgtttaatttcatttcttgctctcacttagtgccagacacattgcctagtaaatttcttcactacaagtaaattaaagcagaataaattgctctaccaaacatccatccctcttctagttatatacttcgtcccagggctgaatcagctggagggcttcctgagaaacggcgacagaaatagcatgggaaggttcttcgtcactcaaacaaataccccaaatttaggccttattagttttgaaggattcctaaaggaaatctcaattcctttggaataagcaatattcatgcattcggtttgtaggattcattggaaaattttccataggaacactatgccaatcctccaaaaatcctccaaaatatactaattccataggaatgaaaacattcactctatcctcttttgtttagctcggtggaggaaaaattcctgtgttccaatcctttgttttacacatggattcctatattattcctacgttttttctatttctgtgatttggaaatcctgtgaaccgaataagccctacttaggaagcggcaatgaaaaagaacgcgtaccatggcaataagagaaccttgtaaaagaagaaaaagctcctggaaatccaaatgttaccgacaactttagaacatataaaaataaaaacaagatctttttactaccaatagagaacaccataaaatggatttttttgtacggtggcgctaatacgcgcgctgcgcgtggaatattagtttgagcaccgcacaaccctctctccttccggttttctcttttttattatcactccaccttccatgtttcttttttctcttttccatctcatccgtgcttcatcaaaaggcccggaaaaatattaaccatccatattttttcctctttcattccttctctgcattttctttagcattttagttttctttatctttttagtaaaatatttatcgtgtagtttttctttccgggttttctgtttttctagtgtctatccacgtttcaaaagcaatgaatttactccatagaatttttcatttactcccagcctaccacatctgctcattcaaaagtaacaaatttactcgcatgaatgcccgtcatcatacaacaccattcctagatgtccgtaaaagaattactaccagcttgcaatgctagtaattcttttaccacagttatcaatattgtttagacttcgtgatctacgagtaaaacaacaccttcctctcgttatagcctatgatctcgtagccactatgcagtaatatgttactgatgtgttcaatacacagtataagagtaaaaactaatataggagtattgttaatatccgtatcacaaaatggttgtacgaatgaaaaacattacaggctcaatcacacacgactgttaatataactcacagatgaattaaactaaaaaagaaaaaaataattcagccaaaaattcatgatgacgttgggatcctggtggctttgctggatctttctataaggatagagaggttggtttgtgtcatgtgactggtagtggagagggcaaccaggtgacgagcagtagtcgatgatggaatcatggaaagatgtagcggcgtggtacatagatgagctcacatttgcgcagtagcaaccttccatcatctagcgagcatgaaataaatgcaaaaacattcttgttcatgtcattgagacgacgagcaaaaacattcttgtagcggccccgctcgcttctccgccccgtgcgcgcgcgcgagctgcgccgcgggcccgccatcgcttccccctcccttcgacttcccccactcgcttccccttccatctccttctgccacgcttgcttctccccccatgcacgcgtgcgcgagctgcgtcctggacctgccgcggatgcagccgcttcccctccccgcgtcgcactgcctcccccatcccccacgcgccagccacgccggagctgggaaccctagcgccatgccggcctcaaccgccccctccctcatcctgttcggcgttacatgcggtattcacttcatcccttaatcacgcgtatttacaatagaaaccgccaaatcaattgggtgaggaggcgcactggttaatataattcatgtgcctattctgatttgtctttcataagtctcttgcaaacttgataggcctcttgcaatccccgctgcaacccggcctctcctctgatctatacctccctcacatcaaccgttctgtgtgcaagcctcaaccctgcaccccttcatcctacaggtgcacatcattgcaatcgagtcatgtaaggttagttgtcaaccaacttaatcggttcattgcatgtaaacttatttactgattttatatgtctgaattggttatttgccatgggtactgattttaattcctgaaaaaaagtgtcaatttattctatttggtaaacctgaacttggcatgaattttgaccagattctattggagtatacattatgatttgaaccaagctgaagcattatgaaaggtctatcgattggtttctcccgcccgtccgcgagcgacctgaagcggatgtgggtgcggttcaagaaagcgccgcgcggcggcggtgaccgacattctccctgtgagaagattgagagagaagagaagagagataggagagctgccatgtgggcccaagggcatttttgacattttacacgatnttctctctcctcttcaactgaaattatatttctaatcggcgcggtgtccattggtaaattagcacgtntatggaatgttttccccaaaaatgagttcggacagtatcctacggctaaaagcacgaagtcgnaagtgttctgtagcaaaatttgccataaatatataatagatgtcggttttttcaaaaaaaaattatcttaatcttaatcttaaatatttaaaaaatccataactttctgatcatcacctctctttttttccgtattttcggtcgtaagtccgagagtccgtacattgtcctcccccgcttaagcaaaatcaaacaaaaacagggagggcggatctgcgtgagagagaggcggagagacaacgggaaacaggcgccgacggcggatccacacaagcagcaacgatggcttagagccggtggtcgatctggtcggcgacaactcgggtggaggagggagacagacgaagaaagacggagattggatcagggagagtaggggagaaaggggatttcatcggctagcgatttcgtcggacatcaaggttttcgtatgcccccctctggccggttatttcatcggtgcaggaccgatccgaactgcgccaccaccgctgttgggccacggaagacaactgggccacgcagagttctccccgcattgggccgtcgccgttagatgggccgttcgccgcgcgatcagctcgtgcgcatgtgctaaacgggtcgggccaattttttgggccggttatggaagtaatgggccaaaataaagttttatttaatttcgccgaattaattcatttgattatgtacataattttatttggcattattttgatccatttaaaattgctggaaaattatgatcaattactcagaaaatatatatttatatgtatatatatacctaataaaaaaacacaaaggttccgatttattttggtctgttggtttttttggtttcgtccggttttttgtcgttgttttttcccgaatgcgaactgatctattgcaccgtgcgccttctgtagccgnccaagccgaatctgaccgattggtgatctttctggactttttattccgaattttaagctctaatatggggaaaacagaaagggcatactagcgtagggctaaataagaaggaagaaatgggctttcggtgcaaaatcaagaaaaaaatttcatcaacttttaaattatagtgtatagcaatcccaatattaaaattctcattaaccttttcaatcgacaatcgcaatgtgtagcgagagggataagcctatctaaccaggccactgatatttttttaaaaaaactacaattatagtagacttgtta

SEQ ID NO: 78319 - DNA, 2034 bp, Oryza sativa
gaaaagaggagatatctagatgaaatcatttgataatgttagtttgcattagcacgctggtatccttctgtttatctaaaaaaacagccatccttcttttcaaagtgctataattgagtgtatagatatccatgttttgttcatcatttcaaaccaattgtgcaatgtcaatgattcaattaatggttagatcagcgaggtctattgggtgccggatctttgtgtcaaatccatgccagctaaatatctttcacattgcataatggttactagttcaatactcaatactaacacaatatataggtgcttcccaatacatcataggaaaaaggttaggaattaggactttggccaggggaagttgacaacttgattcattagaatagttttttacttcatcaaacattggttaaaaatcacattgctcatgaaaagatcaattgaaaattccaagtttcaagcataactacagaaggcacatacgctttcccgtttgtttagctcagcctcctttgcctgcagttctttctcctttttcttcatgtcctgaattacatacgaacatactcaatgcataagcaaccaaccacaaatacagcaacaaaagaatatatggtatcaaacatccaaaccaaggaatagtgaaaccatcattactagattaattgtgttcttcagccttttaaagagataagataacaaaaaatgaagcatgcaactgttgttacacactaacagagtaataatatcagagtgaaagagctaagtacagtatgattttctcacgctgaggtacagaacataacttgtaaatatagtagcacgtagtattaccgctcaatggaaatacaagtaccttggttgaatcaagaggtatgtccactgtggcaccacgatcattatagaacccaggttcgtgaggaagaggtggcatccgagagttggaagctggaggtacacttccaccctgcagaacagggtacatttaaaaatgaaacaaacagatagttgaaggaggctgctaaaattagaatattcagccaactctgttatccctttttacgcctattggccgaaagctcaaaatttgacagtttagaaatcctagatggagcatgtgcacgcatacgcacaattcacatgattatggactcgctgacacgtgcatatccagcaaactgagagtaaactgactgcaggcttacgacactaaatgtttatactggcagagacaatcttcaatctcctaatgttatagacgatctgaaccaaacaagtgtgaactgccccattttacggatattttccaataattctaagagtagaccgaccattttcacaagttatacatatcgattgcaccacatattccctcgtaaaaccagaaacataacgtcccaacacaacctaagagccaattttcaatccgagcatcatttctcctatgaaaatgtataacaatacaaggggaaaagttgccacgcctcgcgatcagctagcaaatagacaagcaaaaaaggccgtattcgcgccatccaagtccaaccccctaacagcggatcctaaatcactaaccctagcgccaacaactcaggctgatccaaagcaccccacatggcgtgccgcgtgcaggaccagacgaagcggccacggccagaaaaccagcacaacacatgccaatccgggacgcagctcgactaccccatccacacaggcgcgaggacaagcttctccatgcctagatgaagcaaggaggaggcgcgattgcgacgcggagggggggtttagccccccgacccagctacagcctaacccagcagctcaccgcgaaggggttgacgtcgtcctcgtcgaaggggttccggtcgtacctccccgccatagctcccctccaccccaactcctcctcctcctccggaagcggccgcgtcggtggtttctctctccggcgagggaaggggaacgcgcgtgacggtggcgaccaactgctccggcctccgggcttccgcttttacgtaacctagtgggtttgga

SEQ ID NO: 78320 - DNA, 1016 bp, Oryza sativa
acatcaccaagaaatgcatgctgtctatggaaagttagtatattctgaactgatattggtttcctttggaatgtgctacaccaagtctgtatttgaggcaatacattaaattaggatatatataagagaatacttgaggtcattgttgtggccaatgtattgacaactgttcattcttcaatgtaatggtgcttactgatacagcgaatcgatgaatagctattcattaatctactggttgaactgcaaagtatatatgttacaactcaaatcagaggaaagctaatcaaatctccaattttgtttggttgcatgtatatacttttaccatttagagtcttgtaaaattgccgcactgcgtgcgccagttcctgaatcttctcccatcctggagcaatgaacttggcagtttaacattggactggttcacttgctgatggcagttccaatctcccttgataactagggatcctagtagggttcttgtgttactactttgatttttatttagctgatgagcaatggctggcaagacagtaaaaatcctctctagttaaggaccccaacatctgtgctttgtatgatctctttggttcaggacttagtcatttgaatattatctacattatacatgttgatgtagttaggtttgcctattatcagagctgtagactaaggtgctatattggaccagtcgatgtttggcgttccattttcaatccttaccttttttttttcgttttgcagaaatccgtgagaaacacaaattggaactggagaatttgacactaacaaagcatccattcaggacattacgttttttcatgttagctatgttgcaatacttgaaaagattagcaacatatatcctgagtaagggtgctttgtttgttgtcctcattgtgttggtgctagctcctggaattttacttgcggttacagatggtctgcataaaaaggtgtgttacttcctgtaatttgattacgatcgcagtgcttgtgctgataagagtaga

SEQ ID NO: 78321 - DNA, 42045 bp, Oryza sativa
aaacgactccccccaagtcccaactccacttgatattcgccgtttgcgaaatttagtggtcgtctgatcagccggtcaattcttcgattctcctatgtgcaagggaagagaatactacccgcccgtagcttcaaatgtactaggctgcttgttatatgattatatccttctggatcagtcctgctgtcctggtctattatgcagaatcgcagatcgactcggagcattccaacttcttccaggtgactaatctgaacttttcacaagtctctcctgatccagaaaaccagaaacaaaagataccacaatagcattacattgcctaattgcagtctcagtttcacaccgcacaatcggtgtgaaccatctggtaattgcctcgccacggacagatggaatcgtggaaaacttgctgtaaattactagattattagtactattagttaatgattacacgagtaggccagccatttgaacacctgtaatgcagagtgtccgagtagtgaggcgatcacctaatccgagttccagttcaaagttttcgtctgattttctttttgacagttaggttttgctgcctgctgaacccaaaggaccagggtttgaaccttggacaagtttggtcgatctgtgcgtgtttatcttacatcttatcatcaaagtactaccactattttgtttgtggctgtggtcttctgttctggttcagtatctattactgctaatttacatatgtgaaacctttcatgaaaacgtggtggcagctcactggcctgcaagcacgtcaaactaccacagttgcgtactactgttgaaattctgatctccggtttttgtcgtcgtcgtattctctgacaaaaaaacaagcagcagcgttttgttttgttttctgtcagagaataagtgcagccataaatatacgtgcacagctttttgaccatccgtcttatttaaaaaatttataaaaaatatttaaaaaattagtcacacataaagtactattcaagttttatcatctaataacaataaaaatattaatcataatctttttttaaataagacaaacggttaaacgttggacatgaatagtgctaaaactacacttatttttggaacggagggagtacaggctacaggctaggggacgtctcagcatggggagttgggaatttggggttgttttctgcagatgcaaacagtcgtcaggccttttccttcggagagaatcgtcacagaaaattggtctaatttttgtgtgccattgaaaattgtttttttcctatattccattgttctaaatttgtgcactctctcatgtcactcccgtgtgttgatcgttatataatcagaatgataaatacgtcttttttatttgagagttaacggtcaacacacggtcaacagatgtgagtgtcatgagagggtgcacaaatttgaaacaatggcatataagaaaaaagtcaattttgagtggcatataaggaatcagactaattttcaatagtatataagaaattctctcttttcgattccttggttgatacaaggccacgaccgcgaaacaatcagacacaatagaatgcaaaatggatgtaagaaaaaaaatgaacttgtggtagtggttctcctataccaagtagaaacataaatgagagcaacaagacgtgtactgtatgatagaacgagagaaagtgaccctattggaatgttactggaggtctggagcacggacgaaaacgatcgtggcaatcaaagttaccttacgggaattttccaaggcataagccacagaggtagtagtaaatactactcccccgtagaaggaatgattcaacgggggtggcgagccatgaaatcagttagcgagcactcccccttctctttagttttaactatctatattagttaatatacttaacattaatgatagtaattagacaagattctgacgatttttttgggagatttttttactaatagattaaaaaaaatttaagttagatttgaaaactttcgatttaagttttaaattttaaagtcaaatttaaaaaactttcaactcagatttgaaaactttcaacccagatttaaaaactttcaactcagatttgaaaactttcaacccgagatttgaaaactttcaacttagaatcgaaactttcaactcgagaatcgagattcgaaaactttcaagtccagatttgaaaaatttgaaaactttcaatttgagattcgaaaactttcaaatcaagattcgaaaactttcaaatcgagattcgaaaactttcaaatcaagatttgaaaaaaaataaaaaattttaaatctgaacttaaaagtttttaaatcgtcaagttcaaatttgaaaattttcaactcaaaatttaaaaactttcaaactcaaaatatgctaaaagattaaaaaaataatcagaaaaaagtgtgaaaaaaaacgaaaaaatcggaaaaaaaagaaaaaaaaaaggtaagaggacgcgcgcgcgcattagcttttccgaataggggggtggctagcacgcgcgtgcgcgccaggaaagcagttggcgagcacttccccttctctttagtcttaactacttatattagttaatatacttaacactaatggtagtaattagaaaagattctgtctatttttttgggagatttttttacttacagaataaaaaaaattaagttagatttgaaaactttcgatttaagttttaaaatttaaaaactttcaactcagatttgaaaactttcaacccagatttgaaaactttcaacttaagatttgaaaactttcaactcagaatcgaaattttcaactcaagaatcgagattcaaaaactttcaagtccatatttgaaaattttgaaaactttcaatatgagatttgaaaactttcaactcaagattcgaaaactttcaaatcgagattcgaaaacttttaaatcaagatttgaaaaaaataaaaattttcaaatctgaacttaaaagtttttaaatcaagaatttaaaaactttcaaactcaaaatatgataaaagattaaaaaaataaacagaaaaaagtgtgaacaaaaacgaaaaaattggaaaaaaaaggaaaaaaaaagtcagaggacgcgcgcgccggggctgggccctctgggccgaaacgcgcgcgcattatcttttctgtgattcaacgggcaatactgacaagaaggtagtcatgtgcaggtgctgtcagtctatcagcatcgacatctatgcctgattacgagaacaacgtgctgctaatcccgggccttggtataagattctgaaaagtccatcttgatttagctttgttcgaatagtaatatttctcaaaatactctaaaaacgagctactactatgtacgagcggcacccttcgaatctcaaaaataatactatacagtacgacattacggctcatcctactcgggtttcgacgtattagcgtcatcacgccgtaacatcgatcttttgaaattgggcatagaccatcaaccaccgtcgtctgaccacgaattccacgaaacatgtgaagcacacgctctcgcttgatcatactgcaaaaacgtgaaacgatgtatatggcgtcgcggccagggcactcgcgtaagcccgagagcgatatggatcgatggtggcgagctgatagctccactgagcgcgccggagaagaactctctcgtctcgtcccgaccgcccggccgcccctgctcaccgaccggtcgtcacgcaacgcagcagccaccggcggcgaatccgtttccgggcttctttggtttagtgccctactaaagtattaaagtattggtagtgcgaaaacttaggtatgttttggcactatcaatattttggtagggtagcattttagatgaatggatttgtattgataccaattggagaccaaattttatattatagttaagaaagttctagaattatgccggcagacagcgacggcgaaagcgatccggagaaaccgctggcaaaagatactgttatcactgtaaccgtcaacgacgatgacgacgcattccccctcctccctcccggctcctgctgcccgcaggctcgcctcgcgacctcagagcaagtttaatagctaactactgtctctaaatcatctataacaaatcaaatagtccacttataaaataggtaactataaaaatatactacaccattaatacccggtctcacttgtcatacacacataacgttttggagtccgtgttgcagctgactataaatttgtagcccgctttcttctctcttcttttagaaaatgaaaatgggttatatctccggcttctctcataagacacacaatcataaatttaatagtaataaaaatgtaagataaaagtaaatcaagatgagaaataaggaggtgggataattctctcccttaatttttttcttgatatgtggttatagctgacttatagtgctattgtactgctctcgcgccgccgcttctgctccatccttccagcgaaatcccatgcgaaaaccgaagacggcaaagcgtctagctagcttgtcgcggggcagcaggtgggggaggggaagtaggagagcgtgtgaaaccaagcaccgcacgggcaggagcgcgacgacgcttgatagccaggtagctcgtgaaccaagcccaagtagggatggcaatgggtcaggtcgggtacgggtagagcaaaaccatgcccgatccaatgcctaacattgcccacccgaaccctacccactagagttagcgggcaaaattccgtgcttgtacccatgcccgacgggtacccaatagatctcgcatgaataataacttgaaagatatgtaatttaacaaagagaaataaaatcaataatttaccaaattatcggttattgacaataatttgaattacatcacaacttagtatcagttagcatcacaaatgaaccaaaagaaatggtataagaattaagaaatgagtcaaaattagctaatacatatgtatcgggtcgggcatgtgttacctacgggtaaaaaatgaaacccgccagttgcccatgacgtcttcgggtctcgggcggacgtgcccatgggtaaaaagtcacacccacgtccatgtccatcgggtcgggtatccacagatacccgaactcatggataaaattgccatccctaagcccaagattccagcgttcaggccaaaattaaacggtgggggcgcctccatccacactccagagagagtgctaactaattgcatatgcgcactgcaaaacaaagatatggtcctgagccacgcctaaaacgacagatccgtgtgtagtgatgagtgtgtgaactgtgtgtaacatgcaatggagaaaagaggaggggaaggaattgtttttttgaccttaaactaatctggcatgaaattgacgtagtaccgttttgcttgagcatgaaagaggacatgcagtgtgtactagccctactggcttttgtcttaaaaaatgcgaaacaaatttcttgttacatagattttgtagtaggggctcatacgacgaacttagcatgtatttagtttagaaacaaagtgagatgggttggactcatccctatttttaggatggaatgatcctatctatctatttggcataagggatgggatgatctacttttgaaggaatgtccacaagttagtgagagaaaaaagtaggttcgattggtccgctagttttttaagggccactaacccgtatcctaggggatatattccttgtcggggaccatcatatcccacatgtgcctaaacaaaacactgaaaaatgggttcaacccaatctaatccatcccaaccctttaaccaaacaaattcttaggctgcatttgtttgagcatttcaggtgaaacagttcgtgacttataaatttagaaaataaatttgtttttggttttttctaaacaacttctatatgatttatttccacaaaatataatattaaaagttcagggagcattgctaatgaaaaacaagaaaataccatttcaagttggcgaaaagaacttagccttggtgatattttgtagaatcactaacagaaacagaggacattaccattcaaaaagttttgtgcttttttgcgaggattaagtaattttttttagatgaaaaatccatttagagaccttgaaatgccgttccatatctttcatcccttggcataaaatttttattctacctagccatataagttaaaaccaacaacaaaacaatgttaggatccctttgatttgtaggggaaacattggagtttgggaggatttcaatcctatagggaaaaaatcctatgaaaacatttgaaacaaaagattaaatcttattttattctttaaagttcctatggaatagataatcatataaaaattttggagaaaacttagcaagaatatatctctcatccgtttcctatgttttttttccgtggtcgaattaaatgagcttttttgtgtttgtagtccattgttttatatctgcattttcctggcataatcatgtgtttttttattccttcggattttttcatacaattaaaaagggcctttactagtatagcaagtttactgtgacgaaattggagacaatatgaattctttccatgtgaaagaataaacttttacgaagtattttaatttcaaagaagaaactcaatttcttctttttgccaagatgagctccctccaaaatcgatctaccggcatgaaccatccaaaccctccagtaggattacgcaccaaacagggagcctaccccaaccacatcctagagcagccactgtacagccgtcctggctcactgttcaaccgcctcgagattcgtgcactcttcccgtgaggcgacggacgatgattgcccaatcatggcccctccctccctcgggcagctccatcaatgctcgcgtgcgtggtcctcccccggagcttattactcccgaccgaccggcgggcccggcccggcgatgtgaggcgctggaccgatccgggccgtccgatgcaccaacggacggccgagatgctgaccagtccgatcccccgcttcgtccctttcccgtttgactccacccaccttacggcccggcccaccttggaaaactggacacacacacacgcaccccctctctctcgcggatttttttttctcgtctttgaccgggctgtcagcgtcggcggtgggccccactgccaccacaatgccatatctatgaccacgcttgcttgcttgcgcttggaatttgtggatattctcccttgcttggccattctctttgactaattttaagatcaagagagccttctagttctaacaaatcttgcacatttttgcatcccacaccctctaaaaatacttttattttctctggtcgtgtttgtacttgttcctcagggactttgttctgaaatttcttctccatgagctcagggagaagaagtgaagaactcgtgctggcgtgctgcataagtttctacgggaaatcttccactattcaacatgacttgtactaaccaaatttaactctggatttgcttctgctaactctttaatatagttcagttgcaatgtatttaggttaacttctctatggctgtgtttagttcagcgcaaagtttggattttgattaaaatttaagatgatgtgactgaaaagttgtgtgtgtatgacatgttgatgtgatagaaaaggactgaagtttggatccaaactttgaatctaaacacagcctatgtttggactcccaggaagccaatccataagggcaagctgcagaattgtcatctgctagtcgtctgaatctctttcagtctcagttgttcttttcatctaagcagtctacctctacggttagttgtcataatttagcaatgcagtatgtactactagtgcagaactaaccactagacagcttgtcaagctcaataattgtccctgaagctcactcttaatcaaactgcagcgtcaaatgtcggactggcgatctcgcatcgatgattcaaagactcagaacattgaacataggaatcaccgatctttgaataaactctttcatgttcttgccatgtagcaccagtattttccctatattttagtatggcaatggccaggtcattctggagctatttctagatgaaagagctgtgtgctccaaggaaaatttcttgttcaattcaacaatgagcaaaaagccaacacagtgacttcaaaacaagagatgccacatccttttcgcagatggcgaattaatctcttgcgttccatcgtcaatacttcaaactttcttactctcttcttcgattagaacaagaattaaaaacactgaaccgcagacggcaaggcaaataaactatgatccttcattgatgttttcgtttcgtccgggatcttcagacggcaggatagcgaataagcaagcagtggcaacttgtcaaacattcgaagccatcgcggtcgcattttattcgatctttctccctctgaaaagcaaaacaagaatggtagcgagagagaaaaacaactggagaacgatatgcccttttatcatgttagaattttgcacacgcagttcgtcatccttcttttcctgtcaagttgtattggtgaacaacctcgaccacgcatgcatcaaatcaatatgagcatcagaccataatcactcgaattgccttccagtttcccaattacacttttgcttatagtgatgatcaaagctgtagaacccaggctacatggttaaagttgatttcttcccaatggacgcttccacaaaactcttcgtgcttaactttgaacagaataattttgtgggcgagaaagggttacacaataaacatttttaaaagaaaaaccataaccagtggctataattaaccgtacaagcaatgtgttacccctatcaacacacagttgcgtcatcttgacacacgcactattcagaagaaaaaggaaaacctgaaacctgtttctgaaaatactggagcactgcagctgaatgttcatgagcaaaccacctttgtcggcttgtgaaggcaaaaaaaaaaaaaacaccatttgattttcaccgctttagaaaatcaccctgtgatgggtggtaccattaccaacacactctcatgtgcatcctgccccaccctcccattaccctacctttgcaaacgcatcgttagagcaagtttattagtatagccaactgtcgacttcaaattaactatagttaattttagagccaattcatataataagttacctataaacatatactatataattaatatattggctcgaaagctagcttatactagcctgctattgtacctgctcctaaaagtagttaattactgctaattacatggattagttgggtaaaagcggggttagcggggggcggaatataaaaatgccgcctgcctcggagcccctccaccggctttgaccagtgccgcgccctctcctctctgtcgcctcgccaccaccatagctaatcctcctcctccgtttattttacttttctcccctcttcgcctctcctcgctgctgttatatccgctttcctctcctcctcctcctatcccccctctcctcctgctcctcggcctcctcccctagatgccagccgcggcctgaccctcaccgctggggagcccccctcccattcttcgcttcccccgcggttgcgctcccggagcggcgttccagcggccacaggtgcggtctctttgcttcccctctgctgctgttgttgtgtgcggtttgcttggttataggtggattttttggggttatttcatgggtggttactgatgtttttttttccgttgctgcctggatctttctcatttggattatcatctgctgctttcccaaagcgcgctgctgtttttttttgtttttttaaatatttttgtttgtgtttgcgctcttgcatttataaattttcgccgaatggcaggctaggactttggatataaggtcgggggtttgaaaaccctcgaatttcataatttcccccaccaccgtttcagaagttcgtttggattctgtgaatgctcacaatgctgtatattagtaagaggtgagataatgccgtgaaggttttggaattctgctttcacggccatggaagctgcaaccgcgggttcatttatgatcgcggagcggtgaaaatttccagtaaatgttttgggggtggtgcagtgcttggttgttggggtcaatgacttagctgcaatagattgcttatttaagttggacttttgacccggaattgttaatttggtttggtttggtgagaattcgactactagattccgtctttggatatggaagtagttgcagacgcgcgcaatttctgtgaagttgcattggaaaccaaactaaatggagtggtgtgtttgaacgtccattgttgcgtctgcggaccaatgcatcacaccacctggctcctataagccttcgtctcagcttgtctcttgatagatcagtgaactgattgtgggaatgaggcagttttagtagtttagctgtctcttcttctccagtaatggtttggaagttcagaatacattgagaggtgttgtacttaaggagagatatcatagttatttttttttttttttttttttttgctgatgcaaggttcgacgccttttgcaccttctgttgtactgcatttagctttagcagatgcaatacatgacaactttttattgttgccgacgactaactgctatattgtgatggggcagctacttttgtgctatgtgctaactcaggatcctatttgaaattctgtagcagctttccctcattgtacacatgatgggttgcttcactgtcctgagatccaagaagaagaagcctcttgctctcaccaagaaatcggttgatgcaagggaaagcacgtcctcaagactcccagagccagaagcgcatgtgccatcgttacaatctgctcctcctagttttaggaacaaggctaaaatccaccaatcggaaaagaaagcttcttacagcagagcgcgcgtgctgtctgctccttccagcctaattgtggttgatcaggatggtcttccatatgccgaattcgatgatcaagatgactccaggggcaagggaggttctataaagggccaccgtttctctaatccactgccccttcctctcccatcaccagaaggaaaatcattgaggaactttggcagcttcaaagccatcaatgcaagtggaccactcgatgcttcaggccctctgccacttcctccaaagaagtgtgatgggcttaagaatttctcctatgaggaactttcatcagcttgccaatggttttctggtgaccagtgtgtttccgaaagtttgacatcaacatcatacaaggcgtcctttagggatgattttaccgacccaaagaccattgaagcaatagtatctcggttgctctcctccactcaggtactgttctccgtaatattgaattatgtgtttcatcttctttgttttcccctggaaggaagttgtattggatgtaaagcggtagctttgccattttgctttgttggtcagcttgtcaaacagatggttggcatgttatggcttacttttatttctctcttgctagtgagtagtgacttggcaaaatgcttgtacactgtaaggattatactcttttagggctttaaccattttgcagcatttcttctattaagaagctgaccttaggctagaggcacggactggttttgtaggcatgtgatctatgctcttaatgttacagctatgctgtctccagcagaaataactctttctatttttgtgaatgcaaaccaggaccacaccattggtggggttaggtaacatgctctggactttgaaggcagaccatgtgtttgatcttctttcttcactttactcctagatgctttctccactccttcctaatcatatccagtgactagcgagattttcttttgacgtttgtttgatactttgatatatgatatctcatgctttccactttatgtggtttattggcatggttctgatcttccctcacttgtattcagtattgaaggaatctaaaaaatcactgtagtgttattgtgtagttctgggaattcagtggttcactagactttgtattgtgtgtgtgtgtctaaatctgataccccctttggtgttacctaatgttgcagcaccgtttattggaccatcctgatctattatttacaatttaactggttatggtactgatgcaacacacattttattaatatgcagagtttgaaagagtttaaaacacaagtgaataccttggcatcacttcagcatcccaacttatgtaaactaatcggctttcacgcaagagaagaatctaatgaaaggatgttggtctatgagcgactccatcatggcagcttagataaactactctttggaagatcggatggtcgtttcatggactggtcagcacgtttgaaggttgctcttggtgctgctagaggcctggctttcctacatgatgaagggccttttcaggttactgcttctaaactttttctttttgacattaccaataagtgaatatttattttacctagttatatagtacattggttgatggtttttgaccttgtggtttaaactcttattcatatgttattttttttacaggccatgtacaatgacttctcaacctcaaacatccaaattgacaaagatttcactgcaaagctatcaggatatggatgtgttggattcaataccgaggaggaaatatcaaatgcatctgtggtaagttatgttttgaaaatattttagaagatatagttatcagagcccaactcatttgcctgatctctttctgtaaattcaagtagtgtgttttggcatggttaatactctgttcgtttgtatggattctgtgttgcacgccattgatattatttagtcccaaacatcctaatattttgatgtgtttttactttacttgtttgcattatatccatagtggtcaatgccattgtttaccgtggatgctattctttgttaggctgctgcaaacctctcagtggaaaccttggagaaaggtgtactgactcccaagagcaacgtatggtgctttggagttgtcctgctggagctaataacaggaaggaagaaccttgatgtccgttcctcaaaagaagaacgcaatattgtcaagtggagtaggcctttcctcaccgatgatagtcgcctatcgttaatcatggactcccgtataaaaggacgcttccctaccaaggctgctcggattgtagcagatatcatattgagatgccttaataaagatccatcagagaggcctaccatgagggccgttgtggagtccctagcaagcgtccaggacataaaggttccatgtcgatatcctttgcaagagccatctgctgccccaagaaaggtgatgttaaaatctacaagtctcaatggcatcattcatcaccatcctgtcgtaaccttctcaccgtcacctccttcgcgaaaccaacatttgctctcgccaaggtcatccacgtctgcactgcttcctccaaggaccagctgtgctctggatgaccctagagtaagctctatcaagaaatcgccttcccctattttacggagatctggtgttgagggtttttgattgtccatatttttttttctcttctcttcacttcgatttgtttgttgtttttgctagcctagtggttttagtgtaatctcatatattgcaagacaaatggccttatgaactcccttcagtagtactaagaagggaagggtgaactgtagatagaaccaggttgtagatacttttcgttttctaattggatggaagcagcgtgttgagtgcgccttgtaaactccattatgcaataataaacgtgtgtcactcagttcttttttggggagtcaaacatttcagctatttcggttgggtgccaactgccaaagtgccaagtggtgttgttgcttgtcggcacatagattgtccaatgttctaatccacgtgatgagatcatgtcgctgaagttgcaaggatccattgatgtaatatttgctgctgcctgtggcagttagagatgttgaatgactttgaatccctgcctgtggaaagttcatcccatcgttgcagttgttgactgcgacccagcctgcttttgcttctttgaccaaagtttgtcgatcgccggtcaaacttatctcaagcttaattagagtacgtaacaaacgttttataaacatgtgttttcaattggaacgtcagtgacgtctagttatgatgatgtaatggttggtggcatgaaactctactgcaacagtgcaacagcaaaagaaaattttgttgcatcatcattttgtactcagttcacatctgcaatctgctttttttgtgtatgagtttatagtactgaaatttctttcggcgactggaataggacaatgatcttcagacaagggtagtactactctgaagcattgatgacagctccaggtatcgttatgtttcttgaatcgtcagaagaattggtgcaccggacacggtttacttcagtttcttggtcgtcagtcctcgccatggtgcccggtggcggtgggtaagctgctctctttgaccggatcgcgagctaatcagctaactgtaactatctgaatctgatgttaccgtgagcgcgcggtggcctaatccaatgtaccggcagtgaatcatatgactcgattattcaaccgaaatctgcacagtttgttttgtccttggacactgtcacttttccctctctttttgctcgccatggctgtaaaggtatctatctgggcatgccaaggtccccgtccttagattgccatgattggatcggatggatccagcctaacctgatcggatattatcgatcaggaagatcagatcaggtaatacggatgattaagattttctaacttctctatgataaagttacaaatgttaagttagagaatttgcttccgatcatgaagaaagctacagaaactaaacactggtcacaagcaactatgcgacgcggattgtcacgttgcgtcgttgatcgatcaaaaattaaaatttcggtcgtcacggcaatttaacatgtctgctgttgactcacaaatcacacggctagttacatggcgtcaggtagtggaggtagtagtcaggtagtcgagaagctgcatcctcggcggcggcgccggcgggcacggcgcggccggctcctcgccccggcggcgccctccgccccacgcgccgccgatgccgagccagcagagcagccgcttcaacgcctccagcagccaggacctccgcgccggcgcacgtcccgctcccggtttctcctcctccttggcacgtcggccggcagcgcccggcggggcttcctgcttgtcctgcggcgcgacgacggcgagacgggacgggctcggctcggagtagctccggcgcaggacggcccggtcgagctgggcctcgatggccagccgctcgtactcgtcgagcagcgtgctggggcggaacgcgccgccgccgccaccgttcaggtcgaggctgaggctgagccgccccagcctggtggcgccggcgtcttcttcctcgactatctccatggcaatgccgccgccgtctagctgtcgcgccggctccattgacattgatcagtagtgttaggcagtggtgctataacgccattgttgccgttcgaaaagttgcgagttgtgggagtttgacgtggatagtgaggcaagcatcgccgcgtcgacgagctttatgagtttcgtttattgcactcaaaacattgttcaggtctggacctgtctcttttgttgaactttcatagtatatgttgtataaatcaatcttgcagtataaattgaagttcacacgctatttcgcacactgcttgtttggcaacgcagggaagaggattgggagtttagaattgatggtgagattaaaataggattgggagtttacacgagggaattgatggtgagattaaaatgagaatttgatttttaatcccagtatcttgtttggtagaggtagtggaaattgatagagagtttagttggagattagttcattaatgaaaatgaatggctgagatttgtttaggcaaagtaaaggaggaattccgtcccaattaccaccactacccaggtattgaaaaggagggagttcctccctcaattctctatccctatcccacaaaaattctcatgtatcccaactaaacaaaacaattaatagatgggactctaccaagaccatgacgatgacattgggctacattactagtccatgagaaagcccatgtaaagtaatgcatcctttcggaccaaattatgaagtccgggcctaacaagtgttacccaaagaaatttccccaaacacaaagaaatacggccccatcgtttcacatatgtgtgaataagccaaacggtatatttacaaataaaaaataatttgtgaataaaactttttatacatgttcatgttcttaatgatctaaaagcaaagtctgaaaaataaacctcaatgaaaaaaccccaaaaccaactccaaattaagagttgaaaattcaaaatttgtttgataagtaaaagcataaacgaaaagatgaggccaaataatcccaatccaaataacgccgccatcatctaaactttggggcctcatcttttcccttatgcttatgcttatacttatcagctaaaatttaaattttcaactttaaatttagaactgatttaatggttttttcatcgaagtttatttttcagccttacttttagatcactaagaacacatatacaaaattttattcataaattatttttcgtttgcaaatacgtcctttcatttattccggggcttttctctcccaatttccccgccgcccgaatcggccgatcggcaaggagttgagcgattctctacgcccccaacgattttctctcccccaaatcgatggcttctcgcaagtcgctacgacgatcggcgctgctccaactcccttgcggctgcttcgcggagacgagggttgtgctcgatgagaagacggagcacctccagctccctcccacgaggttggtccggatcacgtttttcgcagtctcgattggattcggcttgtctctgtcactagggtttaagggaagctttagggttttgatttttagtttcgatctcttcaggaaactgtattccgaaatacggcggagggcatggggaggagtggaggacacggctctccgccgccgtggcggccgtcgtccgcctatgcagctgaggcctgagggagatccccggctctgacatatcggtgcaggtgcgcgacaagccgcggggaagagttgttcgcctgatcgcctacggctaaccagaacgacggtaattgttcggaaaatcctaattgtctatgcaattgcttagttttgagtcgaatttgttaaggattgtgatgcagtcatagtatcagttatctgactctgttaccaaaattgccccggtttttaatttgtttttgctatacatttatcacacgcctgatttttttttctttcatatatactgatgctggccacactatgtattgaaaagaacagtggtccagaggtttatattttatagggagcgacaaatatattgactgataatctggatttatgctggtaacgaattggtttcatgagtctggaaaggtttgttttgctgttgagctacagttggatgagctttttttttccttccgtgcagaactaggtgccatgatgaaaattcggtttatgccaacttattatctaacataggcttcaacacaggactagaagtttgcaaggctgtaagaaggcatgcaaattagatcttactgagtttttttttcctgtcatttattcccttcttggagtgatgatgagaattttatcatgcccataaatctactcaagcaccatcattccatctatttcctcggtgtcttgtactcttgttacacacaagagctatactgtgagtttagcttatggaggtgcattgaagtcagactttgccatctgtggtatctggtttttgaaaatcaaatgtaagcttgaataaaatgatagtaccatggacaataggacctgtgttcgtaaaaaaaatgcacaataggattttgtcatatattggtgttagagggctatatctttcaaacagaacacgcaaccgaaattcactagtttgttcaatttgttaatccttttttgtgggtttgggcttgggctgtgaagcatgatccgattccaatgtctctgatcactgaatccaatatatgcatcacacatctttgttttcgtcatggttttgatgggaaatgtgcaagcctgtttcagtttttagagaagggatgatgcggtagtccaatatgcagctagagatgggagctcatgaccatatcgatggactgctaagatggcttggagggcataccggaacaggacaatatgtggtgataacagtgtgctgatcatcagacgtaacctgcccagggttttttagcaaatattctttctacatcgaactggctattactacatttcattttaggttggccagtcctacaattcactccagaattctgtacctatgtccaacaaggtctcttgcgaaatcctttaacattgatggtattataccagtcattatagcattgagctcattattgttatagttggtgttatatacatgttccccgagtcctatgtgctagataaggcttgagtctgcacatgatactgtcacttgagacttgagaggtgccgccctgctggccctcccactctataggtcaccacaggtccacatattccttttccctttttcttcctttatgtccttttcccctttgcatgattcctctcctcttgcttttggcctttttgttcacttaatgatataagcttgttagcatgacaaagatttatgcgatgccaaggttatttttaccttcaccaccttatgtccttgctttttgcacaagtcacaattttttttgatgcattatatgtatgtactcctaatattttctgagagagactttcacactttttgtcaaattttctgttttctgttgaatatttaagaactaagaactatttattgtcgctgagttctttcgtgtactattttgaagttttcctgtttgcattttcctagccatgctgccatttggaacactgtattaggcatgatcattgcgtgggtcggggacaaacaacaactgtaccgcaataatattttgggcatcaatttctccaggacgagctatatgcataatgcatctctgttgttatatttcccatgggcattttcgcatcgtcagtggtactgttgttgtgtcatttatggacaacttgagcatgcagagaatttgagagatgatttgattacgggcatatgatcccctttgtattgcatatagtgggtagtcttcttgttgttagcatgttcttctccagttaaagaaaagtgagttgtacggttatcaatgctctacatgctcatatggttgcctggcttgtagttcctgcattggcctgcttggtgttgattcacgacagcgaaaaatactccctagtccctacattagttcttcacagtgtgacttggaaaggtgataggatgtactccctccgtttcatattgtaagactttctagcatttcccatattcatatagatgctaatgaatctagacacatatatatacctagattcattaacatctatatgaatgtgggcaacgctagaaagtcttacattgtgaaacggagggagtatcaaacatttcagacgtttctgttacatgttttctgcaggacaagtacgagacctcttggcagaggcttggttaaaattcttgctttgctgaaggaagaagatgccaatggtccaacctgtgactgtcacgatgacaaaacgcattgccaggtggacttatactgtgatttgcttttattccttatctaatcatggtaacattggcaggaatggataatttttctatctaagctaccagaaatcattgtgttctacttttgtgtgtcatgtggaggaactttggggcaggtaaaccatgtgaccagaaagggaattcaacacttagttctagtggtaggaatgcagtcatatgttgatatttgccctggaactggaagcaaaatcataattaaatattttctgaggaacatcagatctttttttatttaattcatcctgattccttttctttgcagaactgccttcagatatatgcaattatccatatactttttgtttctattgcttctgctctcttctgcttactctctcttatactgtatagaaacatatactagctgaattccgcaacacaatacctttattttgtagcaaagcgcaaccttttcagagctttgcatagctgtggttgaattctttgtgaaaagaaagcaaaagatgataactgttccctttagaaacacatttcctgaaacatttgttgactgggtctaccacattcgagcagacgctatcagttcaatcaacaaactgcccaaacatatttgtatacaacatctcatatcctcacagaaagcagctacagtgagtgatctgtaaagtcaattggtagaaaatctgctgggtggcattaagaataacattcattgtttatgcaagggtgcagattatactaatgcaaaatatgattgtttggagcaaagctacaggcatctgcatgtggacgtggatctcagaaggtaacttgtgcagaaagactaattgagattgcattatgaaagacagcagtaacactagcagcctgtgggggacaccatcagcaagacagcaaaagcctgcatgattcatttcttcccccaccacaaagcattgaggtttgctctcctgcctcacttattaaatctcacttttccgcttaaactgttatagcgcagcaccctcgtcgctgtgtctgggatccacggcagtaaaataacattggcacatgcttactatacactggctgtctgttaattaagtgtcattggcttaagcaacactgcatttagaaaatgtttactactgggaattcacaatgacagtgacgtgaatgagctgacaaggaatctggggtggtctgatctcacttgcgtatttttaaaccgcgattaaaaaaagtcaatttgattggatctttaggttttgtacattctctcgcctaactctatctgtccttttatctttaacttccctcttattgttcacaatgtaatcttgtactgaatatacaaaatagtagagctggctctacatttttccgtaaaaaagagaagaaaaactttaggtgcttaatgaggtagataacgagccaaaccttggtaattaaccttaatgagttataaaagtcaggctcggcttgactcttgaaatggctcgttagaacatgtacaataacaaactataaatcagctataagcacatgtgaatagtgagtagagaaaagagaagcggacaatagtttgtagccagctgcagcacggactttaagatgatatgtgtatgataggtaagacgctgtgtgtatgataggtatgaccaaatattaatgatgtactgtatatttgtagttgattattatataaattagctattagattgactatgtatgatttggagctagtagttggctatactattaaacttgctcttaagatatattctatttaacgagcttcatcttatttatatcacctttataatatcaaaacattctatcacatattaatataataacaaacgctaactaataaagagttcatcaaatataaagagactagtcactacttcctccgtttcacattgtaagactttctagcattgcttacattcatatagatgctaatgaatctaaacattatctaaacattatatatatatatgagcaatgctagaaaatcttacattatgaaatggagggagtactatagatgagaaagaagtcttattctaagtttgttttaagtcggaacattttaatctgtgatcattaattcttataaattcatatagtttatcattataggttttatattttcaatccatcatgaaacatactttcctactaacatataattaacattgttgtcaaacctcacatattgtaaataaaatctatagtaaaaaaatagttatgtttaacttaggataaacttagaacaacaaactaattcaaaacagagtagagtagagtgctagagagctaaaaacttataagctcggtttgactcattatgactataaggctcagttcctttgtctgggttcccaacccctccttctcgttttccgcgcgtacgcttttgaaactgctaaacggtgtgtgtttttgcaaaaagtttatatacaaaagttgtttaaaaaaatcatattgtttcatttttgaaaaaaaatagctaatacttattaatcacacgttaatgaactgctctgtttttcgtgccgagggaaccgttcccaaccactagtgttgaacacagccttaagtcagagttgatccaacccatataagtttggagttttttttaaccccagtgattgctacttcctccgtcgcaccatataattattcttaagatagccacgagtattaagaaaatatgtgtaaatgattagagaaagattatgattggttgaaaagagaaagtatgtgaaaaattaattaaaaataattataattgcttaagaagaggtgatatatgaagaaatgattttattttagaacaatacactgcacattttactttgtagtactacgaacaagtttaatagtatagtcaactactagctcaaaatcatatataatcaatttaatagctaattcatataatagttacctataaacatatactacactattaatatatggttccacctgtcatacacaaattgtgtattagagttccgtgttacagctgggcgctggctacaaatctgtagcacactgctattttctctcattttttttcttgatatgtaggccgagtttagatccaaattttttcttcaaacttccaacttttccatcacatcaaaattttcatacacacacaaatttccaacttttccatcacatcgtttcaatttcaaccaaacttctaattttaatgtgaactaaacacacacgtatttagttgtttatagttctattattgtacgtgctctactagcaaaaactgtataggattctactttaccagcattgtcctcggtgcctcctgactcctgagcaagcaaggcggtaaattttaaattttcaaataagttgcactgaacaatgctcaccaaccggaccgtgagggtgtcccagttgctgtgctgcggcgctactcttgccctggttgctccggatcgcaataagttcccccataaatgctgccattcggagtggccgctgtaaatgaaggttgttgcgacgcattgaatacaagcaaccttcagacactgcagacagccgtaggccaggaaccaggagcttttaaaacctctgaccctcttttcctttgtggtgaatttccagagggtttggaaaattgggggtataaaacaaactccgttttgttacactagaacgaaacttctaaaaaattgtgctctactcctactcatcaaaatacttctactagtaagctcaactcctttaaaattcctgcaaaattcctcgaaactaaataggccctaattaaagaggaagatatatacttactatatcatatcatatcttcaatagcgaagccaatgatgtcgtttagtttaaggaaacaaatagcatttttggacgattaactagtttctgtgaacgtcaaaggtagtaattcattgtggagtaatcaacaacagagcctgaagtcgtcctgcagccccgccaccgcataatgctataggaatacgtaacggtgacagtgatatcggaggcgatataaattgtgggactccatgcttatcaaacgatgtttggaggaaaatgttgcaagtccataatggtaacctatttaattccatttcaacaaatgaagctgtggaagataatttatcttcgaacaagcaattaaaattcacttaatatcaatcatatgtaagattaattatatagtttccacctatgaatacccaaaaaaaggagtcgacaacatgagctaagccaagattaaagctgtaccaccattttttctctgcaagataaaaccatagaaatccagaaagccaagagaaatcattttgtcgattcctatttgttctactcgtagcacattaatagcagcacaaggccccccatctcctctcctctgtgcttccctcactgcgccaccactccaccacctccacctcctctccaaaaacttgccttgccgccgcaaatggacaaggcgccgctgtgatccctcctccccattgcgttctcccgcttcctcctcctccgcgcgcgagatggccgccgcctcgccgctcgcgcggctcctcgcggcgctgctcgccgtggcggccgcggcgacggccgccaccgcgctcaccgacgacgtgctcgcgctggtggtcttcaagacgggggtcgccgacccgatgggcaggctcgccgcgtggacggaggacgacgaccgcccttgctcctggcccggggtcgggtgcgacgcgcgggcggggcgggtgacgtcgctgtccctcccgggggcgtcgctctccggccgcctcccgcgcgcgctgctccgcctcgacgcgctcgcctccctctccctgccgcggaacaacctctccggcccggtgctcccgggcctcctcgccgcgctcccccgcctccgctccctcgacctctcctccaaccgcctcgccgcccccgtccccgccgagctcttcgcgcaatgccgctccatccgcgcgctctccctcgcgcgcaacgagctctccggctacatcccgcccgccgtcacgtcgtgcgcgtcgctcgtgtccctcaacctctcctccaaccgcctcgctggccccatccctgatggcctctggtcgttgccttcgctccggtcgcttgacctctcgggcaacgagctctccgggagtgtccccggaggcttccccgggagcagctcgttgcgggcggtggacttgagccggaaccttctcgccggggagataccggcggacgtcggggaggcggcgctcctcaagtcgctggatgtcgggcacaatctcttcaccggcgggttgccggagtcgctgcgtcggctgtccgcgctgcggttcctcggcgtcggcggcaatgcgctcgccggggaggtgccgtcgtggatcggggagatgtgggcgctggagcggctggacttgtccgggaaccgcttctcgggcgccatccctgacgccatcgcgaaatgcaagaagatggtggaggcggacctcagccggaacgcgctcgccggcgagctcccctggtgggtgttcggcctgccgctgcagcgcgtctcggtcgctgggaacaagttgtacgggtgggtcaaggtgccggcggatgccgcgctggcgctgcgcgcgctggacctgtcgagcaacgggttctccggcgggatcccgccgcagatcaccgcttttgcgggtttgcagtatctcaacatgtcctcgaattccttcgcgaggcagctgcccgccggcattggcgggatgaggctgctcgaggtgctcgatgtgagcgccaaccgtctcgacggcggcgtgcccccggagattggcggcgcagtggcgctccgggagctgcggctggggcggaattcattcaccggccacatcccgtcgcagattgggaattgcagttcccttgttgcattgtgagttctttttactcctacttcttttagcatgtattttttattgaattaaatcaaattcgacgtcattgcggttgcttgttagtgaggttgactagttctatttgttttttgtattatttcctgcatgctttgttggctttcagtttcgtaggttgtgcagagacgttgtagaaagtgataggagacaagagatcctgatgtcttattttctgtttggacccccaaaccgcaaaatatgggtctgtgtcatgttttttgctcgtatcccagtgtaacctgggccctcattttcttcgatacactcaaaactgaagtcaaatgtacatgaataggatcttgagcatttgcttcaatatagtattaaactgatcaattcgatcaaaccgtcatattatttggttacggcgatttaacattatgaaccattttaagtttttaaccaagacaatgttttgctcttgaaatgcagggatttgtcacacaataatctcacagggtcaatccctagcaccgtaggcaatctgaccagtcttgaggtggttgatctatcaaagaacaagctgaatgggaccttaccagtggagctatctaatctgcccagcttgcgcatctttgatgtctcccacaacttactatcaggggacctcccaaatagtcgtttcttcgacaacatccctgaaaccttcttgtctgacaatcagggcctctgcagctcgcggaagaacaactcctgcattgctatcatgccaaagcccatagtgctcaatcccaactcctcgacaaacccattgtcgcaggccacaccgactgcccctagcagcatgcaccacaagaagatcatattaagtgtttccaccctcattgccattgcaggtggtggtaccattattatcggggtgatcatcatatctgttctcaaccgtcgtgcccgtgccaccacctctcggtcagctcctgctactgcattatctgatgactatcttagccaatccccagagaatgatgctagctcagggaagcttgttatgtttggaaaaggcagcccagagttcagcgctggtgggcatgccttgttgaataaggattgtgagcttggtcgaggaggttttggtgcagtctacaagacagtgctgagagatggccaaccggtggccatcaagaagctcaccgtttctagcttggtcaagtcgaaggatgactttgagagacaggtgaagttgctcagcaaagtgcgacaccacaatgtcgtcgcactaagaggcttctactggacttcgtcgctgcagctcctcatctatgattacctgcccggaggaaatttgcacaaacacctccatgagtgcacggaggacaactcgctctcttggatggaaaggtttgacattatccttggagttgctaggggtctgacacatctgcaccagcgtgggatcatccattacaatctcaagtccagcaatgttctgctggacagcaatggtgaacccagggtaggtgactatggtcttgccaagctgttgccgatgctggaccggtatgtgctgagcagtaagatccagagtgcactggggtacatggcaccagaatttgcttgcaagactgtgaagattaccgagaagtgcgacgtgtatggctttggagtgctcgtgctggaggtcttgacgggcaggaggccggttgagtacttggaagatgatgtagttgtgctatgtgatttggtgagaagcgcactggaggaaggtaggctggaggactgcatggatcccaggttatgtggtgaattccccatggaagaggccttgccaatcatcaagctgggccttgtttgcacctcgcgggttccatcgaaccggccagacatgggcgaagtggtgaacattcttgagctggtgaggagtcctcaggatagtctagaggacgagctggtttaatgtctcttgccaactctgttctgaacggttctaggcgtttttttttcctttttgttttaatgagatgcatatagtgtaatgctaggtgggaagaaatcagagaaagcaaagagtggtatggatcgtgaaatgcttgtagtttgcttgaagttttagggaggttgcaaggctattttgttgcttctcggcaattctttgatccatttcttggaagagttgttttgccatgtgggcattgcctcggtgccgcatatgacgtctcacaccgtgacacagtcatacaactgaatgaatgatgatgttcttagggtgtgtttaaggataagaggattgaggagattgggaagatacgcaaaacgaggtgagccattaactcgtgattaattgagtattaactattttaaattttaaaaatagattaatatgatttttttaagcaactttcatatagaaaatttttacaaaaaacacaccgtttagtagtttgggaagcgtgtgcgcggaaaacgatgtgcattcttactctctatcacccaaacaaggctgtgtttgctgggggaggttgggaacaaatcttcttcgcacggaaaacggagcggtctattaacgcatgattaattagaaattagctaatttttttcaaaaatgaatcaatatgatttttttaagcaatttttgtatagaaactttttgtaaaaaacacatcgtttagcagtttgaaaagcgtgcacgcggaaaacgatggagaggtgttgggaacccttgggtccgaacacacccttagtagtgttgctctaacatttttgctttcaaatgtgtggtagatttgactccactgtactggtgagtgtcaataccaacagcccaagccacagcagggtgtttgtacttgaattaggggtactgtattttacttcaccagtgactaaagtaaatcacaaaagatgtacagaaaataatcaagagatgctaatgttgtacagtagtactactagtactgaaccatcacttgaagcttggcattgtttcatgattggtagagttttggcagccgttgaccctgtggaatagggaacagtatccctctgccttccctccagcaggggtgcccccatttgcgcgaggatccatggactcacctgtcctttgaagcttccaaaaacatgggcaatgagaccctgtttataatcacatcgaatatttgaacactaattataaatattaaacatagactattaataaaactcatccataatcttggactaattcgcgagacgaatctattgagcctaattaatccatgattagcttatgtgatgctacattaaacattctctaattatggattaattaagcttaaaaaagttatcacacaaattagctttcatttatgtaattagttttgtaagtaatctatatttaatattttaaattagtgtctaaatatagagaataaagttaagtccctggatccaaacaccacctgaatggcccgtgctgccctaccacgtgcccgcgtgttggcatcgtgccagaggctctgaccgcctgtggcggcagcagcagcagccgcagcgacggacggacggatgggatcgtcgtcgaggctcgtttcgtgcagctctcgcgtgaccgtcagttgggagcccggttctcgtcgacgttttttagaaggggtggtggtgtgtgggtgggtgtgagcctgggccctgcctgctgccgcaccactccggcggtcaccaccaccaccaccacaggaattgaatagatggccttaattgcagcacctacccttttgctcctcctccccttcttcttccacctcgtgcaactgtggatggagtgcgtggcaagcgggctgcatttactactcgctctacctttcctcctccctgatctgcaggagtggagtagcttcatagcttcgcagtaaacgtagaagagggcaggggctttcatggcatcggccgcagcaacagtgctgtggtgcggtggtgttggtgtgaggacgccgtttcgatttgtgctaaggcctggtttagttcgcaacattttcgttaaacgtccaatttttccatcacatcgttctaatttcaatcaagctttcatttttagcgtgaactaaaacacaccctaagctaggagctcaggaaatattcaaagattaagctgggagctcgggaaatattcaaagattttgggtttgggaatctttatattcagattctgtaggatacatgtttcaatttgctcctctttttttttcatgctcaggataaaacaggagtaaggttgaaggatgcttgtattgcaggagcaactcaattacacctttgcctggagtggagtgctcgactgctcctactttgtttcgttgccggcaaaaaaaaaaagaatgaaagaaagacagccacgtaaaaagaaaaaggaccgacagaatgaatccatgcaatgaacaaattattgagggtgtgatgatgaagattcaaatcagaacagtgctataatataccgagtgtccgcaccaaaattggaagtttaaagaaaaaagttggaagttgatgtgagtacgaaagttttaggcctagttcctaactttttcttcaaactttcaacttttctatcacatcgaaacttttgtacacacataaacttccaacttttctcttcaaacttccaattttagcgtagaactaaacacatccttgatgtgatggaaaagttgaaagtttaaagaaaaagttgggaactaaacaaggcctcaatagacggtagaaatccatcactctctccgtttcagtttagatatgtaaaaaatgcaacaaatgtcattggcaaacgtcctattctaaaaatactatcgacgaacgcaatttcaacaaatattgttgtacaaaccaacttaccattaaaaataccattatcgttagggtttcactaatttctctccgctaaaatgtgatgaggttaacaaagagatgcaagttgatttgtacaacaaatattgttatccaaaccaacttatcatgaaaaataccattatcgttagggtttcactaattactccatcgttttagtatagcagtactaccatgttcttagagtggattattgcaagtgtgattcattatctggagtaggacttttgcttttgattcactcagaaggaacatccatagcaaaatatgatatcgattgtcgtcaagatgtaatgagcactactcattactcaagagtgcattgcttaaagggccacgtcacgaggcctcgaataaacgattttttttagataatgaaatataacatcccagcctttgctaaaaaaaagctacaaccaattattataaagtagcacttcaaaaaaaagtgtagttcagataaaaagaacacactaaacaaaaacaatggtaaccaagccaaaataaggagaacacatttattgaagtctatttgtgaacctccacccataattggcaaatagttgcataaccatcgactccaacctgcggcatgcagcctttaggaattccccatcatcctcacacctttgtagctgtgccaaaaaccggagccagtgcattgccctaaaaattacctgtatatatgtaatagatagtgatttgtcaaaaccaaatcatttctactcaactgatggaacgagcagtgtcaaagaggctagcctagcctgtgataacggcaatcaactgatggtaaaatcgtcacggccgccgcgggggtcgctggggcgggtttgtcgcgttgctgttgcgaagattcggagaggaaagttctaaaaaaaaaaatcggagatcgatgaaatcggctcgcactcggaccaatgccaattgacgacacatggtttgaccacgacaaaaaaagaaacgctactcatgttgtcctactgtcctacgggcttctcctacgaagaaaaaccgtatcccgagatgttccgtggacgacgcgcgcgcgctgtcccgtgccgtgccgtgaacggtcgtctgccctagtactcctaccgtgctgtgagcccgtgatttttgcccgtttcgcaggagaggcgcccgcgcacctgggcgccgcggtcgcggatgcggatgcggatgcggcgtggtgggacggtgtgtgcgatggcgaacggcgaaggcaggggcttggggcttcgggggcgctcatttatggtgggcggcagggtggtggtgtgtgtgggtgtgagcctgggtcctgtttggtttcatgggccaatgtttagctctcaccttttagtcttaaattagtcctcaaggatctaaacatgtggtctaattttaagctaatgtgaattagcccccctcaaaacattagcccctccaaggggtgctgatggggctaattttatgtggggactatcaaaaagcagctttttctctccttctctctcctctctttctactctctccccaccttttagccttgaattagcccatagatccaaatataccaccataggctaatgtttagcctaacaatttatgactaaatattagctgtcaaaattagctctggactaatcttccaaatagagccctgtgagcgtcgtggccgtggaaacaaaatgtgtcccattagattgtgtgggtgcttcgccccacacagctcgcccattagattgtgtccgcaatcgatcgtgtcagccgtcaaccagacagcaacaacagtgctgtgctgctacggggaggggagggtgtgggggctgcatgtgtcgtccactcttgcatgctgtttgactagtacgtgatgcacatactagtagtctagtgttacgtggtagttgggcacgttgtgggcgtctcggagtcgccacgagcacacgagccgaacaaaatcccagtccattggacccatttggcctcgtatatattcgttataattaaaaaggagaaaaaaacatatccagagattaaaattagaaaatcggctaataagactcggagttttaacctccgatccccttgacctcgatgctttggtagtcatcatgtaattttccctgttctttctgcaacaaaagttggataaaattttagatactcgtggcacgctttttaaatcgttaaacgatgtgtttcgtgtgaaaactttatatatgaaagttgctttagaatatcatattaatctttttttcaagtttataacaattaaaactcaattaatcatacgttaatattacctcgttttgcgtaaaaaacttaatctttatctttaggagaaaagaacaccgcctttattgttggccgatctttgtgctgattcatgcatgcttcatccgctagattgtttctgtcctcggcagtagccatggatgatatatgaatacgctagactccgactcatggtcgagagtctagtcaatctaggtgattagatgatatactgtataatacttctgtcagggttatgggtaccacatacctaatagtagtcgactaaatctcggcatgacccaccatataccatgtcttatacgaaaactgacctcggatatggagggagttccgaataaggaaagagaaccagagttctacatggaaacgacaagaactctcagattgtatccatattggttttcctagttctgcttggacaaggggacacctatgggtataactacaaggccccttaggaggagaggggacacacccaccatagaagacacggaacaatagatcaagacagaagatcaacatacaagccaacatacgccaagacaagacgccagatatcaacttcagagataggcatgactagtcccctacggtgcctatggctaccgtcaggagagacataacgctatctctgatctcgccggatgcggattcgaggaggaagtctaccctggtgtcgactatgagttagaacttcagaccgccaagtcgacaacagttagataggctaccccaagtattgtattggtgtgattatggtgaataagagcaatgaccggcttcggccaacaggatgtagggttattacctgacaattcaggggcccgaacctgtataaaaatcctcgtctctgtctcttttactacaatctcgcgtatatcctagtaccaacgatccccatactatgcaaatactgaaatcgcgacatcaaatgtcgacaacttcctccatccacaaaagttgcacatattacttttgtcaccaagatcaaggagaaattaaatcatcttggatgttacaaaatcaacgagtaaatgtaaacaagcaatcaatgaatatttagattactcattgggttctcacaaacatttaatttatctcttcatttaagtcttagatgtataaagactacaaataagaacaacttatttgaaaaactcaaatgtgaaacatgtctaacttttatggatggagatagagtatatcatcggcttttttagcacgcgtataaattcacttaacatgtttggagtactagtggcacaataatagccaggtgcagccactcacgtacaacccctttagagcaggtacaatagcaggctataagccagctgcaaacatattttaagaagataaataaggagaaagaagagcagcgggctacagatttgtagtcagctgtagcacggactccaagacgcagtgtgtgtatgactggtgggaccaggtattaatagtgtagtatgcaactattgatgaatgagctattagattggctatagatgaattggagttagtagttggctatactttgctcttagcctcattcaggctgtgtttagatccaaagtttggatccaatcttcagtccttttccattacatcaacctgtcatactcacacaacttttcagtcacatcatctccaatttcaataaaaattcaaactttgcgctgaactaaacacagcctcagtcgttgattaagaaagagaaaaacatgaccggagattaaaattctgttccgccgcgtttgccctcgtcaactaatcttcaaaccctagtgacatcgttcgagaaagaacccaaaagagtaaacccggctacgggggttcggaatttttatctccgaacccccttgaccttgctttcactcgtgctttggtataagacagtgaaagagagaggagatttcatctccatgtacatagcgacatgttatgtgaatttgcggtgatcagattctgcggctaaagttgtgtgcttatgttgttcctgcatgtttcggttgctagattgtttccttgggcggaagcggccatggatgatactgtggtactacatgacgattcattctttaagaaacaaagggagcgcagtggaaaatggtgaatgaagattacgagatggctgcgttcgttccatccaacactacagaaatttttagcgcacgataaaactcattagcatgtaattaataaaatattaactattataaatttaaaaaatgattttctttaatttttttaaacaacttctatattttattttaaaaaacgtatcatttaatagttagaaaaatatattgacgaaaaataagtaagatgaagtttggagtttaagaaaagaacttgttctccccctaagccgagctcgataccagccacgagctctcgggcgcaactagcacaggaagtgaagttcgtaaattaatcagaaaagaagcccgtgggctcaaaacgctccaaatattgcctcagtacggcccaattcactccgaaggccagcatccattgggccattggcccattggccgctccaactgcaacttgaccctaaccatctctgccctcttctccacttcccccatctcacccccaagctcggcgcaacctctctcgacgtgctaatggcggcggcggcggcggacttcgcggcgagcaagcgggccatggcctacgcgctctgcaagcacctcagcctcgatccggtgattccccgactctctagccataaaaccgtggatttctgttctggtcgcttcgaagcaaaagctttctcctgctattgttgttgtttagtgctgtcgttgtgcaggctaaaggccgattttcttatatttccgtgttgaggtcttggttgttgaagttcttcggggggattagttcactcgtagtagtagtatttagtatttgatagactcgtgaggtgaatctcataatgcgattgtattgtgctgtcggatttagggtatggttacttcaagcgtatagtacgtagttggggagtcgaaagatatgcagttatctgctgtacaattgttcgatttgtggcaggccgtgaattgatgggagcagtagtggattttttgcatcatatactatatccactatgcaaaccatgagtccaggattgaacaggatcgtccttgctgttgattagcttcgtgcttctctagttctcttaattactctaagcagtgcaattagatgattaatctagttagcttccaatgtttttggctgctgcctgccacatagtactatgtcacagtctataccttgtaaattgtaacagttactctaatactccaatagaatcaatgtgcaaacgcttttaccaaatgcaacatatgcccttgtagtcagctcttaattaagtagcttgctaccttagttcacatagtgcctactctatttctttaactggtgcctggtcatggacttgatactcctgaaatctgacttgaatatttgactggtgtacaaggcacaacgtttgttgtattgctacactgttggcccacttatatgcacttcacagttcaccgttcattactagttcatttggacaaactttgcctggctcactcttataaatctccaattgcacaattgagttctacctgggctggaagcttctactaatttctgcgctgaatattacagaatacaatatccagtacaagtattgaagagagtgatattgccaccctgttctcacatattgtgaaatcgagtgaagatgaggtaactgtttttccacgcatgtacactaataacacgtagtactacttatatattgacagatttcttcactgataggtactgaaatgggttgaattttccagcaattttgttggaaaatgtggagaacagcatgcattgcttggtaatctgaatcaagacttgtcccagaaatcagttctgttgggtaatggttttaaaccatcagttgctgatattgttgtgtttgcaaccatacaagtttttgtggtaagtatgatgtgattactcatttgtatgaccaccatcaatggtcattcataaaagcagaagttctgagattttaaccttttactgcttgtttcagagtcatcttggtgaaaacgagttgcagaaatatccacatgtattgcggtggatggactatatccaggttcgaaataaaactttatttattttgtactatcatactttgttagtatcttttttcatactacctccgtgccataatataagcacatctagcatttgaaatttgttccaaaatataagcacgtctagagtactaattcactcaccaaccaccctaatttatgaggggcatcatagtcttttctgcttaaccttagtctttgctagaaaacctagatttgcttatattttggaatggaagtagtagtttgttgctatatgttgtcaacatgaagtacatgtgcccttcattctggataaaataaccaaacgcatatagtttttttaccgtttctcttgacagtcccctatgttgctttctgtggtataccagcactgaggtgaatgcacataccatgttttttttccttgtttgttgcctggtcttattaccagtttgttcatactttataccttaataatcagacccatattaccattttatttttacatcttatgtgagtacttactgattgacgcagaacatcgttgattttggcacaacagtacaaaaggttaacttgaccaaatctgtcttcgatccaccttctgtaagtaaagatcctttcccaatgtgggctagaagtattacattttgggggtacacatattcttgaattcctttgttgtatactttcagatgttataagagacagagttgaagaaaattaactctgtcaacttaatgcaacctactgtgtttaaatacaattttgtgcttggtctgaaaatacctgtacatgttcatatcagtttatgtttaggatctggttgatataaaacctttgtaagaactactgacataatctgtggaagtgccatagtgctgggaagaaatataaatatcaacaatttttgtaaaataatcatacagtatttcctgttcagtatgctatttgaataaacaaatttgttgaggagtaattgtacaatttcctatttctgtgtgacagcatccaaagaaggcagataaaggtgacactgatccaagttcaaagaaagttgtttcaggacagaagaatgtgggcaaatcggatgcaaatgttgattccaagaaagctgcaccagaggtagttcattatgcaattatgccaattatcactagtactttgcagttctggattagtatgatattatctcagagaggtattggtaattcatgttactttgaagatttggctggaattgatattattgcattttcaactcttctctagctgcaattcatgtagggtctcatgtgcaaatgcagaacaaaactctgtggactttatgtccaataaagctctttaatcagcacataaagtattaaaatgctttatgatgtacagatatctgttgtggaagctatttttttcccctttcaagttagttgattagttcctttgttggttgaatcagaataaagctcctgagaataaggcaaatcctactccagcaaaaaataacaaaccttctggggataaaaagaaagcccaggagaaatctgcaggaaaaccaaatgagggagttgcggataaagctccacagaaaactgcagaaaaggactcagaatgcaatgtcagtatcctgaatatacaggttggccttattcgcaaagcatggaagcacccatctgctgacaggtacccataacttttctgcttatgcaacaattcaaaatggttcaacagttgtattgtgctctttgaacaaatattctaactggtctctcttttcagcctcttggttgaggagatagatttgggagatggcaatgtgcatcaagttgttagtgggcttgccaagttcttcagcccagaggaacttgttgtgagtatttaacagcaacaatggacttgaattattcctgttcatttttcttgccatgaaattgtttcatccaagattctgttttctgtaataaacaactgccttttccttcacagaatcggcatgttgtattaatcacgaatgtgaagcctgggaagctgcgagacgtaatgtctgccggattggtatgttctattccataaattatatttatgctcgtgtacaggcaaagcatcttgatatgtgtcaagcagttgatttataaactacatccaacatgtgacaaaagatccatgagcctatgatggaatactagctttaaataggcattgctgtagaccccaaatcattaggtcatgtgtatgctcttgaagtctactgtagtacatctaaaataggcaatgtaacacttctcactgatgaaacaatgaactattttagaagtgaagcctcaccatgtgcttggtatcacttatttagtcatttgtgttctttctccagtcttagaaatggtaggaatataaactttaagttaggaagtcctaatttccaaatgttgttttcacattgaacatattgccaggtcttgtgtgcttcaaatcaagatcatacagttgtagagccattgattcctccagaaggagctaagcctggagagcgtatttcatttgcagggtaagaattatgttgtatagatgtgatatctgcattaaaattttaaaaaacgtgtttgtgcagttctggggagcatgttctgttcaatttgacctatttgcattcatggctttaaagtcagcttgcacaagcttatatgcaattactgtcttttagattgttatacaagttgtcccctaatatgttggtcgtaagggaagtccaaacaggatggacccatgttgtgtgatgatctttctgtcgtctttcaaggaaaataatattttagcgtagttagcatttcggttgttattagtagtgtcttgtgctgtagaaattatttgattgtgtttggtgtcctgcaccgtttgtgaagaaaaaaaatgtttataactgtccacctttcagttcagttaaattacttatccttcacatataggtttgatgggaagccagaagatgttcttaatccgaagaagaaacagctcgacaagatcacaccggtatgcttttaccaatgcgctatttttgcatgatgctctaagttatttttcccttttagcaatcacatgattagtctgcccttccagcacaatctgggtgaattaaatcagttgtcatttcttttgcacatctgggtgtcattttttacattgccttaacaaattcaataattaaatacagacaattcacaaatcgtgtttgctatgcgctgagtgctcttgaaggctgttgtgtatccatttgtatatatactgcatgaatcaaccaataattaaattttatcatgcacccaggatcttcacactgatggaaatggaattgcaacataccgaggggtacccttcactacatctgctggtccatgtagatcttctgttcctaatgcgagcattaagtgagcagttattttaacagattccaaacattgttgtgctataacacatgctaggtggatgtactatttcatcttgcatcttattacatgccctatcaactgttgtcagcgtagcgtccatctactgtgatatctaatagaaaattttgactagccaatgtgaagaacatttgtattaccttgcaccaaatgcaaaatccttcatgaacacggttgttttcaggcaggatttctgatgagtcaatttctctttaccatttagacatttaattcaaattaatcaatgcaattctaatcggcaaaatcaaagtaattgctggtagctgttctcaggagcaataccttgcttctttcgagggttagcatgaggccatgagtatcgatttctttcttgtggagttctttttgcctgccttccgtcttatgtctcacatgcaacagcttggcataagcaatgtatgtcatttgagtctttttctttgtatccatcgtgctgacattgctccatgaggagggcaaatgcccctcctggagaagctttgattgcggtaatcaataaaggaatcgattgaaatctgtgtggttgaaatgaaactgggtatgtatctgaaaaagaaagttcaggctgggctcatagttgagattcaatcggttaggtattctagtgtttcagattcagggaaaaaaaacagctataacatccacagggcttcttacggttttgttttggtctgcccccacacgtcagtgcctgccactgcatcagcagtacacagtcgacaatctctactgtaggagacgtgtgctagcttatgcttatgtgatcttttaacttgttgaagcaatcagcattgggcatggtcaccttaaagtatacctttgtcctttgagcaaagagatggagtgcatataattatgagcaaaagagatacatctaattgtgatctttgggtgttttcaagcaaccatccatttgcccccacgttaattctcgctttggccctcgtgccctgcgcttatatgcatatcacctggactatttactgatataaattgaacggccaaaaaaaaatatactgtagcttcactgcatttttcttgctcgatgtagaggatccgattcgagagtgaaatactgttactacaccaatggacggcgcatattttcttgccgcgagcacaaggccaaaggtttgattgacagaacgtccactttaaaaaacctggttgaaacagctgaaaacgaaacgaattccagcccaccaaacacaattacacaaacacctccgagagctccgaaaccgaaagccccctcacacgaaaaccccaccaaactcttcttcttcttcttcccccattttcctcgcgttcccctcgtgccgcccgcctccgccg

SEQ ID NO: 78322 - DNA, 2643 bp, Oryza sativa
cctccaccttggatgacggcggtttcgtcatggcgaaatcgaagttgagttgacgttgaacggatctccccagcgaagtcgccaaaatcgtgttggcaactttttgtgataagttgacaacaacgattgcaacaccttatgccttgcggtgatcctattgtcacgaaccacctcgatctagcaaagagccaaacctagatgggttttgacaaataaaccggctagcggagccaatttaagataattacccgtctcgtgggcaaaacggaaggttttcaggacaaacctacaaagagatgttgcactctcgcagcggcggcggacggtttacggcgcaaaccgacaaagatggacaaactaagagaaaactaaaagcaatatgaaaaacgattgaattgattgattgtagattggtttcttacaatagaactggccatgtaccttatataggggttggtcttgccctctacaggccctcctccatgtccaacttgggatagaaactaaaggaaacctgaaacatgccttcccgagcaaggaaacctcgagacctgacgaaacacagtcggactcggacctgccggtcagaccggccacacaccgccagtctgaccggccctcaactggcggtctgaccgcccaacacacggctgtcagaccggccgactcgaaggaaaccgatagacttctaaattttggcaatctttcttattttgatcctaggtgccaaatttgggtgtaaacacgtacttagtaccattgaaaaaaattgatgatctttaaatatgagtttctattatttaaagataaaacatacgattctataaatttacgtaaatatcattcatgaaacgtcctataaatgatctcaaaccatcatgtgttacttgtacaaacactactagaccaccacgtgacactgtcattgtataaatttacgtaaatatcatccattaaattttctatgaaagctctcaaatcgccatgtgacacttatacgaacgctcctaagctgccacgtggaactgtcaaatctcaccgatgattttcactttagcagtggatccgatattttaaaccattatattattatattagatgtattttattttaaaaactaattccttaatccatatatgtatatgggagaattatataactgtactagaaaaaaaatacttgtccattgctacggatgaaggctattttaatcttattcttattatacggtttaactaggatgaaatttactctggaaattcgcttttttttttttgaaaatcattagctgcaattaggagtctgactttcatctcaagttagcatgcgagtttgtttaaagatattttttatataactatttttgtacttccaaaaatgaacgaacataaaaagtgactcaaacaagaatcaatattttcaaaaacgaacgaaattaataaccgactcaaacaagaatgacgtaccaaaatatcggcaaaaaacttctttaatttttataatagtggagaagtatccatacatacgtacgactgaaaaaaacaatgaagctttacctactgttcatctaaagaaacaaataaacttacgcacagacttactataaagatcaataaagcataaaaaaaacatacgtacttagtaccattggagaaaaatgacgatatttaaaatatgattttctattatttaaagataaaacgtatcactctataaatttccataaatatcactgttgatttcatttaaattgataggcccgatcgattctttagaacattggataatgtatacattatatactaaaagtccattaaacttcctaaaagtgctcctatgttgtcatgtgttgttctacaaatgatactatgttcatcacgtgtcagtctaataaattactgaaatacttaagaaatctagaaaaaaacaaagcaaattttcattaaatttgatggacccattatttataactattggattatttttttttagaaaatcatctccttaacccgggcctacctaaaccagtacgtataagtttcattttttttaaggaaaaaacaaacgaatatatgtatgtatgccccctcttccctcaattcttttctctacatttttacccattccttcttctatttgcatgctttattagttagaaaagcaacaattatgtgtaaaacaataaagcatctacatcatataaataatttttgatccgttatgtaaaatcaaaggtgtttttgattattattctgtgatgaaaaattggcattgaagattattggttttgttatttagaatttattcacgaagtggatttcagaggtgattacaggttcattatttcatgtgaccgatcagaccgggcaggtgttgccggtcagaccggcgtgtaatgcgcggtcagatcggcgcagcccgcggtctgaccggccgactctgtgtcggtttcggtttcgagttgttccgtgattatgtcatgattatgggcttctagatggatactatacgtatgtaatactgttgttcgctactaatgagtcaagtttgagataacttggtctcggaatatggtttctttgtttatttcatgtgtaggtatctacttagaagcccatgaagccatcagtttgtcaacaatct

SEQ ID NO: 78323 - DNA, 675 bp, Oryza sativa
gacttatcttacaataaacacaagaattagcatcagctacacgaaaaaaaatgcaatcccagttattgtactcaaggaaacttggacatctatgaacatatccagttagccacacatagttaacagcctatgatggcatatgctggaactaaatgtagagttttactggttactgaccacaaaccatatgacaaattccgagcataacaagtactacctccgtcccaaaatacttgtcgttttgagtttttgtttgtaatgcttgaccattcatctattcaaaagaatatggaattattatttattttgtttgtgacttgctttgttatcaaaagtactttaaatatatgacttatcctttcctatatttgcactaatgttttaaataagacgaaatggtcaaaagttgcaagcaaaaagtcaaaacgacatctaatttggaacggagggagtacattactacccaaggttggtaaatacaagacctagcaaccaacaacttgaaaatacaattaaaagacaaaacctcccaaaaaaacacttcctcaaacaaagcacaaaaaatgaagattcaatttcacttggtatggtatcagccaatcattttgccacagaactgaacgcggcaagaaattctatatttccccagcactcacccaaagtattcaaggtcac

SEQ ID NO: 78324 - DNA, 1645 bp, Oryza sativa
  unsure (1)..(1645): unsure at all n locations
cagagtantagcccttgtgtgatggatgtgtacgtttatgcctgcacatgtattcggataaatctaaattcttaaaaaaatagatccactatatttaacgaatatcaatggttaaatgttttcttttttcatagaatttttaagaaacttttgaatttataagagtgtcacgtggcggcttagaagcgtttttaggatgcgacgtagcagcttgaagcgtttgtaagaagtttaatggactctagtatataatagatagatagatagatatatgatctgtttggtacaggtctagctctagctccatgtctcctagagctggagttcaatcaaacagtttcaactatacgtaaaatcttagttattaagaccggactggaccagcggttggaccggggaaaaaccggaaccaatgccccaaccggtccggtccaggtaaaaagaccggcatgcaatcggcccagcaataaaccggttagaccgcctggttttagagaaaaaacgccattaaaccggggaataaaaccgcttccaaccaggcttggcggctgctgtacgcgcgcatgggtgctgttgggggaaaaatgagagaaaatgtgcatgggtagcattcgaaccggttagactgcctggttttagagaaaaaccgcctggttttaaagaaaaaacgccattaaattggggaataaaaccgctgttgggggaaaatgaaagaaaatatgcatgggtaggattcgaacctagaaccataaacaccccaaccaccaggctatcatgtcctttgtgtttagatagaatgcttaatgtatttaatagttattgaactggattaaaccaacggttcaaccagttgaaccagtgaaccattgaatcgagagcctcaccggttcgattaccagtccggtcttaataactatgcgtaaaatgggagtgagaggagctggatggagttctctttactaaatgaactatagaggtagagctgggcttaggcaactctaaaactccactccagacctaatttctagagttaaatttaggagttagaaatctactaaataggcccataaatttgcaattcagaaactaaaagtgtctagtagagttctgcactgtcacaccctaaaaatcccaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattggaaaaggttttaaaagttctcttttggctttgggccgaaagtcggcccaaaacctctctctctctccctcggcccagtcggcccagtccggcagcagccgcccgtgcgcgcgtccgcccgctgacaggtggggcccacctgtcagtcttcgtcttcctcgcgccgctgccgcgcccaaaccctagctgagcagcgccgccgtctccttccaaattcggccgcgcctttcctttcccggtgaaatcaatagaggggaaatgatcnccgggatcccctctacatcatcta

SEQ ID NO: 78325 - DNA, 17752 bp, Oryza sativa
  unsure (1)..(17752): unsure at all n locations
aatgaagtagtagaattttttttcaagaacacatactttttttaagtgtgaaataaataattcgttttaactatcaataacctggtgaataagcttaaaagtgggccttaagaattgcaatcataagcaaacaaaagttttcgagtgcacttgtcatgtgtcaccaaaaaatattaaacgttgtgttcttttagtttttccatttaacgcagcacatatattcatttcacatagcctttgtggctttgtaacaagccgaaccatctctaatacttcatccgtttcacaatgtaagactttctagcattgctcatattcatatagatgttaatgaatctaggcatatattgacggtcgttatcgatcagtttcgagcgtcaatattaccgaaagagagaagaactagttatgcttgcaatgcatatttgtgttagaaaaataatattccactagtattagatttactaaccttttcaagaataacaataaattggagaagaatcgacatcaaaacagacgatcaatcaatcagacgatgtcgaggatcagacttatacatgaatgggccaagaacttagaaatgacacgtcgaaacggccaaaattcaaaagtctatatagaggagcagaagaggaggccacctgccgaaattgggccaggaaggcccggcccctggttcggccgaacccgaaccctccctggcatcgttggatgcagggtttcttctggacggtgtggatcactctccaatgatggttggagggcaattccgaccgttccaactgccacaaccgtcattggcagcctattcaaggagttcctcttctcacttcctcggttcctccacacacttcaagcgagagctctctcatattctctcaagtttagtttagtgttcttaagctagtggagtaggaatagaatagaaatcagagtctggaagtcttcgggtatggctctggtagctctcctttcctcttttgtaagctttgtactttatttagaatactcttctttgtacatttttggtattgaaatacgttccgaatatatgaatgccaactttactttatgttcatgttatactgattatactgctagcttatctggaagatgcataggtacgggtataatgtttgctattgcaattactctatgtcatgacgatgatattagagtagtatctggtagtttaggcgtggtgtctagattattattgggtatcattatttggggttatatgttgcggatgagaggtgggccgctgatggtgaaagctcagtacaggtattcctctgcgcgtgtatatagttctaagttaatttcctgggaagggtactcctccgtatttagccccgtatggtcatgacagattgtcgtaaggaactcggcagtggggtggcttctcgaagtactaggagggcatcggaaagagggtattagctagttaatcatataactagaatgtatgtatactatgtatatactagaagtataggaataggttcttttctattttctttccacttaggttagataatttagtatgagaataagtagacttatgcttgtgtgtcatcttaccctttgaattatcttaacccctgcttagactatgattattacaactaacatataaactattagtacggttctctctactatgatcttcccacatgattaaataattacgatacccttggaatactctcgggtgaaatgctacaatggtatatccgtgcgcttacggataaactctataaccataatataccaggagtatttctgcgccattgctgggaattatatttctagtaatatcgttaagaaataccaacagtatatatgtgtgtctagattcattaacatctatacgaatatgggcaattgtcgaggaagtgatcctctctagcaggagatcgtgggatccccctttcgtgagttcggccggggggaaaggcccgcctctggaaatcacgtatccgaccccaaggctgctagctagcgtgtaaacaacaagattatacaagttcgggccgctatgaagcgtaataccctactcctgtgtatggaatttagactgagagttacaaaggttcctaaactccggagagcgctctcgcttcccttctcctagagctcaggttttctgagagccgtccgctttctcggtgggcaaggtcatccttttatacctcaagaggataccacatgcactgcctctaactactcttctatcgggtggggacccaccctaccttgaccggatctcgacctgtgccttcgcctggaagctaagccacagtttgtccttgagtggggcccagcgccgtccctcgcctgacacgggggacagccttgtcattcccttattaatgggtaaagacttgtggtggccgccctctcatggggagaactgcgaatgaccctccgatgggacgggtcatacctacctccactccgccggaggcagatgtgacgtgggggcacggccgtccgtgcagtcagacgtgaccggcgacagaccggtcacagatcggtcattcgtgaccgacgcgagccagtcgggcacgccgcacgtctgcccctactgcatggaatgcggcagggggcagttggggcgctgcacgcattaaaggtcgttcagcctgggcccgctccccgcttgctccccccgccagatggcagctgggcgagggcctcggggcaaagcggcgtgagggcccgaggggtatgacgtggcaccccgaggccccccggccgctcctgtgattcgcggggtgcgggggtagggctaggctgtagggtcacgcgacaggatgggaaggtaaattcccctcacttcgcataccccgggcccatatctccgacagtagcccccggcaccacatcggacgttggcctccagaggtcggtctgacgtggcacctcacgacttctcaatctggggttgtgggcccggcggggaatctaagcggatgccgccgagcggccaggttggcgtattaacaataacggcgatttgaccgtcactaaccgcgctgatgatgggggcgcttaaggcgcgaaaatcgggggggggggtcggttggaccacacctcgactccctcgcccgccacgtatgcgacggtactgatggcggcccgcctagattgcgcccgtgaacgtcgcacgccctactccgagtgtgccgctgacaggcgcactaaatgcggggcgcggattcagtgagcgacgtgatgagtggtagcgggaaacgatcaggcaactgcaggcgcaagaattgtgggggcaaccgtgagggcgtgaaacgaggaggcaagcgcgggcgaggcagggataaaaggatacggtggcggggactttgcctccttcctttcgccaactacaagacacatcttcctcacgtgtaaccacgtgccacataccaccacggtatacgaacgtaagacgtgacatagttttcaacccatcctagccatagacaagagtaccgacccaaccccacctatggccggaacctccgggacaggtaggcaggactgagcccctagcagcaggacaccagccctgtgccatgacatctcgactaccgagtgtcacgccctgtagttcccctcccttgctctaaattcataaaataaatcgtccgaagaaattgtttaatttaacctagagataaatccctaattaataaatgcaaataataatcggaatcgacatgtggaatttttcttggattctacatgtcaaaatatgctaacaggatttttagtggaattttcagaaccttggaaataattttaaccaattaaaataagcaaagtgcaatattaaatccctgggaaaatcctttttcctttttatcttttcttttccctcctttttcctttttcttgggcctggcccattccctcccgcgccggcccgcttcacctcccccgaagtccatccaacctcccctctcctcccgggcgccgacaggtggggcccacctgtcggtcgtccctaacctccggcagccgccaccatccgccgccgaaaccaccgcccacgccgccgcttcctttgcatccgcgccccactccgcgcccacacgttcccacgtcaccgccccacgccctgccctcttccgtccgcgcgcgcgcccgcacggacgggattcgatttgaatcctctccccctctctctcctcctccacctcttcacgtcgtcgccgcggaaccgccgttcccgaccacgtncggnctcttcacctctatataaccgaccaccgcgcctctctccacctttttcctctttcgccgtccactcccgagctccctatcgccctagcaccgggcacggacccgccgncattattttcaccgctccggccgcctctagcagccgctagggtcgccggcgcaccccgccatcggcgccgcgcgtccgccatcccttgagccgtcgcgtccgccgttcgctcggccaaatccgtcgtccgagcccgtttctccctactccggtgagcttccaccattgccgccgccttcggccatggtttccgctcgccgtagactccctctctccctctaatctctctctttccctctcttagggcaacccggagcccgtcgccgtcgtcctcccgtctctcgtcgttgccgttcgccgtcgctcctccctcgcgccggccgagcccctcggtgaggatcggtctccctctcttcctctctctccctttgccgcgccgcccgccgcgtagcgccgccgctagggccgctcgcgccaccgcttcggccgccgccgccgtctttgcgccgtccgccgctgcctccgtgcgcgcgccgccgccctcgccataaccggccggccggcttgaagccgagccgagccaggccgccttccccccctttgtgacgctgcccagtgggcccgcctgccagccgccctctctccctctcttagtgccgctgaccagtggggcccgcatgtcggcaccgccccacccccttgctgacgtcagccctgggatgaattattgcgcaataaattgattaagggtttttttttatagtaataaacacagataatcttctaaaaatcataactaattcatccgagctccgtttaagcccattcaagtctcagtaaattcataaaaatgtatagaatccattaaaaatggttttgtttcctgtttcagtagtcttatagcatgttttgcttgtgtgctttgtttgtcgcgtagatttcgcccgtttcgtcgtttcgcggattctcgaagacgttgctgtggtctcatcagtgcgagagcaaggcaagtcatacattgcaattgatcatattgtacctaatatacaaatgtcccgcatttctattaaatattacatttgttttacaatatcatgtgggatgggtcctattactcagccatatattgcttaccttatgccattgataacgtgggtattaaaatgactagatattggtttaggagatgcttagccatgcttagttcaactagtgcacaaagggggattacattaaagcatagacttgattattggcatagctttgatttagtgccaccgtaatggtgttggttaattaaaatacacgtcatggtgggctgtgggtgcatggtcttgctagtcacacccatggcatttaaggaccggttcgcgggatgccctggaagaacttatcgtacttaccacaagccagcgtgggcaaaggctgggcttgtagtgtagcttttctctagccgacgtacccaggcgagggtgggcgtgatggagttgggtcggccggggtgtccggttgatcggcttccggattcaccgcgacacgaaaggggggctgcccgttgcctgctggggacgggggcgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttagaactggttagttcaggtggtggtttgggcctgttgcaacgtggtgtaacgttggacagtgattggttaatatagattaattactacagctgttttactgctttcaactactgcttgaaatgccggctttatgcaaaagaaaatttagcctcccttggatatatcttgcatcatacctcctcttccggtgtgacttgctgagtacagtgggtagtactcagtcttgctctcttttcccccacaccagagttgaagtccttctcagttgaggatgtctcgaagaggttggtttcgtcgctgccgtcaaggatgcctgtggaatggagtcgcccgctgcagaagtcaagccttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaccgagccacagctcgtgtagccttcatttgccctagagatgtccatcgacccccgacttcgtccatctccatccgtgtacttttgtttataaccagactgagccacaaacaaagccttacccactagacatgtggaagtacggtagtgctttgcaatagaggcccgaagaccggtacttatatggccgaggtgctactatcaaaaccatgcaccccgagcccagcctaaaaccattttgaggattttgaatagaggggaaggtgtgagtccaattccacaataatccaactattccatagtgtccaggtgatgagaatattcccaaagtctagagttataaaaccacctaatgttgcctaattaaccagcgaagcatctacctaaattcatactagtggtaccatgagtagagtgtccactagttggggttttgtttattctagggtgaacaaggtaataataacaatagcaataataataaggtcataacaaaggtaaataggcatggctaaataaaatagtgataacgcgagaatttaaataaagcgataacgcattaatttaaatcaaaataattttataaactgggattcaatatgttcaaggatgatgtgacttgccttgctcgctttcccaaacgtcggcttcaacctccacgaagagtggatcttccgaagctgcagcgtctacacgaccaacggaaacgaaaaaggcttttactctaataaactccatataacaagcaggaacaaagcacaaaaatgggttcttgacttcttaaggaaaaattagagacttgaacggtccaattccgagttcaaatggccaagttatgaccatttgaagtttatatgctctttaaatgaatatttgtgaatttctttatttaaattttaatttaaaaatggtttattgtcagccgagggggaggggcgcgcggaccgggtccacgggagtggggcccacgcggcagcctcacggtccacggtggaccgggtgctcccgggctcacaccgccggcgccgtgggccccacgcgtcagccgcacccgagggcgcgggcggctgacggccgggccccacacggcagccactcggcgtacccgaaggcggccatgccggcgcggtcggcaggaggcggcgcgcctgcgcccctatggtcgccggcggcggccataggcacggcggagcggcggccgaaagaggggagggaaacggggaaacgaggcggcggtctacggctcaccctaggtcgacggcgacgacgaaaaaggcggccgtagcggaggaaggcggtggcgtggctcgggtcgacggggtcggcggcgttccggcggtcggcgagctcgacgagggggtggacggggacggcggcggtgcggcgaagccggaggaggcgacgccggggcgggaaacggtcccggcgagcggggagagccggccgaaggtcatcggcgacggaggagagagagggcgacggcgcgagctcgattccggcgaggagacggtgcggcaaggggcggaaacgggcgagggaggcgcggggagggtttaaatggggttggaagggggagagggcggccggggaaggaaggaaaccggccgggaggtccggccgccatcaatggcgccggcgagatttgcgggagcaaatccgcccgtttgaatgcgagagagagagggaaaaatggggggaaagggggaggggatcacggggaatatttccccccacattattgcacgcggggacgacgggaggcggcgggattcgcgatggcggcggcgctaggcgcgggcgaggcggcgggaggaaggggatgacgggtgggccccacccgtcagcgagggtggcgtgcgggcccgcccgtcagcggcacgcgcgaggggaggggccgagtgggccgcggggaagaggagagagggggagggaaatgggccgagccggcccaagagagggaagggggatttttagggtttttctttttataaaacctttttaactttgtttatttcttaacaattattatttgtgctctgaaaattccactaaaatttatttacacattttaggcttttaggaaatatacaaaaatcctctaagccttatttgacttttactttgcacattttaagttttggacgctttcacatagattttaattattctagacataatttaaaggatatattttagggtcgttttgggacgcgacaggtgtggccgacgatgtggctgttccagtccttcttcgtcccgcagctgctgcatggtgcggtggtggggggatgctacttccagccccgacgaggcacggcgggccatacatcgagagtcatctctggaagaagtgagaggactagaagaaggactggttctacaccgcattgccagaccacctgcgacttcggttctccgccgccccccccccccccgaacgatcagccgcatggctggcggtttcggagctgggcgaggagtacgatgtagtgcagactcgccttaggggcctgcgaagccagggcctcacgggggcaatggtctttggcgattacttccgccgccgcatcgtacctctccaagagcggtcccgcggcacgtgggagtacactggacccaacgatcccatgcgcacccatgtgggtgagcgctgggactggggcgaggacgacgcgaagacggtgattcgtcgggtgctgggtctggacaccgccgagcaaacactgatcccagacaggatccttcccatctgcagcgaccgcgaccgggaaagtatcctggctgtgatgtcggccgtcggcgccggcaggggtcggtcccgccggggcagcgccgtcggcatgggtagcagcggcgcgaccgtaggtgggagtcgaaccagtggctccggcgggggtggtagctccagggcacccggcccgagccgcgggcccgggggagattcggccaacgacccgaaaggaaagcggaaaatgtccaaatctcgaccgccctctcctccgtgcatagggggcgccgagcgcgtggcggaccgaccgaagttggacggaagaagaagcggctccggaagaaaggtcagacggagccgtgccgggggagctttatcgagcccccaaattggaccttcaaccgccctccccacaggtacgactgccggcatccgcttcggtgctctttactcatctcggcctcttgttccttcctcttctttttctttgttaacgcgatcagggttcttttgtagcgagattccttcccagggggtctcggcgtctgaccctttgttggggtcaaaatccgagcgaccggagcggcccgggctcggctgatccagcgccgcggggccttcacagccttacggcggggcccacgggccgcacgccgggtctggccccgagtccaccacagtcgggacaagacctgccgcgagcgacagcggccgcggcgtccctcccgagggcgacaccgaggcccagacccgcgtgtagtgccacccgggagcgggggccgaggggggtcgcggcccgaaagctgaggctgggggcagccctgagcccgaggctgaggccgaaactagggcgggcccgagcccgaggccgaggccgagtctgcccgagggcccaaaacgggggggcgagaggaacagccgctcccccttgcatttggggtgccctcggggctggccgcgcgggaggggggttgagagcagccccctgtctcgcgggggatccagcagcactccgtcgttacaggggcggaccgcaactttctcttctccgacgccggcaagtatggagcctctcctgcaggtgctcgccaccgccgattccaccgtccgggaggggctcaacgcccaagtacaagccccggcggaggagcgggcggccctggaggcagagtgggcacagcttgtggcggaccgcgcgcgggttgacgaggggcgccgcgccgtggacgacatggtggaggtggggcgcaaaatgcgccaagcccaactggcagagatccagacgcgtgaggaggcggcactgatcacctcaagcatcctagatgaagcgctgggtgacatccgcttgcagtacgaggcctatgcgaaggacctgacgaagagggtcgaaaatgcctgcggtgtcattgatgcggctgccgcccaagagcggcgggcctcggaggccgacgcctcgctgcgggctcggacggcggcgctcgaggccgaacgcaaggccttggacgagcgcgctcgctccgcgcaggagtttgaggccacggttcgtcggcgaatcgaggtcctcgaccggaaccagcgcgagcaagacgcgcgcagccgggagcaggcgcagcgagcccaggagttggaggagcaggctcaggcgctagaggagcaagcacgtttgctagaccagcgggagtccaccttggccgcccacgagagaacggcgacggaagcggaggcctcccttcgtcttcgtgaggaggccgcagccgagcgtgaccagacgacccttgctgcgaaggcttcggcggcccgtcgtgtagaggagctacggctccgggaagaggcgtgccgggaacgggacgccgcgctcgccgagcgcaaggccgaggtgaaccgccatgaggtggcgacgcgccggctgcgtgtcacgcccagaaattcccgaatagaattccaagtagaatgtgcattaaaatccccgtccaggaccggccggggtacacaagcgacaaagttgacatatagatccacgtcttacaaacattataaaagtcttacataaatgcagcggaaacttaaaagataactagagctaagccttgacttggactgcagcgggaacaccactccacaggcatcctcaacggcacggacgaagcctactcctcggaaaagccaccatctgacgcatactcaaactctggggtttggggaaaatagagcaagactgagtactacccactgtacttagcaagtcataccggaataggggtatgatgcagggaatcatcaagggatagctataatggttcatttgcataaagcgagcatttataaaccgaagatggaagaagaaaaacagttgtaataattaatcaatattaatcatccactgtccaacactataccacgttgcaacaggcccaaccaaccacctgaactaaccagttccatcagactatactagggtgagactaatcacggtgaatctggttgaccgcccataactgcgggcacggctattcgaatagttttactctgattagaggtgtacaactgtacccacaagacatagccccacgacacgtttccgtgtgccgacatgccaccacgacataccagaaagaggccgtgacaggacccttcgcataaccccctctaaccaagcacaccacacctcaggtttcacccccactcctcgcaaggcagtgggcagtcccctctcgtgcctaggtgaatccgaaagccgcataggccgtcgcagggcccatccaaactccatcacgcccacccttgcctagatgcgtcggctagaggaaagctacgcttcaagcccagccgttgcccacgctggcttgtggtaagtacgaggaaggggagggcggcgccgacatgcgggccccacatggcagtgactcggggagggcggttcacggtggaccgagtccacggaccggggaaggggtggcgcgccacgtggtgcacacgtggcgctgacgcggcgcacacatggcagccacgcggcagccccgcgggtggctgaaccgacggccccgatctacctcgggtagatcggacggcggcgaggagcacgcggccggcgcgcacgggcggctcgagccggcccggcggccatggcgcacggtggcgctaccgcggggcggcggcgcggcaaacggcggtgtccgacggcaagcggcggcagcggcgcgacggcgcggcgacgctggcggcggctaagcggctaggcggtggcgcggtgactagacggcgcgggagagagagagaaagaggaggaggtgcctcaccaacgacaagcgacgacggcgagcgacggagggcgatggtgacggcgggacgatctccgggaccacctagcgaacacgatggaaggggttagagagggagagggatttggaacagggcgaggacgccggccgaaggcggcggccatggcagtgctcaccggcgcacggcgcggagtgggttccagcggtagaatccgacgggagaggggtggacgggctggcccgcacgatggcgaacgcgacggcgtcgtcggcgcggctcggcacggcgtctagcggcggctagcggcgaccggagcagcggcggcggtggcggagaggagggcgacggcgctagggcgttagagagcacgggagagctcggcgagattgggaaaaagagagagggagtggcggtggagcttaaatagaggagggggagcccggacgtggccggtagaggcgggaatcgccggccgaagtgggggagtggggaaggagagagaggcaggattcgaaaatcgaatcccggctatctcgagcgcgggcgtaggcgggagagagggggaagtgggcgcggggaacgcgggtgcgagggcgacgtgggcgacatggcccgagagacgcgggagcggggcgcggcggcgccggctggaggaatgggacgggcccgacaggtgggtcccacctgtcggcgaccccgggagagagaagcgggcggccggctcagctcggctgggcctcggccttcggccggcccagcgggaagaggaggcagagggaattgggccggcggaccaatcgaaagaaaaaaagggggaaaagaaaaagaaaaggaaggaaaaggactttcctgggattaaatattgcttgtgctcaattttaattggttaaaattatttctagagctctgaaaattccactaaaaatctggttagcgtattccgacatgtagaactccagaaaaatttcacatgccaaatccgattattgtttgcattaatttattagggtttactcttgctttacaccggtattttcttgagaccatttataacttcaatttaggcttgggaaagaacttcagggtgtgacactgggcgagcaactcgcggaacgcgaggaggccgtcaccgggcgcgaggctcggcatctggagagcgctcgtgccgagcgcgcggcgatggcggcgagggcttctaagctggaaggccgggagaaggacctggcggcgggcgggtagcccggcggcgcgaagttggtgagccagcttaccgtggctcagagcactcttgccgacctagggcgcctggtgcaagaccaagctggggagatcgcggccctccgccttaccaacgagatcggacccgggcaactctccgatgccgtcgatcagctggagcgacttggagtggtccggtttgcccacagcacagcgggcaactcttcaagccacgaatccccgtgcttcttcaagacgttgtacgtcttagtcttgaggcccttgaggatttctacgttggctcgctcgacttcgccgttgctcttggggtgggcaggcgaggcgaagcatagcttgatgcccatgtcgtcgcaatagtcgccgaacagctcactggtgaactgggtaccattatccgtaatgatacggttgggcaccccgaaccgggacatgatgcccctgatgaacttgagggcggaatgcttgtcaattttgacgaccgggtaagcctcaggccacttggtgaacttgtcgatagcgacatacaggtgttgatacctgcctcgagtcgctttgtacggtccaaggatgtctagcccccagactacgaaaggccaagagagcgggatgacctgtaaggcttgagccggctggtgcgtttgcttggcgtggaactggcacgccttgcatcaccggacccattcctgggcgtcttgcaatgcggtcggctagtaaaaaccttgtcggaaggctttaccgactaatgtgcgtgaggccgaatgtgccccacactcaccttcatgagcgtcggcaatgagctcgacgccctgttctcgagaaatacacttcaagagtatcccgttggcggcccgtcggtagagggtcccttctacgagcacgtactgcttagagatacgcgaaagcttctcagcttctgcgcgaccctcaggaagagtattattgtcgagatatgcccagatgtcagtcatccaggcgacgtgacgaggggtgtcggggtcgaccccctcgggccctgaggcccgtgggtcgtcggggcttggggcggaggtcgtggcaccggggtccctcgggggggccaattataccgacggctgcgcgagcctttcctcgaaggtcccaggagggagtggggctcgtgccgacgcgatacgcaacaactcatcagcgattgcgttgtcacgtcggggcacgtgccgtagctcgagtccgttgaaatggcgttccatacgtcgcacttcacggacgtatgcatccatttccgggtcggtgcatcggtactccttggagacctgattcacgactaactgggaatcgcctaggaccaggaggcggcggatgcccaatccggtcgccgccctcagccccgcgaggagtccttcgtattccgccatattgttcgtgtctcggaagtcgagccgaacgacgtacttgaggacgtccccgcttggcgaagtcagcgtgactccggcccctgcactttgaaggttgagggagccgtcaaaatgcataacccagtgcccgacgcgaatgtcggcgtttgggtcctctgcatctccggggagggagggaacgttggacggaatagggtcgtccactggggtccactccgcgatgaagtcagccaggacctggcttttgatcatgtgccatggttcgaagtgcaggtcgaactcagcaagctcgatggcccactttacgacccgaccagtgccctctcggttgtgcaagatttggccgagagggtaggacgtcactatggaaacccgatgcgcttggaagtagtggcgtaatttccttgaggccattaagactgcataaagcatcttctaggcctgtgggtatcgggtcttcgcgtctcggagcgcctcgctcacaaagtagacgggccgctgcacctttcggtggggccggtccttgttgtcaggggcagatgatctggggcgcccttgctcaagggccccaggggggggtctcgagccatgtcaggaccataggcctcgggaccactcgccaaagcctcccctcctcccacggaggcctcggggtcctctcgggggttgggggcttcgggcactgggctttcggggaacgaagtgccattgccaatcaagggggcctccggtccgctctcgtcacgctcgactactagggcggcactcatcgcatggggggtcacggccaagtagagcaccaatggttcctccggccccgaggctaccaagatggggggaggtgaggtaagctttcaactgactgagagcttgctccgtccacacaaacggcccggggcgctagaggagtttgaataggggcagcgccctctctcccagcctcgatataaatcgacttacggcggccatgcatccagtgacacactgcacatccctaagcttgcgggggggggggggcgcatcctctctattgcacgtattttgtcgggattagcttctgtgcctcaggaggagactagaaaaccgaggagtttgcccgccggcacaccgaacacacacttgtcggggttcagtttcatgcgcgtagacctaagattgtcaaaagtctcggccaaatcctgcaacaaagtgtcctggtggcgcgtctttaccaccaggtcatcgacatacgcctctatattgcgccctacctgattactcaaagtaatacgagtcatatgctgaaaagtagggcctgcattctttaaaccaaaaggcatagttgtataacagatagtgcccataggagtaataaagacagttttttcctcatctaccctagccatgcggatctggtgatacccagagtaggcatctagaaaacacaaaaggtcacaccccgcagtggagtcgactatctgatctatgcgtggttaagggaagggatccttagggcatgccttgttgaggtccgtgtagtcgatgcacttccggagcttgccgttggcctttgggatgaccaccgggtttgccagccactctagatggataacctcgcggatgaagccagcctccaggagcagcgccacctcctctcggatgaaggcctaccgctccggggcttgacgccgtactttctgccggacgggtcgcgcgtctggccgcacggcgaggcggtgctcgatcacctccctgggaccccgggcatgtccgacggcttccatgtgaagacgtcggagtttgcccgcaggaaggagacgagcgcgctttcctatttggcgtccagggtcccgtcaattttggcggtcttcgacggatcattgccaagggggatctccttgacgggcacctcgtcagccgaggtgaggcacttcttggaggcgcaggacgcggaggcctccggggcctgcggctccgtggccaccgccaggatgtcgacgcgctgctccgtgcaggcgagggcgaccttgacattaccaaagacggtgatggggccactagggcccggcatcttcatctggaggtaggcgtagtgggtggcggccatgaacttcaccaacgcaggcctgcccaggaccgtgttgtagggcagattgagatccgccacatcgaagtcgatccgctcggtgcgaaagttggtggagtcgccgaaggttaccgggagctcaacgtggccgagaggccacgtgtgtcccggagtcacaccgatgatcggcagtgacggctggagcttcatccccggagccttgagcgcgtcgaaggcagccggggagatgatgctcaggctgccccccctcaatcaaccaggacgcgcttcatcctgacgttgtgaatggtcagggagaccacaagggccaacttccctccacgagcgagcactgttggatggtcgctctggtcgaaggtgaggttcacctccgaccagcgcgccttccgagctgcctcgtg

SEQ ID NO: 78326 - DNA, 998 bp, Oryza sativa
  unsure (1)..(998): unsure at all n locations
tatcgagtatgcagcattgttcgaggaaacgcatattttttggagacacttcaaggggagtgttttcagcgagcaatcaacgggaagtacttgaagaaatacttcccgagcgtttggcaacacgcttaaggaggtactatgacaagtacttggattatcgtcctaagaccaaaacatgttctacgcttttagattcacgttgttcatcaaaaaggcaggggggcatgtgttaacacccaaatttggcacctaggattaaaatagggaaaattgccaaaatttggaagtctatcggtttccttcgagtgggccggtctgaccgccggttgagggccggtcagacaggcggtgtgtggccggtctgaccggcaggtccgagtccgactgtgtttcatcgtgtctcgaggtttacttgctcgggaaggcatgtttcgggtttcctttagtttctaccccgagttggacgtggaggagggcttgtagagggcaagactaacctctatataagggacatggccggttctattgtaagaaaccaatctacaatcaatcaatcgaatcattttttcatattgcttttagttttctcttagtttgtccatctttatcggtttgcgccgtaaaccgtctgccgccgctgcgagagtgtgatatctctttgtaggtttgtcctgaaaaccttccgttttgcccacgagatgggtagttatcttaaatcggcttcgctagcctgtttatttgtcaaaacccatctagatttagctctttgctagatcaaggtggttggtgactctaggatcactgcaaaaataaggtgctacaatcgttgttgtcaacttatctcaaaaagttgccaacagtacgtatgatcgtgcgctctgaagggttcaaagnggacatggggggggnaaaatatgaaaccgtatagagagttgagggggatgcggcataccgctaaaagagagattacggctctaaatctgaatcagcgaaggggg

SEQ ID NO: 78327 - DNA, 3718 bp, Oryza sativa
  unsure (1)..(3718): unsure at all n locations
attacagcccctctaaatgtatgcatatgnacgttagaaattatattgttccctcggcatgcaacatgtcgtcgctatatataaacgagcacatctcgtcgtccctcgccattcgatctcctcaagcgttggcattcccaagttgttatcattcacaagcgtggtatatatagggatcgaccgaaacagccatggcgaactgccgcaggaggatgacctcccctctctcgagtttggtcgccgtcctcctcatcgtcgtcgccgtgcagtcccgaggtattctaagctcaatctggtttcttctatgaacttgtactgtattttctgacggatcggatgacatttaactgactatgttgtgtgtatgcatgtatatcgatcaattaactagcatgggcgttggatcagctggatgacatggtgccgatgaagacggcgaagccggtggtggtggccatcgccggcggcggcggcagcggcgtagtagggacgttggcggcgccgttgtgcctgcagtgccggtgctgctcgaaggcgaacccgagcaactgccagctcactagctgcagctccaccttcaactgcgaccctgccggcaagtgcaccctcgtccagcagcgctgcggctgctagctgcattcctagctagccggcgagccgagcgtgagctaatgcattggatgccaaagatagttcttgctgaaagtataagcatgtatatagagatttaatttatgtcatcaataaatcttggcgttaaacaaagacaaactgattaaaaaaatgtggaacttaatataataaatgcgtactggtggttctgttctggatgatctctggactccattaaggacgtgtttggttcgtggtgaaggttggataggatatagacatcagatatggtggggtctaattttttatttggttgggtggatatcacaatccagttttttttgttaggtacatgagaatgagaatggattgaatgaaaaacaataacatattaattaatagtaaaatatgttaattatcatgactatagccattctttatactaattaacaacaaaataaactaattatatctaatcaacactaattttgataagttaattactaattaacaacacaatacattaattattgttaatcaattactaatgatcaagattagcaaaggtggatatcctcatccagccgatacacttatctagcatcttcgtggaatatttccttttcaggtcgccctatccacccttgtccaccaaccaaacacactcaaaaactgaatcgtcatctcccatctagggatattcctccaacaaaatacaccctaataggcgcaccaggtatcacgtggacagctcactgtataggatgttggacgatacgccacgggtgagcaacatgggccgtggtgaatggacagtgagaaatcatgcgtagtgcttcccaaaaatctcattcaccattcacccttctaggactttaaaagcgatagttaggtagacctgatctcctgattaccagtgcacgccgacgagtgaaatagactataaatgatgatgaaatacagagatatcggggtatgtgatcagaacaccgtcacggtctccacaactcgtatctgaaccagataagtcgcacataaccataccaaattttataccactctaatgcatgcactgggcaatccgatgcactcgctagacatgtcattcgtttctactacaaaacgaagccacgtatgtgtgagcacaaagagtcaattattttttatgaggcaaagctatcgagcgctcgtgccttcctcaacaatgtatattccccatgtgttagtgtgtatgtgcaatgggaagcagatcctttgacttaactgcacatgcagttgagtcactggcatatgggtcccactttgctatggcccacatgtcagtgactcaactgcacagcagttaagtcagaggatccctttccatgtgcaatgatatagcaaaatacaccaaactagtacgctaaccgcctttattatttacaagcaaagtgtcagtgcattccaataaaaaatacgaaaaaaggtaggaaaagaaatagagcgtggttagaaaacggtcgagacgaggtgattgttgggaaaattgactctcagtatggaaaccgggagacaatcacacacgttgcttttccacccattacccatgcgagattaacgcgattaattcatagttatttccataataacgcattaacgtgattggtcatgcatgaacattccttttgggattacccccgatacccacagcgccatataaaaagggaacgccagcgtcgtgtcatggtgacgatcgctacacgatcatctcgttctcgataaacactaactaatctcgatcctttactaagtgctgaagggtcatcaaacggcggtaccatgccagtgcaggtggcaccccgaaggacgtcgccatcttgcaattgatcgccggcaatccctacagatcaagccggtgaccttacctaccccgctgctacgactactttctctacaccgaacaccggagcggttcgaggaactgctatctctacatccactccggccatcggcaacctcaggacaactacggcatccatggcttccaataatggtcagtcaccctaagtttctgtattatggtgatcatgttaggctaagcacttatgatttagcctcatgatcccatcatcccatttagaagccataagatgcatctaagcctctatctattgagtgtcggtttgatgcaaaatttggtttcgatttatgttagttagtccttaattatcatcagattatgattagttaggttcgattaggttttaatttcttgatgcccatgactaattaaatttgtgtctgcattttaagatcgattactgcttgggtagaaattaggaggagaattgcagcggataaccaaaatctctaattttcacaaatgctaattcaagaaaatccccaaattagaacccaaaaattccccacaatccctgcaaatccctaagaggataagattgatgtcttaccgattcctcgaatcataacgcgagcaccgctgtgcacgcaaccccgccgtgtcatggatcggccttgcgcctactctcatggcccatgcagggtgagactcaccgtcatgttttgccgcacgtgaggacaatcgagattgcactgttgcactagcattagccttgctacgcactcaccgtcacgatatttgactagggctcctacggcaccagtgtgttgcacgagcaccgggtaactcggtcggccacgaccccttcgttgcacgctgctgggcaccacaaccaccgcctcgcacatcgccggcactccgatgcctcacccgattcgccgctgttgtcgccattaggagtagaagaaaggggattggaagaaaggaaatgggttttagggctagggttttggccaatcggccatttttctcaatccaatattatctttcattttgctctatgatgaagttttactccttgtctggaaataataatgttttaatttatttacatagataatatgcatagcttaaagtgaagagaaacattgtggatagaagcaccacaaagtataatctcaagagacacacgacaaagtccagtcgatacaaagacttcacagtcgcacacaatgattatgaaggatgtagcttacaaagagtcta

SEQ ID NO: 78328 - DNA, 11800 bp, Oryza sativa
tttgaaaaggctatattgaagaaatttcttattttgttttggttctttctatatgcaaaaattaagggcccctttgatttggaggaaaaacataggaatttttggaggatttcaatcatataggaaattttatatgtttttctattcctataggaaatcaattcaatagttgaatagcaagcaatgttcagaaaggttgaatgtgcacttgatatgttaataaattacctttcaaagtatgtgtactttctaatttttaaatgtgattttatatttccttgatatatattatgaaaaaaatgccttgcacgtgcataattactagtctttcaattaagtaggagtaaaaacacagacaagttacagaaaaaaacaaaaaacaacttctcagcgagaagaactcgccaagcccctcaactgcgaccggtacaaccacacagcacacggagcaccacaccactctatccaaactaccaatgagaaacaacgacagaacccaacgacaaagatcgatgttgagatgctgaaaaagcggtacaaagctttgactttgacttcgcgaggcacgtgtcattgttgccgagcttgccgcccaacatccaacagctccgactccacggcggtcccgtcatcgttggcaaaggcactgccaaaacaatcaagacaacgccaaattcacatgttcaacatcagccaaagcccatgcatcggcaaccaccaacacccctagacagaaattgcaagtgttatcgttgccaagcttcatcgcacccaacaacatagcagctccgactccatccgacagaaacaaacgaagagagttggatgccaccaacaaacaagaaaggagccaagaaggcaaaggcctcgccaaacacctaggcatctagtgcttcgagccttcgagttgacacagtagtctaccaacgatgatcgatgcatgggtaaggttctccaaaacggcgccccatggacgacacgacgtgaaagcgccaccaccgcttgtccggaaaccggatcaaggttttcacctagagattggtagcgacgaaggaaaacaccataacgacgccaaaggtgccgccttcgtcagccacccaaaggctaggcaaggctttcgctagcgagttccattcagtaccaccaccagcccacaacaactgtcgccgaaccaccaccttgaccctccagacaccaagctagcccggtcgaccaccccacggctcaggtaggctcacagcaggatgtcgcaaagccaccgtgttcaccctctcccggaactccccatggccagaatagggttctagccataggaggggaggagttccacggagaggaggttactcgaccagcaaacgagaagatggaccgccgtcgccgccagccgcttccccgctcgcaccaccaatccttgagaagtcgctacctccttgcaccgccacctcacgtcgttggccaccccgtagtagaccatcgccatctccatttgcaccacacacggtaaaggacatcgaccggagagaggacgacccctcccgccatccatggccaacgacgatagggctgccgactcccacgtcgccgatttggctgctctccctgtctgccacccgagccaagccaagggaaccctagatctaggagtgtttgggaatggcaacgaagctcggggtgggagctcctccgccacgcaccctgacgcacttggtgccaagctcagggcggccgctcctcccctcgccgccatgtagccttcgcgccatcgccgccgcacggcctcgtcgtcactggccgccccttcctagcaagccacacggtttccgacggctagcactggcggcggcgaggtaaggaagaggggaggagggtggcggcactagggtttagcgcgtcgccctcgggccaccggtctgaacccgcggtccacctgggcgcccaacgcgcgcgcgccgtcctcttcgcacgtcaccacatccgccgccccttccacgctcctcgttggtgttggtggctgttaaatgccaattctataccgccaacatctacataaggatcagataataaaacatccaacatagtaataggtgtttaatctcacatattccacaagtgttggtgaatatctatatgcagatgataaatcccagtgctgggaggaaaatcagactaaagtggggagaattatatatccatgcaaggaggggttgtgaacttcatcgaaacatcggtgaatcagcccaaaactccgagaattggacagaggaggaccagaggagaaggcaggccgaaggccaggccggggggcccagcccaagttcggccgaaccccctggtgagcaccgttggatccaggttttggcgtggacggtcctgatcatctcctgatgacggttgcgggcatttccgacaattcgcatagtacaaccgtcatacctacctctatataaagacctcacttcactcacttcaacacacacttccaagcttgagctgaattataagaggctctatttcactatattgtatactagaataggaagagagtagagtagaagaagtcggaagaattccgaagctgtcggtaatcttctcctatttcttttattctgtttattactctgaattcaatataatattcttcctgagtaatttagatttatcttgtgagaattatctcttggttagttcctaaatagcatatgagattattgttcactataatcaactaaaatatagtgattgctttggtgagttagaaacactaaagtagatattaattacttagacgtggtgtttaggtaattgttatccagtaattgttgcgtatcccacagtacgtttgaggtaggtgtagaggtggtgacagccctcgagatcacttaagtcctccctgtccgggtacgaagtagagcgacatccaggaacagcgggttgccagtgcctgaagtattgtgttaggattaaagttaagctttcctaaacattgtttctcactagtaaatcctctctatcctggcctattttttgcttggtgtccttggatgaaccggaggaagctctgatcacacacgttcccttggatttgatacccttggaatactccgtaggggaagtgctacatcggtgtatccgtgcgcttgcggattttatctgtaaacgtaagaaataccaacaagcatttctggcgccgttgccggggaacggttgctgatcatttccgaacattgtttatcctcgtatcctttttcacttttttttattctaccttcacccctactatcctagagaagtattcctgttaaactcttctcgaccatggagcaacctctttttgagctgtttgctcctcggggcgaattctatgagacacctccttcatcggagcccatttatacagctggctatgaaattcgtcccgaactaattagtatggttaacaaaaatcctttttctggctttgatctagaaaatccctaccatcatctacgagactttgaacaagtctgctcatgccttaagattcgtggcatgagacaagaaactgtgcggtggaaattgttcccgttctctcttcaagagagagcaaaacaatggtacacttctaccgttggatgtgtaagcggtagctgggaaaagttgcgagacagattctgtcttgccttctttctagttactcgtattactgcccttcgagtagaaattctcagtttcaagcagatcaaaaacgaatcaatcggtgcagcctggtctagattcactaatttagtgtagtccggaccaaccctgtccttactcgagtatgtgctacttcaacatttccatacggctttggataaggagtctgcattctatctagacataaccgctggaggatcgttcatgcacaaaacgccgtcagaaggaagaacaattttggatcgtattctagaaaatacttccttcatgacgcaatccgatgaaccccagtcgaaggcatccgtgtccaagatagaggaacctctaacgatcgagccactcgatgaaccatccacttctgctagctcgattgatgagaaggttcctgagcagccgtctgtcgagaatgaagaaattcagactacagagcgtgccgcaattttgtttagggacggttttgatgaagactatggcaataccccgaactatttcagcaagaagaaaccactcgttcctttgccacctcccgatcctatggaattgggcttcctacgagaaactgtctgggagttaacatccataatgcgcgatgaatggctaagggagccagaactttcatccgaagtaattcggataaatactgctccccgaatcattccttgccatctggaagggaacgacgtcagtattctctatagtccaactgtcggggacaatctcatttccgagtcttttgcattcgcttatttaagcgataaggcagtgactccgacaaacaaattcttcaagcatccaaacggaaatatcatcgaaggatttgggattgtacaagatgttcctgtctgctttgaagacagggaggcgatcatggatttccacgtctttgaaatccaagattttgacatcctaatcaggctgcccattgagcaacttctcatcaacacacctcaattagatagcctcagaataacgctggaagggaatgaattctcaattctattctcacgggcgaggatcgccttgactgaccccctcccagaaattgagtcagcagaagaggttactgtagttcctcctcatgagtcttccaaggcccttctagaagatgaggtctcagattttatcaaggaagaagcagaccccggtgagactctcgacctaccaatcatggaaccaccacctcgacctccgcttgagcttaaacctctacctccaggcctacaatatgccttcctgcataatcacagagaggcccctgtcataatcagtgacaaactctctgaagacaagactcaatgtcttctcaccgtgttagaaaagcatcgttctgttcttggctactcgctccaagatcttatggggattaatcccgcgctttccacccatcgtattcctattgaccccgagagtactccctctagggaacctcaacgacggctcagtaatgcaatgcgagaggttgtaaagaaagaggtcttgaaactcctgcatgccgggattatttatcccgtaccatacagtgagtaggttagcccagtccaggtagtgccaaagaagggaggaatgacggtcgttgcaaatgctcaaaatgaactaattctgcaataaaccgtaaccggatggaggatgagcatcgattacaggaaacttaacaaggctacaaaaaaggatcatttcccgctacccttcattgatgaaatgttggaacggctggcaaatcattcctttttctgtttccttgatgggtattccggatatcatcaaattcctatccatccggaggaccagaggaagactacgttcacatgtccatatggcacctatgtatatcgtagaacgtctttcggactgtgcaacgctcctgcatctttccaaagatgtatgatgtctattttctcggacatggtcaaagatatcatggaagtcttcatgaatgacttctcagtatatggaaagactttcggtcattgtctgcagaatctagacaaagtcttacaacgatgccaagaaaaggacctggtgcttaattgggaaaagtgccgtttcatggtccatgaagggatagttcttgggcatcgagtgtccgatcgaggaatcgaagttgatcgtgctaaaatcgacgttattgatcagcttcctcctcctatgaacatcaaaggaatccgcagtttcttgggacatgctggcttttatagaaggttcatcaagaacttttctacaatcgccagacccctgacaaatctgctagccaaggatgcgccctttgagttcgatgacgagtgcctaaaatcttttgaaattctcaaaaaggcactcgtctctgctccaatcattcaacctcctgattggactctgcccttcgagatcatgtgtgatgcaagtgactttgctgctggtgcggtcttgggccaaaccaaagataaaaagcatcatgcaatcttctacgctaacaaaactctaaccggagcctagttgaattatgcaactactgaaaaagagctgctcgcggttgtttttgctatcgataagtttagatcttacttagtgggagccaaggtgataatttttactgatcatgctgctttgaaatacctgctcactaagaaagatgctaaacctcgcctcttaagatggattttgctgctccaagaatttgacttagaaattaaagataaaaagggagtatgtttagttccgcacccaggccaagatctggcaaattggtttcttctggcccacaatgtaggaagactcaaaagaattcgtcagaagatgcataagctgccagaggcaaggaggaatcactgctcgcgatgcaatgcccctcacatacaatttgcaagtcgagatattcgatgtttggggtatagacttcatgggacctttccctaagtcttgcaactgcgagtacattctggtggcagtcgactatgtctccaagtgggttgaggctatgccgtgcagtgctgcggatgcgaggcatgccaagaagatgttcacagaaatcatcttcccaagatttggtacccccaggatggtcataagtgacggaggttctcatttcattgacaaaaccttccgagacctcctacgagaaatgggagccaaacacaatgtggccacaccttaccatccacagaccagtggtcaagcagaaacatcaaacaaacatatcaaaaacattatgcagaagacggtcaacaaaatgggaataggatggaaggatatattgccggacgcactgtgggcataccggacagcgtacaagacaccgttggtatttcttaacgacattgctagaaatataattcccagcaatggcgcagaaatacttctggtatattatggttacagagttcatccgcaagcgcacggatataccattgtagcatttcacccgagagtattccaagggtatcgtatttattttatcccgtaggaagatcatgtagagagaacttaactaattacttatatattacttgtgataatcatattctaagtaggggttaagataagtccaagggtagagtgacaaacaagcattaactactcattctcataataattaatctaagctaggtggaaagaaaagagaaagagaatctattcctatacctctaatataaatagtatacatacattctagttaactggtatactagctaataccctctatctgatgccctcctggtacttcgagaagccacccctgactgccgagttccttacgatagcccgtcatgaccatccaaccggggctaaatatggaggaataccctccctaggaaattaacttaggattatttataggtgcggaggaatacccgtactgagctgtcaccatcagcggcccacctctcatccggaatatataatcctaaataatgatatcccgtaatctagacaccatgtctaaactaccagatactactctaatatcatcgtcatgacatagagtaattgcataagcaaacactatacccgcaccaaagcatctcccagataagctagcaatatactcactataacatgaacataatgtaaagtaggtactcatatactcggaaagtattccaataccagaaatgtacaaagaagagtattctaataaaagtacaaggcttacaaaagaggaaaggaaagctactagagccatacccgaactcttccgaagactttcggactcctgattcctattctaattctattccaccagctagatactactaactaaacttgagaggaatgagagagctcttgcttgatgtgtgtgttgaagtgaagagagtgagcttcttaaataggtaggtaatgacggttatggtggttggaaagttcggtaattgtcacaccctaaaaatcctaaatatataaattgttgcttaaatggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatgaaattgcatttaatgaataatttaaattgaaaaaggtttttaaaagtctcttttggctttgggccgaaagacggcccaaaaacctctctccctctctccctcggcccagtcggcccagtccagcagcagccgccgctcgcgcgcgcgtccgcccgctgacaggtggggcccacctgtcggagtcatcgtcttcctcgcgtcggccgccgcccgaaaccctagcgccgcgccgccgtcgccgtccgctgctcctccgccgcttctttggtcaccggtgagttcgccgcaacgttctctacgtcctggtgccctccgttcgtgccgaagcgccgtcgttcgccggcgagcttgcgcgcccgagccgccgagccgccgccggagatgacgtcaccgctgacgtcatcagggtctgtctgctgtgagccgccgtggaccgctcgatctcggccgtccgttttggatggatcgatctcggccgttcgttcccgtgaaccgctgccgtgcgcccggtccaccgcaaaccctagccgctgacgcaataaaccctttttccttttcaaaaataattcattattgcgtcataattcaattaaaatccatataagtgttttaaatcgatttaatctttgaaaattcataactaattcatcttagctcggatttagttggttcaagtctctaaatttttctaaaattgagatctacatgttaaaaatatccacatgtattgttcaagcttgtttatgtgctgtttgggtgtttttgctcttttctgtttagattccgacgtttccggagagtccgttttcgcaggagaagaatttgaagagttccaaggccagcaaggcaagtcacacagatcccaaacaatcctttgagcatgttgatcccgtttaaagctattgtttctattcaactatcgcatttattttcgaatgtcattgggtggaattaacctattgtttgttatagcccttttgttcttgaatactttattccttgataccttgggttattataacttgactagttgggctatatatattggttcgactacatattagatgtgattgcttagccatgcttagaaacattagcacactattgggataacttatgactcactattatttaatgatggcttaatgatagttcacgatggtcaatcgtgattggttaattaattacttgccaattaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataaacccacgggggtcgctggggagtccatgccttgtttataagggggtgattatgatccaggaaaggtgctctgtagtggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcatgataacagatgctataactggtaataatttgtttagctcctggtttggaatggtatattcctggtttggagatagatctgtacagccgggtatggttgttcagaaaggttgggcctatacaacagggtatgttgtatagcgttgaattaatattgtttaattattacttaactgttttattaaattctgaaatgtttattaaaggctgtttatgcaaatggaaccctattatgccatcctttgttatcctgtgcacttgcatatttgctgcgtgacttgctgagtatgtcatatactcaccttgcaatcattcatcagaggaagagttctacagtgaagctgatggtgtggaggattaggtgtagccctggtcaagctgcctgtggagtggagtcgtctgcgccgtttatcttatctttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttagtatcagagcccccttgaccctaggttatgccaaatggttatccatagaagccctctaaaaatattggaaaagtagaattgttctcctccccttctcttttaattaaaccaaactaatggcacatgcatttcataatctcttttagtggttctcattcaaaatttattccagtgttattagtaccgtacatctattactgtactaatggctcatctaccagcaaaagttttacaatattgttttatttagtcttgctgcaatgaaataaatttagcatgttgattttataactttattccttttgaaaccggttgttcaaaagtacaaaatttgtgacctcgtttccagctgtttcaacttatcttgcaagcttggtttattttatttacttaccttttactttgattttctaactttattcaaattaatccaaaaacttgtgctattaattggataaatgtcttaactccctcctttcacttgtctttagatgccgcgctataagcctgagtacttgtttggtgttgagggatttgtccaagagttgcgtacgatgtcctttgtcataggatttgggactgcctctttttatgcccagattcctcatgatcgtcctgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgctacagtgatcagttggccgacactgagtatcgctaccatcctcgccaaccacagggaagtgaccgtggcagttaccttgacactgaaggaattgagaatgatgctaccacaaggcatttggttgagatgctgtgggctatggatgaaacccgtgcggagactgtgttagcggctcaagatcatgaagatcggaatcgtggtaagatttgcaagctagaggacaaggtggatcgtttggagaaggaactagccgcattgaagggagaagcaccaccgcagaaggccaggattcgtcttaccgcaaggaagagagctctatttgtccctcgttaccaattggcgccaaaggtccgtgtggtggaaaaagaagttaccccagccctagcggatcctccggtcgtcaatataagtgatgatgaaggagaagaatcgaagcgcacccattccaagatcgagtggggagcaactcaagatgatggagacgagccgaacgagccttcaatcaactccgatgctcggaagaat

SEQ ID NO: 78329 - DNA, 6720 bp, Oryza sativa
tccaacaatatcttcatggtaccatcctgcccttcagtagcagcaagatgtaatggtgtcccacagtcagataacgggtcaacataagctccttttgcaagcaatagttttaccattttacaatcacctgaataatgaaaaatccatcgagtatttaatacaaaagaggacaattgtaaattctaacaatctctttctattgcaaagttattgaaacccctttttttccagaagatgtgctacaaaaaccaataaaagaaagtatggcaaaagaccaagatctacacagatctacactttcagcaaaatgacaagccgataaacagggaaaattgaaaatgcgtaggaccaatggcatattttttatgagaatatgtattcctagaaattacaagaaaaccacctcataggaaaaaaaacataaatgtttattgtatccactgaacaaaaaagaaatttacgtaaaaataacttttagaggatgcgtacacagcagtattaggttatttaatgacaattagcagtatttagttattgtgttggaacaaagttttgcttcattattaacataaaggaagaagaatatcattatgtaacaacagaagattgcttatagtaaggaaataacaccacacactgtctattacaacagaaatacagaacttcataaaaaagtgcaacaaacatatgcataacagtgatactcgtttatagtgggggacctaatccagcagcagaatgcagaggagttaggccaccctcgcttgctttgtctttatttgcaccgtgatcaagaagatacttgaccgtgcctatgcgtccactgtgtacagcagaaaccagaggtgtcctccctgtcaagcaaacaggtgaacacctatcaaaacagtatcttcatctcaaaaatatagagccagaaagagcttttccaagagaatggcattcagaagttgctactctagagatataatgcaggtatgtgaaatttaggtgatgtgaggaataaaacagtaaattccataagacaaaattgggctaattggaatggcataaaacattgatcgcacaagacaaatttggacagatcctaatggcaagtgtaaaccttcaattaaattgtatagtcagtgcagaacttatgcagaatcaagtacatattcttggagaatgtgaatatgtgcaaataagtgaattaaaaaactaacatggatattatcttggtaatattttataattggaatggccacgatcatgaataagcagaggataataaattggggttaactggatccatgccattataaatttaccagttttaaacaatgtcattataactctgtctaattggatatgccaccacgtaccctttggatgcagtgaaattttattttagactaaattgccctttatcttctacctccgtactctccactcttcctcccatccctaagcagggatagcggcagacccacctcctccccaagccccgttgccggagccaaactcccacaccttgcgtccacccaacaaaaccaaaactcgaagcatatcggcttcatcaatcaatgatgaacccaacaaaattttctatctcaagaaatttctgcatgtcttttgtttttcccccggtttggttgatggtcaaaagcttggatttcagagtgcaaacttgctcgcatctgggcaaacattggatattttgaatgattttagcgccttgtcttgattttggtgtttgtttgcttgggcatctttggagctaaaggtttaattttgggaggatatttagcggttcgcagacatttggtgggagcggaggacatgaagttcttcagcaccgctacgtgcccgcaaagccaacctactcgcccagatcctcgagcccgacggatgagtttgtcaatgagcggcggatctgggagagagatagagataagggtagtttggtccaaaaaggaatttcagtgcaaacaaatggtaagcagttgcatatttctaattttaatatatttgcaatggaatcttccaattagatgaattgtaatggcatttttcaaaaggggcaaatttataatggcatgaatccaattaaccccaacaaatgggtatggatgctgaaccatgctttctttattataaattcacgaggtaaatcaaaatgacatccagaagctttttatggcatgcacaattctagaaggaataaaactattgattcaaaaaatattaattgagatgtatatattaaaacaaaaaatttgataatttgacacttttttcgatgcccaattactttaactgacatttgtgatgatgacatgtggggccatctgagtgaatgaaagtgggccaggatatcaaataatcgaaacccatttaaaagagtgttaaattatcatatctcttagtctatgcatgaaaaccaggacaccccacaagcccccaatgcaaagtgaaagttgcatattgtgacaaccaaaaccaccctacaccgctcactgggaacaatcagaactatgcaaactagggtttgtatccagagaagcagaccttctttgtcgaggtcatccacatcgaaccgcatcgtctcaaccaggtacctgaccacattcatgctcccgttgatggcagcgaggtgcagcacgccggcaccttccatgccttgcacgcctgcctgcctcgcctctcccacggtctcccggaggcatcccctccccgtatccagcatgttcgccaggtctggatcaaacgaaatcgaacaacaccaccacagcacccacaaagaaaacaaaaaaaaacggaagggaaagaaaagatcagcaccgggagaggagtcgaaatgacgaaatccaagccggtaggtagaatccacccctgcatactcttgaagccgcgcaggttgtcgttgtacgccgcctcgaggagcatgtgatgcgcgccggcggcggctcctgcggcgggaaggggtagaggagttagcggcgggttcgttgcgttgcggcctgaggggctagtaggattagctagcggaggggggctcttacctgggctcaaaccggaaacatgacgcggcgacgccatgggtgggggtgatgggcgaggtgctccggtggagaaaagtagagatcgctagggtttgagagttggcactgggagagaaatataggggggaagtaggagctgttgcgtggttttgaaagggaggggaggaggagaaaggggaagaattggcggaaggaaggtggaagcgtatgcgggaagctcgttggatactgcgccactgcgccgtgaaaagagcgctggttgcccagcaacaacactagaggctgacatgtgggacaagtttgcactagggcccatgtgtctttcattactattgcaagtacacgtatcacaaaatggagtatacttttttttttttactaaaccggcacaggaactgccaattatctagactaatataaaaggtacgagttgtttagtgcaattaacaccgtaattgtaattagcgtcggattaacgctcccacgccttttccccatcgcaaaatccctgcccacgtcatcaaatcccgcgccgccccttgcctctccctccaaaccgtcactgggcggcacccaggatcgcgtgccccaccctcccgacgcccctacccgccgcccccgccgccgccgccagcggcgcctcccgctcggccccgaccggcgagtcgcgtaggagggaagcgccacacttacacaacgagaggaagcgctgctccgggggcacgagaggaagcgaccacgtgccccaccctcccgacgcccctccccgccgccgcccgccaccgccgccagcggcgcctcccgctcggcctcgaccggcgaatcgcgtaggagggaagcgtcacacttacgcaacgagaggaagcgctgctccgggggcacgagaggaagcgctgctccgggggcggcgtccggcgcggcttgactcggacgcgacggcgacggcacggtctctcctccggtggccaccttctcctcggtgagttcatcccctacccctcttccctcctcttctagggttagggtttctcgcacacgtgctgctgctgcggcagtgacggcgcacgacgatggtaggcgtggcgggggacgccggagagtcacaccctctcgccatggccgttgaagctccgttgctgcggcaaggagaagcagcttcaagagttctttcttccactgtttcttgattaagctcgtcaatggaagcaggcagggccagtgttagtgtaggcatgtagctcactgaattgtatagagtaaatttttgttcagatgttcaacaaagagacaaaaggcacatgcattgtacaccagaaataatctaggcaaaggtgatcatttaatggcacagtgttctaacttctaagatattattttcagacaagttgggtttgttctgacatataatggggttttcttcttctcagcttattggttgacatgagcttatgctgaaagacaaaacagtcaaaaacactgctgaatgcagtacaaagttttaccttactgaaattaattagtttttgataaataaactgtattcagataaataaattagttcaatgtcatgggcatgggggtgcttcaattagtagctgaatagaagggacattttttggaatgtagacttcactctaaacattttttgtgacttgcagatcttttacacggagacttcaaatctactggtttcttattttttaatttttcaaattcaagccttacaattcaattgtagactaatttagtttcaaatgaacaccaatggacaatcatgattcattttagaattagaaatcttattaccactgttactagggcagctgtggcacatatcgaaagtagacattttgaaaagcagaacatgtgaagtgactgacttgttgtagagacatgcatctgcatatgatgggaagtagagatagagcttagggcttcttgtgtactgcaatcctgaatttacagcattcactgcaatcaccattgcttatcatctccctggttccatgccctctcttttttttcgtgtcttagtgttattctatttcctacatgtgaacttttcaatagtatagtattgatttcatatatgcatcgatttcatatatgcatcaatgttcttgaccatcagcaattaagttagtatatttttgttctgattcttgatcatcaatcacacacacctgtcatattttgctgaaagattcttttggttgagatgtgcaagcagcaagcagcaagcaacaacctacagatagcagtccattattttaaatgtcgtttttggtagttaaaactatgaaaaatgcacataaaaatttctcttttctacatcatagattgagatcacagccgccaatccgaaacaattggtcactgcatagaagtgttccttaaattattgcagtttcagacagaaactaaagggagctttttccctgcaggctttgggaagaaggaagtctgcaaggatactggttttgtgcggcatcggcaaatgttaatcctgaacctttgaatatgtatattgttgatgcaacctttgaatagagcaaatgttgatactgaacctttgaatatgtataagttagaaggtctgctgcttcataatagtagatcatatgtgtatttctgaatatatcttctttgtttggttttttccagtacggcactctgctactattctaggtacatgtccgcaacctgtaatattattttgcggtgtactgattgggcggttagatttcgaaagcaatctcaaattatctgtcctatccaatctattgccagattacccaggtgccatgtgcaatactattttttttttaaaaatgtggcaatcaggaagtttgagaaccagtatgtactcctaccaatgaagtttggaaagaaaatttacatagtttgtggcaaataatgttcaggtttgcagattaacatgctaccacggtcaaaactgtatgtaatacttgcaagtgtcagattttgtttgttcccctactttactaaaactgtaaattaggttaataacttgtttctgatatataacaataaaagaaaccatgatattaaaaagtatctgttaatgctattaggcatctgaatatattggcttacttctattgtttataatacaggttgacactgtcgacaaatgaagattttggtaaaatcctatcatgtttgaccatggtgtttcactgttaggtacacggtatttaggagctattcgtatagtaaatactggaatattgaagtaaattatatgttcagcttattaactgcattgcaatatctttgatctggagacggttttaattttcatttgtgtggtcgcatcctttaatttatataacttcataagaatatactccaaagtacatgctggtttatgtatttttatgccttcctattctaattgtctaatggctcttgaacaatagatgtaaactacgatgtctgaagttttccatgttttcttccttatgaaaatgagatggagctatggcaagctgctttggcaatccaagtttttcatgtggcttgagctgaagggaagatgcctcatggctgacaatctacagaaaagaggtggcctcatcaagcgaattgctccctatgcaacctgacgtttcaagatgacacccaaccttttctcaatgtgcttttcacaaac
